US008778358B2

(12) United States Patent
Telford et al.

(10) Patent No.: US 8,778,358 B2
(45) Date of Patent: Jul. 15, 2014

(54) **IMMUNOGENIC COMPOSITIONS FOR GRAM POSITIVE BACTERIA SUCH AS *STREPTOCOCCUS AGALACTIAE***

(75) Inventors: John Telford, Monteriggioni (IT); Guido Grandi, Siena (IT); Immaculada Margarit Y Ros, Siena (IT); Cira Daniela Rinaudo, Siena (IT); Domenico Maione, Siena (IT)

(73) Assignee: Novartis Vaccines and Diagnostics, Inc., Emeryville, CA (US)

( * ) Notice: Subject to any disclaimer, the term of this patent is extended or adjusted under 35 U.S.C. 154(b) by 898 days.

(21) Appl. No.: 12/906,510

(22) Filed: Oct. 18, 2010

(65) Prior Publication Data

US 2011/0110982 A1 May 12, 2011

Related U.S. Application Data

(63) Continuation of application No. 11/192,046, filed on Jul. 29, 2005, now abandoned.

(60) Provisional application No. 60/697,643, filed on Jul. 11, 2005, provisional application No. 60/695,453, filed on Jul. 1, 2005, provisional application No. 60/693,001, filed on Jun. 21, 2005, provisional application No. 60/673,754, filed on Apr. 22, 2005, provisional application No. 60/660,321, filed on Mar. 11, 2005, provisional application No. 60/640,069, filed on Dec. 30, 2004, provisional application No. 60/633,418, filed on Dec. 7, 2004, provisional application No. 60/616,833, filed on Oct. 8, 2004, provisional application No. 60/609,833, filed on Sep. 13, 2004, provisional application No. 60/592,805, filed on Jul. 29, 2004.

(51) Int. Cl.

| | |
|---|---|
| ***A61K 39/09*** | (2006.01) |
| ***C07K 14/195*** | (2006.01) |
| ***C12P 21/04*** | (2006.01) |
| ***C07H 21/04*** | (2006.01) |

(52) U.S. Cl.

USPC .................... 424/244.1; 424/190.1; 530/300; 530/350; 435/69.1; 435/69.7; 536/23.7

(58) Field of Classification Search

None

See application file for complete search history.

(56) References Cited

U.S. PATENT DOCUMENTS

| | | | |
|---|---|---|---|
| 4,454,121 | A | 6/1984 | Beachey |
| 5,098,827 | A | 3/1992 | Boyle et al. |
| 5,354,846 | A | 10/1994 | Kehoe |
| 5,378,620 | A | 1/1995 | Adams et al. |
| 5,391,712 | A | 2/1995 | Adams et al. |
| 5,445,820 | A | 8/1995 | Seidel et al. |
| 5,585,098 | A | 12/1996 | Coleman |
| 5,700,648 | A | 12/1997 | Kehoe |
| 5,821,088 | A | 10/1998 | Darzins et al. |
| 5,846,547 | A | 12/1998 | Cleary |
| 5,968,763 | A | 10/1999 | Fischetti et al. |
| 6,174,528 | B1 | 1/2001 | Cooper et al. |
| 6,372,222 | B1 | 4/2002 | Michon et al. |
| 6,406,883 | B1 | 6/2002 | Lutticken et al. |
| 6,420,152 | B1 | 7/2002 | Adams et al. |
| 6,426,074 | B1 | 7/2002 | Michel et al. |
| 6,579,711 | B1 | 6/2003 | Gaier et al. |
| 6,635,623 | B1 | 10/2003 | Hoogeveen et al. |
| 6,669,703 | B2 | 12/2003 | Shue |
| 6,737,521 | B1 | 5/2004 | Fischetti et al. |
| 6,747,437 | B2 | 6/2004 | Chiu |
| 6,777,547 | B1 | 8/2004 | Podbielski |
| 6,833,356 | B1 | 12/2004 | Koenig et al. |
| 6,936,252 | B2 | 8/2005 | Gilbert et al. |
| 7,033,765 | B1 | 4/2006 | Dime et al. |
| 7,041,814 | B1 | 5/2006 | Weinstock et al. |
| 7,098,182 | B2 | 8/2006 | Le Page et al. |
| 7,101,692 | B2 | 9/2006 | Schneewind et al. |
| 7,128,918 | B1 | 10/2006 | Hamel et al. |
| 7,128,919 | B2 | 10/2006 | Adderson et al. |
| 7,169,902 | B2 | 1/2007 | Podbielski |
| 7,247,308 | B2 | 7/2007 | Martin et al. |
| 7,348,006 | B2 | 3/2008 | Contorni et al. |
| 7,407,664 | B2 | 8/2008 | Beall et al. |
| 7,438,912 | B2 | 10/2008 | Meinke et al. |
| 7,485,710 | B2 | 2/2009 | Reinscheid et al. |
| 2002/0025516 | A1 | 2/2002 | Black et al. |
| 2002/0045737 | A1 | 4/2002 | Choi et al. |
| 2002/0061569 | A1 | 5/2002 | Haselbeck et al. |
| 2002/0086023 | A1 | 7/2002 | Dale |

(Continued)

FOREIGN PATENT DOCUMENTS

| | | |
|---|---|---|
| EP | 0369825 | 5/1990 |
| EP | 0613947 | 1/1994 |

(Continued)

OTHER PUBLICATIONS

Abbas et al., *Cellular and Molecular Immunology*, 4th ed., Chapter 15, pp. 360-362, 2000.

Amara et al., "Molecular detection of methionine in rat brain using specific antibodies," Neurosci. Lett. 185, 147-50, Feb. 13, 1995.

Areschoug et al., "Group B streptococcal surface proteins as targets for protective antibodies: identification of two novel proteins in strains of serotype V.," Inf. Immun. 67(12), 6350-57, Dec. 1999.

Banks et al., "Progress toward characterization of the Group A *Streptococcus* metagenome: Complete genome sequence of a macrolide-resistant serotype M6 strain," *J. Infectious Diseases* 190, 727-38, Aug. 15, 2004.

(Continued)

*Primary Examiner* — Padma V Baskar

(74) *Attorney, Agent, or Firm* — Banner & Witcoff, Ltd.

(57) ABSTRACT

The invention relates to the identification of a new adhesin islands within the genomes of several Group A and Group B *Streptococcus* serotypes and isolates. The adhesin islands are thought to encode surface proteins which are important in the bacteria's virulence. Thus, the adhesin island proteins of the invention may be used in immunogenic compositions for prophylactic or therapeutic immunization against GAS or GBS infection. For example, the invention may include an immunogenic composition comprising one or more of the discovered adhesin island proteins.

27 Claims, 497 Drawing Sheets

(56) References Cited

U.S. PATENT DOCUMENTS

| | | | |
|---|---|---|---|
| 2003/0035805 | A1 | 2/2003 | Michel et al. |
| 2003/0109690 | A1 | 6/2003 | Ruben et al. |
| 2003/0157122 | A1 | 8/2003 | Dale |
| 2003/0171337 | A1 | 9/2003 | Aylward et al. |
| 2004/0029129 | A1 | 2/2004 | Wang et al. |
| 2004/0101536 | A1 | 5/2004 | Teti et al. |
| 2004/0219639 | A1 | 11/2004 | Potter et al. |
| 2004/0236072 | A1 | 11/2004 | Olmsted et al. |
| 2005/0019345 | A1 | 1/2005 | Podbielski |
| 2005/0020813 | A1 | 1/2005 | Masignani et al. |
| 2005/0181388 | A1 | 8/2005 | Edwards et al. |
| 2005/0214918 | A1 | 9/2005 | Edwards et al. |
| 2005/0288866 | A1 | 12/2005 | Sachdeva et al. |
| 2006/0039922 | A1 | 2/2006 | Mizzen et al. |
| 2006/0041961 | A1 | 2/2006 | Abad et al. |
| 2006/0073530 | A1 | 4/2006 | Schneewind et al. |
| 2006/0115479 | A1 | 6/2006 | Reinscheid et al. |
| 2006/0160121 | A1 | 7/2006 | Mounts et al. |
| 2006/0165716 | A1 | 7/2006 | Telford et al. |
| 2006/0194751 | A1 | 8/2006 | Meinke et al. |
| 2006/0210579 | A1 | 9/2006 | Telford et al. |
| 2006/0210580 | A1 | 9/2006 | Telford et al. |
| 2006/0210581 | A1 | 9/2006 | Telford et al. |
| 2006/0210582 | A1 | 9/2006 | Telford et al. |
| 2006/0258849 | A1 | 11/2006 | Telford et al. |
| 2006/0269541 | A1 | 11/2006 | Meinke et al. |
| 2006/0275315 | A1 | 12/2006 | Telford et al. |
| 2007/0036828 | A1 | 2/2007 | Rappuoli et al. |
| 2007/0053924 | A1 | 3/2007 | Tettelin et al. |
| 2007/0065464 | A1 | 3/2007 | Grandi et al. |
| 2007/0098737 | A1 | 5/2007 | Dale |
| 2007/0116712 | A1 | 5/2007 | Hamel et al. |
| 2007/0128210 | A1 | 6/2007 | Olmsted et al. |
| 2007/0128211 | A1 | 6/2007 | Olmsted et al. |
| 2007/0128229 | A1 | 6/2007 | Olmsted et al. |
| 2007/0141635 | A1 | 6/2007 | James |
| 2008/0038268 | A1 | 2/2008 | Martin et al. |
| 2008/0220010 | A1 | 9/2008 | Telford et al. |
| 2009/0022753 | A1 | 1/2009 | Olmsted et al. |

FOREIGN PATENT DOCUMENTS

| | | |
|---|---|---|
| EP | 555438 | 1/1997 |
| EP | 555439 | 10/1997 |
| EP | 1770171 | 4/2007 |
| GB | 2233977 | 1/1991 |
| WO | WO9006951 | 6/1990 |
| WO | WO9305155 | 3/1993 |
| WO | WO9305156 | 3/1993 |
| WO | WO9801561 | 1/1998 |
| WO | WO9818931 | 5/1998 |
| WO | WO9819689 | 5/1998 |
| WO | WO9823631 | 6/1998 |
| WO | WO9803677 | 8/1998 |
| WO | WO9913084 | 3/1999 |
| WO | WO9916882 | 4/1999 |
| WO | WO9926969 | 6/1999 |
| WO | WO9942588 | 8/1999 |
| WO | WO9954457 | 10/1999 |
| WO | WO0006736 | 2/2000 |
| WO | WO0006737 | 2/2000 |
| WO | WO0023456 | 4/2000 |
| WO | WO0062804 | 10/2000 |
| WO | WO0078787 | 12/2000 |
| WO | WO0132882 | 5/2001 |
| WO | WO 02/12294 | 2/2002 |
| WO | WO 02/34771 | 5/2002 |
| WO | WO02075507 | 9/2002 |
| WO | WO02077183 | 10/2002 |
| WO | WO02092818 | 11/2002 |
| WO | WO03068813 | 8/2003 |
| WO | WO03087353 | 10/2003 |
| WO | WO03093306 | 11/2003 |
| WO | WO2004018646 | 3/2004 |
| WO | WO2004035618 | 3/2004 |
| WO | WO 2004/041157 | 5/2004 |
| WO | WO2004078907 | 9/2004 |
| WO | WO2004099242 | 11/2004 |
| WO | WO2005013666 | 2/2005 |
| WO | WO2005028618 | 3/2005 |
| WO | WO2005032582 | 4/2005 |
| WO | WO2005076010 | 8/2005 |
| WO | WO2005108419 | 11/2005 |
| WO | WO2006035311 | 4/2006 |
| WO | WO2006042027 | 4/2006 |
| WO | WO2006069200 | 6/2006 |
| WO | WO 2006/078318 | 7/2006 |
| WO | WO2006078318 | 7/2006 |
| WO | WO2006082527 | 8/2006 |
| WO | WO2006082530 | 8/2006 |
| WO | WO2006130328 | 12/2006 |
| WO | WO2007018563 | 2/2007 |
| WO | WO2007039319 | 4/2007 |
| WO | WO2007052168 | 5/2007 |
| WO | WO2008020335 | 2/2008 |
| WO | WO2008108830 | 9/2008 |
| WO | WO2008003515 | 10/2008 |

OTHER PUBLICATIONS

Barnett & Scott, "Differential recognition of surface proteins in *Streptococcus pyogenes* by two sortase gene homologs," J. Bacteriol. 184, 2181-91, 2002.

Black et al: "*Streptococcus pneumoniae* polypeptide coding region"; Genbank Accession No. AAV42990, Nov. 9, 1998.

Blackburn et al., "The end of the (DNA) line," Nature Structural Biology 7, 847-49, Oct. 2000.

Bork et al., "Powers and pitfalls in sequence analysis: the 70% hurdle," Genome Research 10, 398-400, 2000.

Borovec et al., "Synthesis and assembly of hepatitis A virus-specific proteins in BS-C-1 cells," J. Virol. 67, 3095-301, Jun. 1993.

Bowie et al., "Deciphering the message in protein sequences: tolerance to amino acid substitution," Science 257, 1306-10, 1990.

Brodeur et al., "Identification of group B streptococcal Sip protein, which elicits cross-protective immunity," Inf. Immun. 68(10), 5610-8, Oct. 2000.

Burgess et al., "Possible dissociation of the heparin-binding and mitogenic activities of heparin-binding (acidic fibroblast) growth factor-1 from its receptor-binding activities by site-directed mutagenesis of a single lysine residue," J. Cell Biol. 111, 2129-38, 1990.

Chung et al., "chlorosome protein," NCBI Accession No. 2115394F, Jul. 10, 1992.

Clancy et al., "Cloning and Characterization of a Novel Macrolide Efflux Gene, mreA, from *Streptococcus agalactiae*," Antimicrobial Agents and Chemotherapy 41, 2719-23, 1997.

Collins et al., "Mutation of the principal sigma factor causes loss of virulence in a strain of the *Mycobacterium tuberculosis* complex," Proc. Natl. Acad. Sci. USA 92, 8036-40, 1995.

Dale et al., "New Protective Antigen of Gorup A Streptococci," J. Clin. Invest. 103, 1261-68, May 1999.

Dale et al., "Recombinant, octavalent group A streptococcal M protein vaccine," Vaccine 14, 944-48, 1996.

Dale, "Group A Streptococcal Vaccines," Infectious Disease Clinics of North America 13, 227-43, Mar. 1999.

Dale, "Multivalent group A streptococcal vaccine designed to optimize the immunogenicity of six tandem M protein fragments," Vaccine 17, 193-200, 1999.

Database EMBL, Accession No. AAX13129, *Enterococcus faecalis* genome contig SEQ ID No. 192, Mar. 19, 1999.

Database EPO Proteins, EBI Accession No. AX605513, "Sequence 3442 from WO0209818," Feb. 17, 2003.

Database Geneseq, "Group B *Streptococcus* protein sequence SEQ ID No. 49," EBI Accession No. GSP:AAY91320, May 30, 2000.

Database Geneseq, "*Streptococcus agalactiae* protein, SEQ ID 2382," EBI Accession No. GSP:ADV81242, Feb. 24, 2005.

Database Geneseq, "Fibrinogen-binding polypeptide, SEQ ID No. 17," EBI Accession No. GSP: ADS93952, Dec. 2, 2004; revised in 2007.

(56) References Cited

OTHER PUBLICATIONS

Database Geneseq, EBI Accession No. GSP: ABP30134, "*Streptococcus* polypeptide SEQ ID No. 9444," Jul. 2, 2002.
Database Geneseq, EBI Accession No. GSP: ABP27285, "*Streptococcus* polypeptide SEQ ID No. 3746," Jul. 2, 2002; revised in 2007.
Database Genseq, "Protein encoded by Prokaryotic essential gene #319788," Accession No. ABU46451, Jun. 13, 2003.
Database JPO Proteins, "Nucleic acid and protein originating in group B *Streptococcus*," EBI Accession No. JPOP:BD629260, Jul. 17, 2003.
Database Swissprot[Online] Oct. 1, 2002, accession No. EBI, Database accession No. Q9PGX9, Hypothetical protein XF0167.
Database UniProt [Online] Mar. 1, 2003, "Cell wall surface anchor family protein," retrieved from EBI accession No. Uniprot: Q8DYR5, Database accession No. Q8DYR5, 87.2% identity with SEQ ID No. 20906.
Database UniProt [Online], Nov. 22, 2005, "Cell wall surface anchor family protein," retrieved from EBI accession No. UniProt: Q3D2D6; 100% identity with SEQ ID No. 20906; abstract.
De Boever et al., "*Enterococcus faecalis* conjugative plasmid pAM373. Complete nucleotide sequence and genetic analyses of sec phermone response," Mol. Microbiol. 37, 1327-41, 2000.
Dittmer et al., "Treatment of infectious diseases with immunostimulatory oligodeoxynucleotides containing CpG motifs," Curr. Opinion Microbiol. 6, 472-77, Oct. 2003.
Duez, "*Enterococcus hirae* mraR, pbp3s, mraY, murD, murG, ftsQ and ftsA genes, mraW, yllC and ftsZ partial genes," GenBank Accesion No. Y13922, Apr. 18, 2005.
Ellis, *Vaccines*, Chapter 29, Plotkin et al., eds., W.B. Saunders Company (Philadelphia), pp. 568-575, 1988.
Examination Report for NZ 560966, Mar. 4, 2009, 2 pages.
Ferretti et al., "Complete genome sequence of an M1 strain of *Streptococcus pyogenes*," Proc. Natl. Acad. Sci. USA 98, 4658-63, Apr. 10, 2001.
Ferretti et al., "Putative surface exclusion protein," GenBank Accession No. Q9A1H3, Oct. 31, 2006.
Ferretti et al: "*Streptococcus pyogenes* M1 GAS strain SF370, Section 87 of 167 of the complete genome" Database Accession No. AE006558.
Glaser et al., "Genome sequence of *Streptococcus agalactiae*, a pathogen causing invasive neonatal disease," Mol. Moicrobiol. 45, 1499-1513, 2002.
Grandi & Zagursky, "The impact of genomics in vaccine discovery: achievements and lessons," Expert. Rev. Vaccines 3, 621-23, 2004.
Grandi, "Genomics and Proteomics in Reverse Vaccines," in *Microbial Proteomics: Functional Biology of Whole Organisms*, Humphery-Smith & Hecker, eds., John Wiley &.Sons, chapter 20, 2006.
Greenspan et al., "Defining epitopes: Its not as easy as it seems," Nature Biotechnol. 7, 936-37, 1999.
Gutekunst et al., "Analysis of RogB-Controlled Virulence Mechanisms and Gene Expression in *Streptococcus agalactiae," Inf. Immun. 71*, 5056-64, Sep. 2003.
Gutierrez et al., "insertional Mutagenesis and Recovery of Interrupted Genes of *Streptococcus* mutans by Using Transposon Tn917: Preliminary Characterization of Mutants Displaying Acid Sensitivity and Nutritional Requirements," J. Bacteriol. 178, 4166-75, Jul. 1996.
Guttierez et al., "*Streptococcus* mutans ProX (pouABC) gene, partial cds; YlxM (ylxM) gene, complete cds; Ffh (ffh) gene, complete cds, alternatively spliced; SatC (satC) and SatD (satD) gene, complete cds; and SatE (satE) gene, partical cds," GenBank Accession No. U88582, Apr. 3, 2001.
Guzman et al., "Protective immune response against *Streptococcus pyogenes* in mice after intranasal vaccination with the fibronectin-binding protein Sfbl," J. Infectious Disease 179, 901-06, 1999.
Holmes, "PSMA specific antibodies and their diagnostic and therapeutic use," Exp. Opin. Invest. Drugs 10, 511-10, 2001.
Hong, "unnamed protein product [*Streptococcus pyogenes*]," NCBI Accession No. BAB1603, one page, Oct. 3, 2000.
Horvath et al., "Toward the development of a synthetic group a streptococcal vaccine of high purity and broad protective coverage," J Med Chem. Jul. 29, 2004;47(16):4100-4.
Hughs et al., "Identification of Major Outer surface Proteins of *Streptococcus agalactiae," Inf. Immun. 70*, 1254-59, Mar. 2002.
International Preliminary Examination Report for PCT/GB01/04789 (published as WO 02/34771) dated Feb. 17, 2003.
International Preliminary Examination Report for PCT/GB2003/001882 (published as WO 03/093306) dated Aug. 18, 2004.
International Preliminary Examination Report for PCT/IB2005/036009 (published as WO 06/042027) dated Apr. 11, 2007.
International Preliminary Examination Report for PCT/US2003/029167 (published as WO 04/041157) dated Mar. 5, 2005.
International Preliminary Examination Report for PCT/US2004/024868 (published as WO 05/032582) dated Feb. 6, 2006.
International Preliminary Examination Report for PCT/US2004/030032 (published as WO 05/028618) dated Mar. 16, 2006.
International Search Report for PCT/GB01/04789 (published as WO 02/34771) dated Aug. 27, 2002.
International Search Report for PCT/GB2003/001882 (published as WO 03/093306) dated Nov. 14, 2002.
International Search Report for PCT/IB2005/036009 (published as WO 06/042027) dated Jun. 20, 2006.
International Search Report for PCT/US05/046491 dated Jun. 26, 2007 (published as WO 2006/069200).
International Search Report for PCT/US2003/029167 (published as WO 04/041157) dated Aug. 2, 2004.
International Search Report for PCT/US2004/024868 (published as WO 05/032582) dated Oct. 28, 2005.
International Search Report for PCT/US2004/030032 (published as WO 05/028618) dated Dec. 6, 2005.
International Search Report for PCT/US2005/027239 (published as WO 06/078318) dated Aug. 25, 2008.
International Search Report for PCT/US2007/022838 (published as WO 08/108830) dated Oct. 9, 2008.
Jobling et al., "Analysis of structure and function of the B subunit of cholera toxin by the use of site-directed mutagenesis," Mol. Microbiol. 5, 1755-67, 1991.
Kalman et al., "Comparative genomes of *Chlamydia pneumoniae* and *C. trachomatis*," Nature Genetics 21, 385-89, Apr. 1999.
Kehoe et al., "Nucleotide Sequence of the Streptolysin O (SLO) Gene: Structural Homologies between SLO and Other Membrane-Damaging, Thiol-Activated Toxins," Inf. Immun. 55, 3228-32, Dec. 1987.
Koch et al., "Complexity and expression patterns of the desmosomal adherins," Proc. Natl. Acad. Sci. USA 89, 353-57, Jan. 1992.
Kunst et al., "The complete genome sequence of the Gram positive bacterium *Bacillus subtilis*," NCBI Accession No. CAB14964, Nov. 20, 1997.
Lachenauer et al., "A protective surface protein from the Type V Group B *Streptococcus* shares N-terminal sequence homology with the Alpha C Protein," Inf. Immun. 64, 4255-60, Oct. 1996.
Larsson et al., "Protection against experimental infection with group B *Streptococcus* by immunization with a bivalent protein vaccine," *Vaccine 17*, 454-58, 1999.
Lazar et al., "Transforming growth factor alpha: mutation of aspartic acid 47 and leucine 48 results in different biological activities," Mol. Cell. Biol. 8, 1247-52, 1988.
Le Page et al., *Streptococcus agalactiae* sequence 217 from WO 01/32882, GenBank Accession No. AX134653, May 29, 2001.
Lei et al., "Identification and immunogenicity of group a *Streptococcus* culture supernatant proteins," Inf. Immunity 68, 6807-18, 2000.
Lindahl et al., "Surface proteins of *Streptococcus agalactiae* and related proteins in other bacterial pathogens," Clinical Microbiol. Rev. 18(1), 102-07, Jan. 2005.
Madoff et al., "Maternal Immunization of Mice with Group B Streptococcal Type III Polysaccharide-Beta C Protein Conjugate Elicits Protective Antibody to Multiple Serotypes," J. Clinical Invest. 94, 286-92, 1994.
McMillan et al., "Identification and assessment of new vaccine candidates for group a streptococcal infections," *Vaccine 22*, 2783-90, 2004.

(56) References Cited

OTHER PUBLICATIONS

McMillan et al., "Prospecting for new group A streptococcal vaccine candidates," *Indian J. Med. Res. 119*, 121-25, May 2004.
Meehan & Owen, "Sequence 1 from Patent WO9801561," GenBank Accession No. A68631, May 6, 1999.
Meinke et al., "*S. pyogenes* hyperimmune system reactive antigen Spy0269," EBI Accession No. ADR83896, Dec. 2, 2004; revised Jun. 15, 2007.
Michel et al: "Cloned alpha and beta C-protein antigens of group B Streptococci elicit protective immunity"; Infection and Immunity; vol. 59, No. 6, Jun. 1991; pp. 2023-2028.
Molling et al., "Naked DNA for vaccine or therapy," J. Mol. Med. 75, 242-46, 1997.
Mora et al., "Group A *Streptococcus* produce pilus-like structures containing protective antigens and Lancefield T antigens," Proc. Natl. Acad. Sci. USA 102, 15641-46, Oct. 25, 2005.
Musser, "The Next Chapter in Reverse Vaccinology," Nat. Biotechnol. 24, 157-58, 2006.
Nakagawa et al., "Genome sequence of an M3 strain of *Streptococcus pyogenes* reveals a large-scale genomic rearrangement in invasive strains and new insights into phage evolution," *Genome Res. 13*, 1042-55, Jun. 2003.
Nakata et al., "MsmR, a specific positive regulator of the *Streptococcus pyogenes* FCT pathogenicity region and cytolysin-mediated translocation system genes," Mol. Microbiol. 57, 786-803, 2005.
NCBI News, table on p. 4, "Microbial Genomes Available for BLAST Search," Jul. 1998.
Olive et al., "Protection of mice from group A streptococcal infection by intranasal immunization with a peptide vaccine that contains a conserved M protein B cell epitope and lacks a T cell autoepitope," Vaccine 20, 2816-25, 2002.
Orefici et al., "Possible virulence marker for *Streptococcus agalactiae* (Lancefiled Group B)," J. Clin. Microbiol. Infectious Diseases 7, 302-05, 1988.
Paoletti et al., "Neonatal mouse protection against infection with multiple group B streptococcal (GBS) serotypes by maternal immunization with a tetravalent GBS polysaccharide-tetanus toxoid conjugate vaccine," Inf. Immun. 62, 3236-43, 1994.
Paoletti, "Surface structure of group B *streptoccoccus* important in human immunity," in *Gram Positive Pathogens*, Fischetti et al., eds., Chapter 14, pp. 137-53, 2000.
Pournaras et al., "Pheromone responses and high-level aminoglycoside resistance of conjugative plasmids of *Enterococcus faecalis* from Greece," J. Antimicrobial Chemotherapy 46, 1013-16, 2000.
Pritzlaff et al., "Genetic basis for the beta-haemolytic cytolitic activity of group B *Streptococcus*," Mol. Microbiol. 39, 236-48, 2001.
Pritzlaff et al., "*Streptococcus agalactiae* cyl gene cluster, partial sequence," GenBank Accession No. AF157015, Feb. 8, 2001.
Proft et al., "Identification and Characterization of Novel Superantigens from *Streptococcus pyogenes*," J. Exp. Med. 189, 89-101, Jan. 4, 1999.
Pucci et al., "*Enterococcus faecalis* strain A24836 cell wall/cell division gene cluster, yllB, yllc, yllD, pbpC, mraY, murD, murG, divlB, ftsA and fitsZ genes, complete cds," GenBank Accession No. U94707, Sep. 10, 1997.
Quinn, "The response of rheumatic and non-rheumatic children to streptolysin O concentrate," J. Clin. Invest. 36, 793-802, Jun. 1957.
Rodewald et al., "Neonatal mouse model of group b streptococcal infection," J. Infectious Diseases 166, 635-39, 1992.
Rodriguez-Ortega et al., "Characterization and identification of vaccine candidate proteins through analysis of the group A *Streptococcus* surface proteome," Nature Biotechnol. 24, 191-97, 2006.
Roitt et al., Structure of Antigens, *Immunology*, 4th ed., Mosby, London, pp. 7.7 and 7.8, 1998.
Rosini et al., "Identification of novel genomic islands coding for antigenic pilus-like structures in *Streptococcus agalactiae*," Mol. Microbiol. 61, 126-41, 2006.
Rudenko et al., "Selection for activation of a new variant surface glycoprotein gene expression site in *Trypanosoma brucei* can result in deletion of the old one," Mol. Biochem. Parisitol. 95, 97-109, 1998; NCBI Accession No. CAD21770.
Rudinger et al., "Characteristics of the amino acids as components of a peptide hormone sequence," in *Peptide Hormones*, Parsons, ed., University Park Press, Jun. 1976, pp. 1-7.
Schneewind, "Structure of the Cell Wall anchor of Surface Proteins in *Staphylococcus aureus*," Science 268, 103-06, Apr. 7, 1995.
Segura et al., "*Streptococcus suis* and group B *Streptococcus* differ in their interactions with murine macrophages," FEMS Immunol. Med. Microbiol. 21, 189-95, 1998.
Seizen, "Multi-domain, cell envelope proteases of lactic acid bacteria," Antonie von Leeuwenhoek 76, 139-55, 1999.
Simpson et al., "*Xylella fastidiosa* 9a5c, section 136 of 229 of the complete genome," Genbank Accession No. AE003990, Jun. 4, 2004.
Smoot et al., "Genome sequence and comparative microarray analysis of serotype M18 group A *Streptococcus* strains associated with acute rheumatic fever outbreaks," *Proc. Natl. Acad. Sci.* USA 99, 4668-73, Apr. 2, 2002.
Spellerberg et al., "*Streptococcus agalactiae* cyl gene cluster, complete sequence," GenBank Accession No. AF093787, Jul. 31, 2000.
Spellerberg et al: "Identification of genetic determinants for the hemolytic activity of *Streptococcus agalactiae* by ISSI transposition"; J. Bacteriol.; vol. 181, No. 10, May 1999; pp. 3212-3219.
Stalhammar-Carlemalm et al: "The R28 Protein of *Streptococcus pyogenes* is related to several group B streptococcal surface proteins, confer protective immunity and promotes binding to human epithelial cells"; Mol. Microbiol. 1, Jul. 1999, pp. 208-219.
Stephenson et al., "The Fap1 fimbrial adhesin is a glycoprotein: antibodies specific for the glycan moiety block the adhesion of *Streptococcus parasanguis* in an in vitro tooth model," *Mol. Microbiol.* 43, 147-57, 2002.
Su et al., "Identification of a Xenopus cDNA that prevents mitotic catastrophe in the fission yeast *Schizosaccharomyces pombe*," Gene 145, 155-56, 1994.
Supplementary Search report for EP 03799822 (corresponding to WO 04/041157) dated Jan. 21, 2008.
Surovov & Ferretti, "Physical and Genetic Chromosomal Map of an M Type 1 Strain of *Streptococcus pyogenes*," J. Bacteriol. 178, 5546-49, Sep. 1996.
Takami et al., "Two component sensor histidine kinase involved in phosphate regulation," NCBI Accession No. NP_244022.1, Sep. 10, 2001.
Telford et al., Sequence 7466 from WO 02/34771, EBI Accession No. CQ650509, Feb. 2, 2004; modified May 31, 2006.
Telford et al., "*Streptococcus* polypeptide SEQ ID No. 9188" of WO 02/34771, EBI Accession No. ABP300006, Jul. 2, 2002; revised Jun. 15, 1007.
Tettelin et al., "Complete genome sequence and comparative genomic analysis of an emerging human pathogen, serotype V *Streptococcus agalactiae*," Proc. Natl. Acad. Sci. USA 99, 12391-96, Sep. 17, 2002.
Tettelin et al., "Complete genome sequence of a virulent isolate of *Streptococcus pneumoniae*," Science 293, 498-506, 2001.
Tettelin et al., Database EMBL, Accession No. AE014193, *Streptococcus agalactiae* 2603V/R section 3 of 100 of the complete genome, Sep. 2, 2002.
Tettelin et al., Swiss-Prot Accession No. Q3DV91 for *Streptococcus agalactiae* strain 18R21, Nov. 22, 2005.
Tighe et al., "Gene vaccination: plasmid DNA is more than just a blueprint," Immunology Today 19, 89-97, Feb. 1998.
Todd, "Antigenic Streptococcal Hemolysin," J. Exp. Med. 55, 267-80, 1932.
Ton-That & Schneewind, "Assembly of pili on the surface of *Corynebacterium diphtheriae*," Mol. Microbiol. 50, 1429-38, 2003.
Ton-That et al., "Sortases and pilin elements involved in pilus assembly of *Corynebacterium diphtheriae*," Mol. Microbiol. 53, 251-61, 2004.
UniProt Accession No. A7CNQ7, Jul. 5, 2004.
UniProt Accession No. Q5XEL1, Nov. 23, 2004.
UniProt Accession No. Q8P318, Oct. 1, 2002.
Wang et al., "Protein encoded by prokaryotic essential gene #31978," EBI Accession No. ABU46451, Jun. 19, 2003; revised Jun. 15, 2007.

(56) References Cited

OTHER PUBLICATIONS

Wessels et al., "Stimulation of protective antibodies against type 1a and 1b group B Streptococci by a type 1a polysaccharide-tetanus toxoid conjugate vaccine," Inf. Immun. 61, 4760-66, 1993.

Woodson et al., "Analysis of a ribose transport operon from *Bacillus subtilis*," Microbiology 140, 1829-38, 1994.

Zhong et al., "Hypothetical protein of *Arabidopsis thaliana*," NCBI Accession No. AAD29767, May 11, 1999.

Beckmann et al., "Identification of Novel Adhesins from Group B Streptococci by Use of Phage Display Reveals that C5a Peptidase Mediates Fibronectin Binding," *Inf. Immun. 70*, 2869-76, Jun. 2002.

Lauer et al., "Genome Analysis Reveals Pili in Group B *Streptococcus," Science 309*, 105, Jul. 1, 2005.

Maione et al., "Identification of a Universal Group B *Streptococcus* Vaccine by Multiple Genome Screen," *Science 309*, 148-50, Jul. 1, 2005.

Barnett et al., "A Novel Sortase, SrtC2, from *Streptococcus pyogenes* Anchors a Surface Protein Containing a QVPTGV Motif to the Cell Wall," *Journal of Bacteriology*, vol. 186, No. 17, pp. 5865-5875, Sep. 2004.

Bessen et al., "Genomic Localization of a T Serotype Locus to a Recombinatorial Zone Ending Extracellular Matrix-Binding Proteins in *Streptococcus pyogenes," Infection and Immunity*, vol. 70, No. 3, pp. 1159-1167, Mar. 2002.

Lewis, "Riddle of Biofilm Resistance," *Antimicrobial Agents and Chemotherapy*, vol. 45, No. 4, pp. 999-1007, Apr. 2001.

Navarre et al., "Surface Proteins of Gram-Positive Bacteria and Mechanisms of Their Targeting to the Cell Wall Envelope," *Microbiology and Molecular Biology Reviews*, vol. 63, No. 1, pp. 174-229, Mar. 1999.

Ramachandran et al., "Two Distinct Genotypes of *prtF2*, Encoding a Fibronectin Binding Protein, and Evolution of the Gene Family in *Streptococcus pyogenes," Journal of Bacteriology*, vol. 186, No. 22, pp. 7601-7609, Nov. 2004.

Schneewind et al., "Sequence and Structural Characteristics of the Trypsin-Resistant T6 Surface Protein of Group A Streptococci," *Journal of Bacteriology*, vol. 172, No. 6, pp. 3310-3317, Jun. 1990.

Vallet et al., "The chaperone/usher pathways of *Pseudomonas aeruginosa*: Identification of fimbrial gene clusters (cup) and their involvement in biofilm formation," *PNAS*, vol. 98, No. 12, pp. 6911-6916, Jun. 2001.

Watnick et al., "Steps in the development of a *Vibrio cholerae* El Tor biofilm," *Molecular Microbiology*, vol. 34, No. 3, pp. 586-595, 1999.

FIGURE 1: Adhesion Island 1

Figure 2: Conservation of AI-1 in GBS serotypes and strain isolates

FIGURE 3: Correlation of AI-1 and AI-2 within GBS serotype V, strain isolate 2603 genome

Figure 4: Identification and Variance of AI-2 in Several GBS Serotypes and Strain Isolates

Figure 5: Purified gbs80 protein binds fibronectin and fibrinogen in an ELISA

A: B:

Figure 7: In frame deletions of AI-1 genes
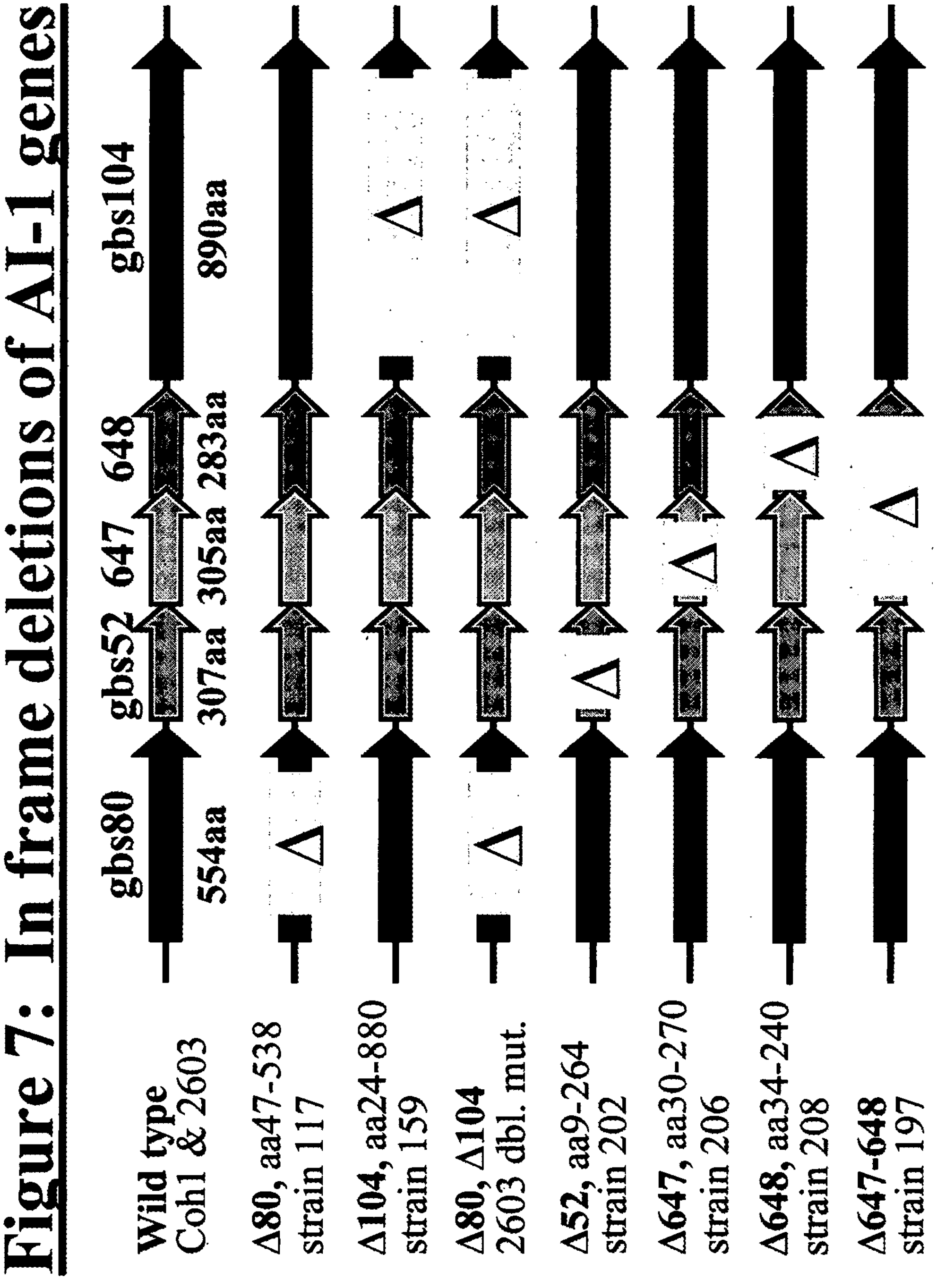

Δ80
α-gbs80
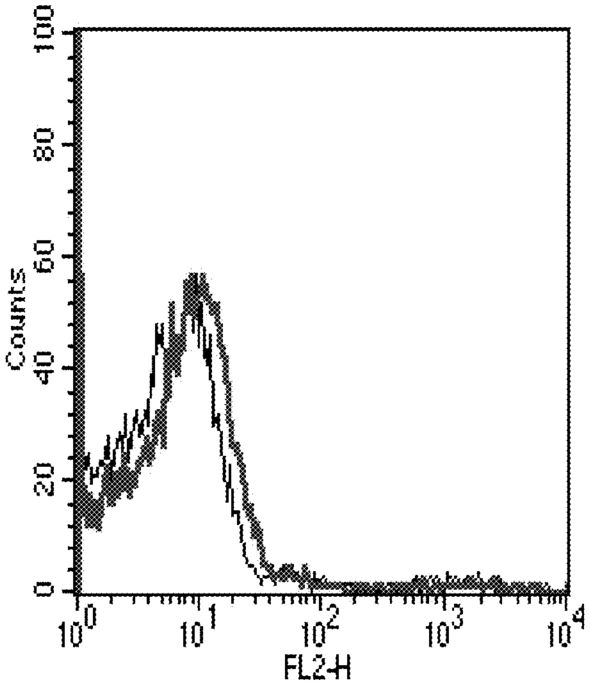
α-gbs104
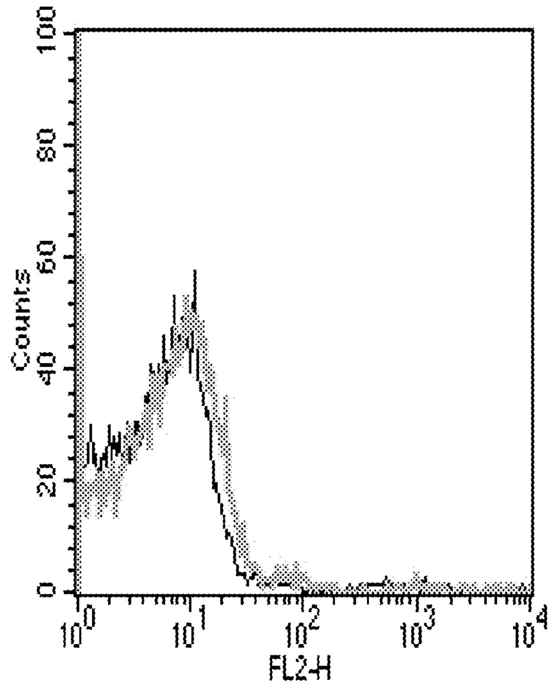
FIG. 8B

Δ104
α-gbs80
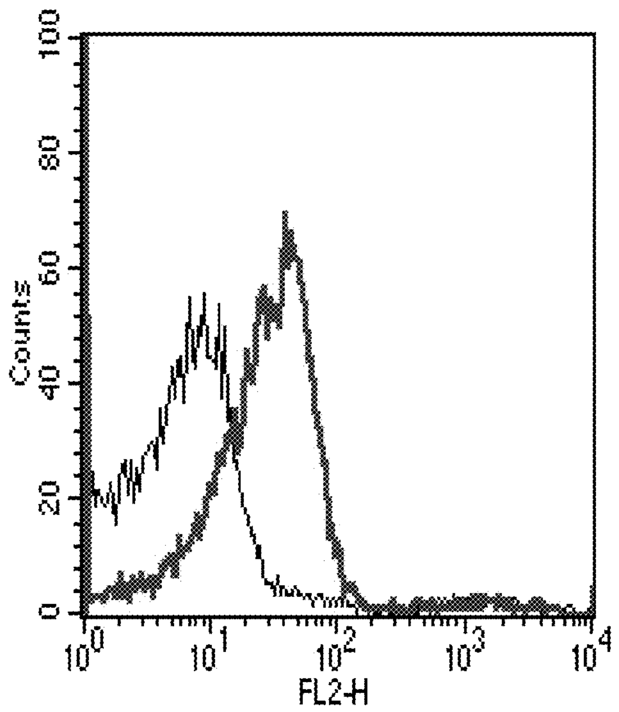
α-gbs104
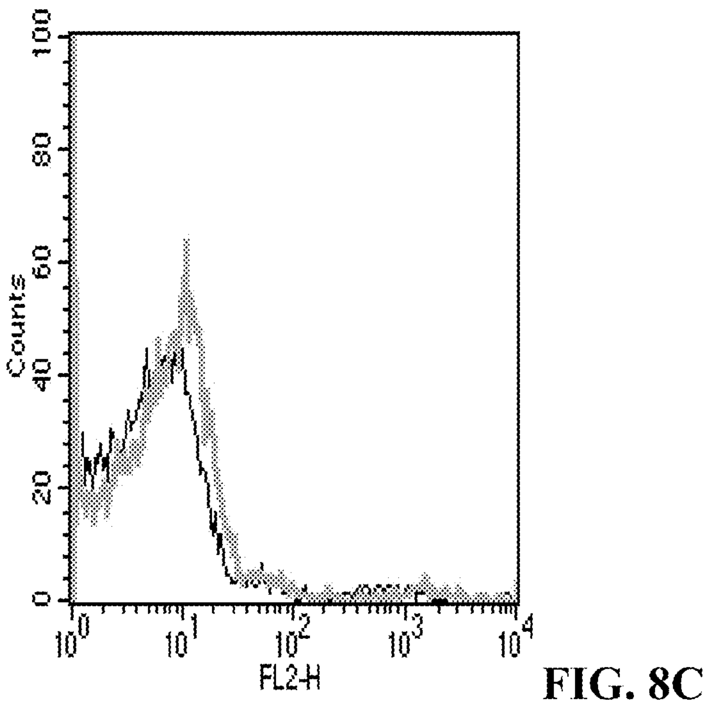
FIG. 8C

Δ647

Δ648
*α-gbs80*
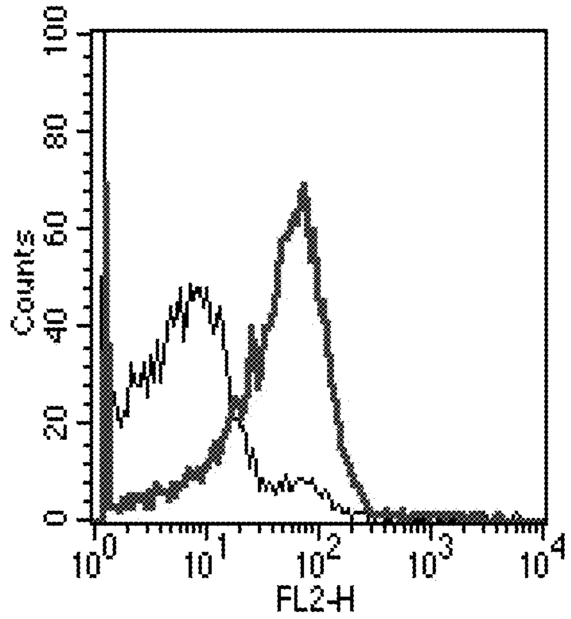
*α-gbs104*
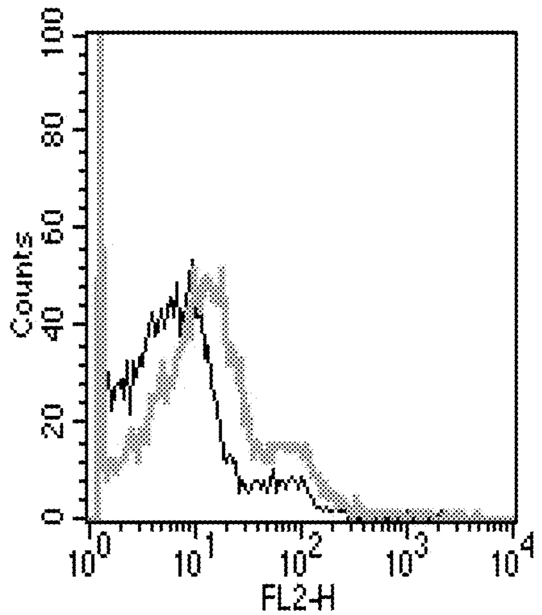
FIG. 9D

Figure 10: Western blot of mutant strains
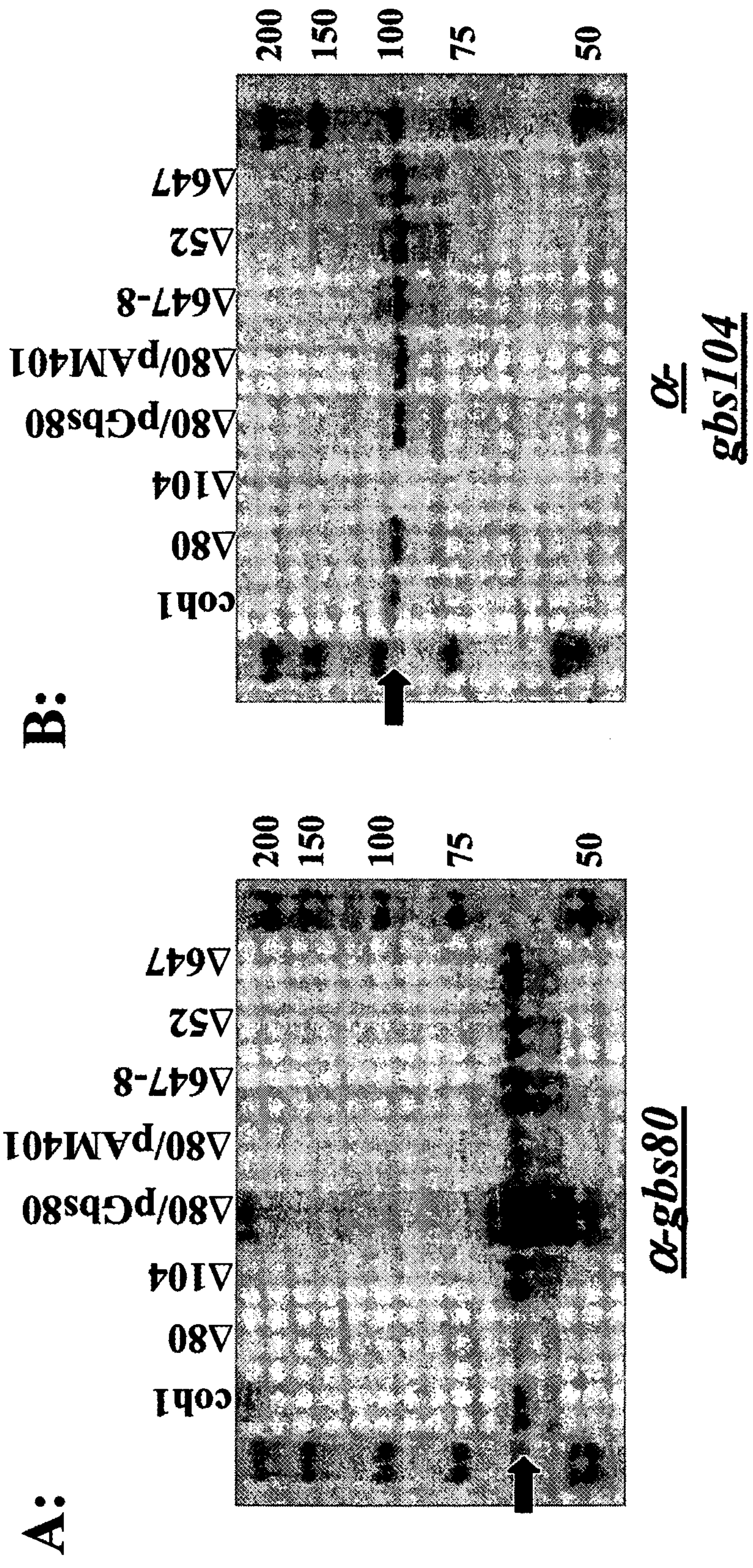

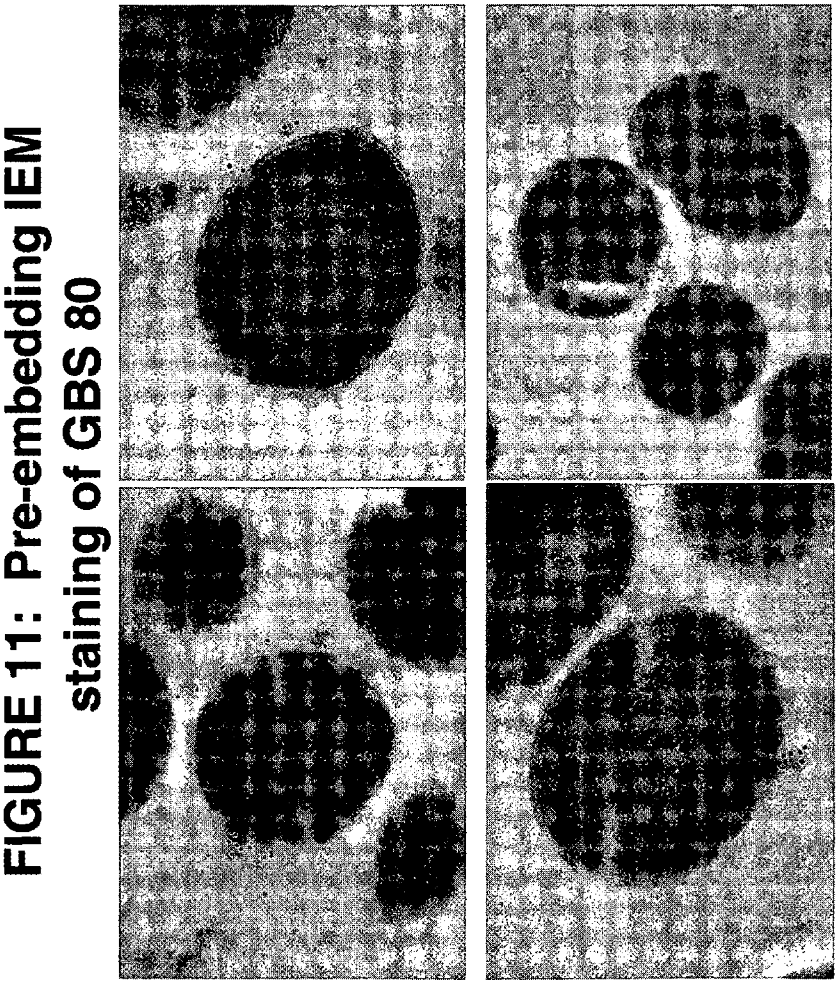
FIGURE 11: Pre-embedding IEM staining of GBS 80

FIGURE 12: Predicted Secondary Structure for GBS 067

PHD SECONDARY STRUCTURE PREDICTION for GBS 067

```
        10        20        30        40        50        60        70
         |         |         |         |         |         |         |
MRKYQKFSKILTLSLFCLSQIPLNTNVLGESTVPENGAKGKLVVKKTDDQNKPLSKATFVLKTTAHPESK
CcccccceeeeeEEeceeeEcccccccccccCCCCCCcceEEEEeCCCCCCCCccEEEEEecCCCcch
IEKVTAELTGEATFDNLIPGDYTLSEETAPEGYKKTNQTWQVKVESNGKTTIQNSGDKNSTIGQNQEELD
hHHHhhheeEeeeccCCCCCCcccCcCCCCcccccccCeEEEEEEeCCcEEEEeCCCCCCCCCchHHhc
KQYPPTGIYEDTKESYKLEHVKGSVPNGKSEAKAVNPYSSEGEHIREIPEGTLSKRISEVGDLAHNKYKI
CCCCCCcceeccCccccceeEEeccccCCCCCcccccCCCCCCcccceeccCCCccccccceccccccCCcEE
ELTVSGKTIVKPVDKQKPLDVVFVLDNSNSMNNDGPNFQRHNKAKKAAEALGTAVKDILGANSDNRVALV
EEEccCcEEEecCCCCCCeEEEEEcCCCCCCCCCCCCChhHHHHHHHHHHHHHHHHhcCcCCeEEEE
TYGSDIFDGRSVDVVKGFKEDDKYYGLQTKFTIQTENYSHKQLTNNAEEIIKRIPTEAPKAKWGSTTNGL
EccceecCCCeeEEecccecCCCcceeeEEEEEEecCCcchhHHHHHHHHHHhcCCCCCCCCCCCCCC
TPEQQKEYYLSKVGETFTMKAFMEADDILSQVNRNSQKIIVHVTDGVPTRSYAINNFKLGASYESQFEQM
CcccccceEEEecccccchhHHHHHHHHHHHHHcccCCeEEEEEeCCCCCccceeccecCCCCchHHHHHH
KKNGYLNKSNFLLTDKPEDIKGNGESYFLFPLDSYQTQIISGNLQKLHYLDLNLNYPKGTIYRNGPVKEH
HHhCCcccceeeecCCCCccCCCCceEEeeecCcCeeEEEecCcccccceeeccCCCCCCeEEeCCCcCCC
GTPTKLYINSLKQKNYDIFNFGIDISGFRQVYNEEYKKNQDGTFQKLKEEAFKLSDGEITELMRSFSSKP
CCCceEeEEcccccccccecccecececceecchHHhcccCCcHHHHHHHHHhcccCchHHHHHHHHcCCC
EYYTPIVTSADTSNNEILSKIQQQFETILTKENSIVNGTIEDPMGDKINLQLGNGQTLQPSDYTLQGNDG
cceeEEEeecCCCcHHHHHHHHHHHHHHHhhccceeeeeEecCCCCeeEEecCCCcccccCCCCcccCCCC
SVMKDGIATGGPNNDGGILKGVKLEYIGNKLYVRGLNLGEGQKVTLTYDVKLDDSFISNKFYDTNGRTTL
ccccccCCCCCCCCCCceeeceEEEEeCCcEEEEEccCCCCCEEEEEEEeecCCCcceeeecCCCCCccC
NPKSEDPNTLRDFPIPKIRDVREYPTITIKNEKKLGEIEFIKVDKDNNKLLLKGATFELQEFNEDYKLYL
CCCCCCCCCCCCCCCCCcccccCCCeEEEEeCCCCCeEEEEEeCCCChhhHHccCchHHHHhchhhceee
PIKNNNSKVVTGENGKISYKDLKDGKYQLIEAVSPEDYQKITNKPILTFEVVKGSIKNIIAVNKQISEYH
eecCCCCcEEEccCCcEeEEecccCCcEEEEECCCchhHhhCCcCeEEEEecccchhhhhhhHHHHHHH
EEGDKHLITNTHIPPKGIIPMTGGKGILSFILIGGAMMSIAGGIYIWKRYKKSSDMSIKKD
HhCCceEEeCCCCCCCCeEeecCCCccEEEEeccccccecccCCeeEEEccCCCCCCcecCC
Sequence length :   901
PHD :
   Alpha helix      (Hh) :   148 is  16.43%     3_10 helix       (Gg) :    0 is   0.00%
   Pi helix         (Ii) :     0 is   0.00%     Beta bridge     (Bb) :    0 is   0.00%
   Extended strand  (Ee) :   243 is  26.97%     Beta turn       (Tt) :    0 is   0.00%
   Bend region      (Ss) :     0 is   0.00%     Random coil     (Cc) :  510 is  56.60%
   Ambigous states  (?)  :     0 is   0.00%     Other states         :    0 is   0.00%
```

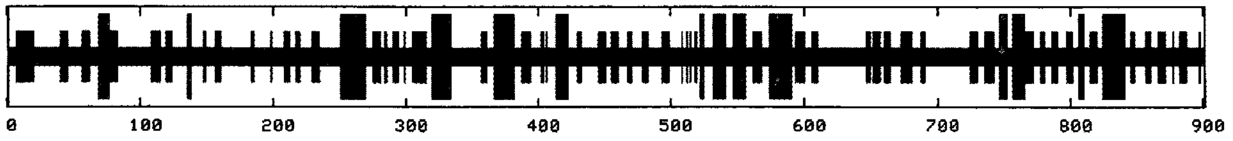

FIGURE 18A

Alignment Report of AI-1_alignment, using J. Hein method with Weighted residue weight table.
Thursday, July 29, 2004 5:46 PM

```
     TAACACGGATTGGAAATAACATCAATCAAATTGCGCGTGCTATCAACCAA Majority
              10        20        30        40        50
1    TAACACGGATTGGAAATAACATCAATCAAATTGCGCGTGCTATCAACCAA 2603_ai1.seq
1    -------------------------------------------------- 18rs21_ai1.seq
1    TAACACGGATTGGAAATAACATCAATCAAATTGCGCGTGCTATCAACCAA coh1_ai1.seq
1    TAACACGGATTGGAAATAACATCAATCAAATTTCGCGTGCTATCAACCAA cjb111_ai1.seq
1    TAACACGGATTGGAAATAACATCAATCAAATTGCGCGTGCTATCAACCAA nem316_ai1.seq
1    TAACACGGATTGGAAATAACATCAATCAAATTTCGCGTGCTATCAACCAA a909_ai1.seq

     AGCCATCTAATTTCTCAGGCTCAGTATCACTTTCATCGAGAAGCACGTTA Majority
              60        70        80        90       100
51   AGCCATCTAATTTCTCAGGCTCAGTATCACTTTCATCGAGAAGCACGTTA 2603_ai1.seq
1    -------------------------------------------------- 18rs21_ai1.seq
51   AGCCATCTAATTTCTCAGGCTCAGTATCACTTTCATCGAGAAGCACGTTA coh1_ai1.seq
51   AGCCATCTAATTTCTCAGGCTCAGTATCACTTTCATCGAGAAGCACGTTA cjb111_ai1.seq
51   AGCCATCTAATTTCTCAGGCTCAGTATCACTTTCATCGAGAAGCACGTTA nem316_ai1.seq
51   AGCCATCTAATTTCTCAGGCTCAGTATCACTTTCATCGAGAAGCACGTTA a909_ai1.seq

     AGCCCAACAGCAGGGGGGGTTGCTCTGATTCGGTTAAGTAATAAGCAAAA Majority
             110       120       130       140       150
101  AGCCCAACAGCAGGGGGG-TTGCTCTGATTCGGTTAAGTAATAAGCAAAA 2603_ai1.seq
1    -------------------------------------------------- 18rs21_ai1.seq
101  AGCCCAACAGCAGGGGGGGTTGCTCTGATTCGGTTAAGTAATAAGCAAAA coh1_ai1.seq
101  AGCCCAACAGCAGGGGGGG-TGCTCTGATTCGGTTAAGTAATAAGCAAAA cjb111_ai1.seq
101  AGCCCAACAGCAGGGGGGGGTGCTCTGATTCGGTTAAGTAATAAGCAAAA nem316_ai1.seq
101  AGCCCAACAGCAGGGGGGGTTGCTCTGATTCGGTTAAGTAATAAGCAAAA a909_ai1.seq

     TCCTCACCAATTTTCCCAGTAATAAGAGGCGTTGTTGAGGTATAGGGATT Majority
             160       170       180       190       200
150  TCCTCACCAATTTTCCCAGTAATAAGAGGCGTTGTTGAGGTATAGGGATT 2603_ai1.seq
1    -------------------------------------------------- 18rs21_ai1.seq
151  TCCTCACCAATTTTCCCAGTAATAAGAGGCGTTGTTGAGGTATAGGGATT coh1_ai1.seq
150  TCCTCACCAATTTTCCCAGTAATAAGAGGCGTTGTTGAGGTATAGGGATT cjb111_ai1.seq
151  TCCTCACCAATTTTCCCAGTAATAAGAGGCGTTGTTGAGGTATAGGGATT nem316_ai1.seq
151  TCCTCACCAATTTTCCCAGTAATAAGAGGCGTTGTTGAGGTATAGGGATT a909_ai1.seq

     ACCTGTGCCATAGTCGATGATGGTCACAAAATGACCATTCCCCATAAAAG Majority
             210       220       230       240       250
200  ACCTGTGCCATAGTCGATGATGGTCACAAAATGACCATTCCCCATAAAAG 2603_ai1.seq
1    --------------------------------GACCATTCCCCATAAAAG 18rs21_ai1.seq
201  ACCTGTGCCATAGTCGATGATGGTCACAAAATGACCATTCCCCATAAAAG coh1_ai1.seq
200  ACCTGTGCCATAGTCGATGATGGTCACAAAATGACCATTCCCCATAAAAG cjb111_ai1.seq
201  ACCTGTGCCATAGTCGATGATGGTCACAAAATGACCATTCCCCATAAAAG nem316_ai1.seq
201  ACCTGTGCCATAGTCGATGATGGTCACAAAATGACCATTCCCCATAAAAG a909_ai1.seq

     GGCCAACCAAAACTTCACCTGTGGCCGTTTTTTGATGTCAACACCAGTAT Majority
             260       270       280       290       300
250  GGCCAACCAAAACTTCACCTGTGACCGTTTTTTGATGTCAACACCAGTAT 2603_ai1.seq
19   GGCCAACCAAAACTTCACCTGTGACCGTTTTTTGATGTCAACACCAGTAT 18rs21_ai1.seq
251  GGCCAACCAAAACTTCACCTGTGGCCGTTTTTTGATGTCAACACCAGTAT coh1_ai1.seq
250  GGCCAACCAAAACTTCACCTGTGGCCGTTTTTTGATGTCAACACCAGTAT cjb111_ai1.seq
251  GGCCAACCAAAACTTCACCTGTGGCCGTTTTTTGATGTCAACACCAGTAT nem316_ai1.seq
251  GGCCAACCAAAACTTCACCTGTGGCCGTTTTTTGATGTCAACACCAGTAT a909_ai1.seq

     TTTGGATGTACCCCTTAACATGCCCTTTGGTATCTGCAACAGAGATAATA Majority
             310       320       330       340       350
300  TTTGGATGTACCCCTTAACATGCCCTTTGGTATCTGCAACAGAGATAATA 2603_ai1.seq
69   TTTGGATGTACCCCTTAACATGCCCTTTGGTATCTGCAACAGAGATAATA 18rs21_ai1.seq
301  TTTGGATGTACCCCTTAACATGCCCTTTGGTATCTGCAACAGAGATAATA coh1_ai1.seq
300  TTTGGATGTACCCCTTAACATGCCCTTTGGTATCTGCAACAGAGATAATA cjb111_ai1.seq
301  TTTGGATGTACCCCTTAACATGCCCTTTGGTATCTGCAACAGAGATAATA nem316_ai1.seq
301  TTTGGATGTACCCCTTAACATGCCCTTTGGTATCTGCAACAGAGATAATA a909_ai1.seq
```

FIGURE 18B

Alignment Report of AI-1_alignment, using J. Hein method with Weighted residue weight table.
Thursday, July 29, 2004 5:46 PM TGACCAAAGGAAGAATCACCGATGACTTTAACCGTAATCTTGCTATCGCC Majority
360 370 380 390 400
350 TGACCAAAGGAAGAATCACCGATGACTTTAACCGTAATCTTGCTATCGCC 2603_ai1.seq
119 TGACCAAAGGAAGAATCACCGATGACTTTAACCGTAATCTTGCTATCGCC 18rs21_ai1.seq
351 TGACCAAAGGAAGAATCACCGATGACTTTAACCGTAATCTTGCTATCGCC coh1_ai1.seq
350 TGACCAAAGGAAGAATCACCGATGACTTTAACCGTAATCTTGCTATCGCC cjb111_ai1.seq
351 TGACCAAAGGAAGAATCACCGATGACTTTAACCGTAATCTTGCTATCGCC nem316_ai1.seq
351 TGACCAAAGGAAGAATCACCGATGACTTTAACCGTAATCTTGCTATCGCC a909_ai1.seq TTTTTGATTAGCCGCTAATATTTGATTAGCAATCAGGGTGCGACCAAGAG Majority
410 420 430 440 450
400 TTTTTGATTAGCCGCTAATATTTGATTAGCAATCAGGGTGCGACCAAGAG 2603_ai1.seq
169 TTTTTGATTAGCCGCTAATATTTGATTAGCAATCAGGGTGCGACCAAGAG 18rs21_ai1.seq
401 TTTTTGATTAGCCGCTAATATTTGATTAGCAATCAGGGTGCGACCAAGAG coh1_ai1.seq
400 TTTTTGATTAGCCGCTAATATTTGATTAGCAATCAGGGTGCGACCAAGAG cjb111_ai1.seq
401 TTTTTGATTAGCCGCTAATATTTGATTAGCAATCAGGGTGCGACCAAGAG nem316_ai1.seq
401 TTTTTGATTAGCCGCTAATATTTGATTAGCAATCAGGGTGCGACCAAGAG a909_ai1.seq CAACTGTTGAAGACGACAAGGTATGATGTTTTTCCTGAGCCAATTTAACA Majority
460 470 480 490 500
450 CAACTGTTGAAGACGACAAGGTATGATGTTTTTCCTGAGCCAATTTAACA 2603_ai1.seq
219 CAACTGTTGAAGACGACAAGGTATGATGTTTTTCCTGAGCCAATTTAACA 18rs21_ai1.seq
451 CAACTGTTGAAGACGACAAGGTATGATGTTTTTCCTGAGCCAATTTAACA coh1_ai1.seq
450 CAACTGTTGAAGACGACAAGGTATGATGTTTTTCCTGAGCCAATTTAACA cjb111_ai1.seq
451 CAACTGTTGAAGACGACAAGGTATGATGTTTTTCCTGAGCCAATTTAACA nem316_ai1.seq
451 CAACTGTTGAAGACGACAAGGTATGATGTTTTTCCTGAGCCAATTTAACA a909_ai1.seq GTCTCGGTGCTATCGAGGACATAAGACCTGAAGGCACCAGAGGCAGAAAT Majority
510 520 530 540 550
500 GTCTCGGTGCTATCGAGGACATAAGACCTGAAGGCACCAGAGGCAGAAAT 2603_ai1.seq
269 GTCTCGGTGCTATCGAGGACATAAGACCTGAAGGCACCAGAGGCAGAAAT 18rs21_ai1.seq
501 GTCTCGGTGCTATCGAGGACATAAGACCTGAAGGCACCAGAGGCAGAAAT coh1_ai1.seq
500 GTCTCGGTGCTATCGAGGACATAAGACCTGAAGGCACCAGAGGCAGAAAT cjb111_ai1.seq
501 GTCTCGGTGCTATCGAGGACATAAGACCTGAAGGCACCAGAGGCAGAAAT nem316_ai1.seq
501 GTCTCGGTGCTATCGAGGACATAAGACCTGAAGGCACCAGAGGCAGAAAT a909_ai1.seq TGATTTAATAATTTTATCCATAACCTATGTTATAGCACAAAGAGAGAGTT Majority
560 570 580 590 600
550 TGATTTAATAATTTTATCCATAACCTATGTTATAGCACAAAGAGAGAGTT 2603_ai1.seq
319 TGATTTAATAATTTTATCCATAACCTATGTTATAGCACAAAGAGAGAGTT 18rs21_ai1.seq
551 TGATTTAATAATTTTATCCATAACCTATGTTATAGCACAAAGAGAGAGTT coh1_ai1.seq
550 TGATTTAATAATTTTATCCATAACCTATGTTATAGCACAAAGAGAGAGTT cjb111_ai1.seq
551 TGATTTAATAATTTTATCCATAACCTATGTTATAGCACAAAGAGAGAGTT nem316_ai1.seq
551 TGATTTAATAATTTTATCCATAACCTATGTTATAGCACAAAGAGAGAGTT a909_ai1.seq TGTATGGACTGGATTAGCTGAAAATTTTAGACTAAAAAGTAGTGCCAGTG Majority
610 620 630 640 650
600 TGTATGGACTGGATTAGCTGAAAATTTTAGACTAAAAAGTAGTGCCAGTG 2603_ai1.seq
369 TGTATGGACTGGATTAGCTGAAAATTTTAGACTAAAAAGTAGTGCCAGTG 18rs21_ai1.seq
601 TGTATGGACTGGATTAGCTGAAAATTTTAGACTAAAAAGTAGTGCCAGTG coh1_ai1.seq
600 TGTATGGACTGGATTAGCTGAAAATTTTAGACTAAAAAGTAGTGCCAGTG cjb111_ai1.seq
601 TGTATGGACTGGATTAGCTGAAAATTTTAGACTAAAAAGTAGTGCCAGTG nem316_ai1.seq
601 TGTATGGACTGGATTAGCTGAAAATTTTAGACTAAAAAGTAGTGCCAGTG a909_ai1.seq GATTTTGAAAGGTAACAAAAGAGTCTTCCGTTTAAACGAGAAGGCTGTTT Majority
660 670 680 690 700
650 GATTTTGAAAGGTAACAAAAGAGTCTTCCGTTTAAACGAGAAGGCTCTTT 2603_ai1.seq
419 GATTTTGAAAGGTAACAAAAGAGTCTTCCGTTTAAACGAGAAGGCTCTTT 18rs21_ai1.seq
651 GATTTTGAAAGGTAACAAAAGAGTCTTCCGTTTAAACGAGAAGGCTGTTT coh1_ai1.seq
650 GATTTTGAAAGGTAACAAAAGAGTCTTCCGTTTAAACGAGAAGGCTGTTT cjb111_ai1.seq
651 GATTTTGAAAGGTAACAAAAGAGTCTTCCGTTTAAACGAGAAGGCTGTTT nem316_ai1.seq
651 GATTTTGAAAGGTAACAAAAGAGTTTTCCGTTTAAACGAGAAGGCTGTTT a909_ai1.seq

FIGURE 18C

Alignment Report of AI-1_alignment, using J. Hein method with Weighted residue weight table.
Thursday, July 29, 2004 5:46 PM

```
      TTAGTCGTTTCAGATGAAGGCAAAAGGACGATGAAATAATTCCGTACCTT Majority
                710       720       730       740       750
700   TTAGTCGTTTCAGATGAAGGCAAAAGGACGATGAAATAATTCCGTACCTT 2603_ai1.seq
469   TTAGTCGTTTCAGATGAAGGCAAAAGGACGATGAAATAATTCCGTACCTT 18rs21_ai1.seq
701   TTAGTCGTTTCAGATGAAGGCAAAAGGACGATGAAATAATTCCGTACCTT coh1_ai1.seq
700   TTAGTCGTTTCAGATGAAGGCAAAAGGACGATGAAATAATTCCGTACCTT cjb111_ai1.seq
701   TTAGTCGTTTCAGATGAAGGCAAAAGGACGATGAAATAATTCCGTACCTT nem316_ai1.seq
701   TTAGTCGTTTCAGATGAAGGCAAAAGGACGATGAAATAATTCCGTACCTT a909_ai1.seq

      CATGGATTGCTATGTTACTGGCATGAGGTCTCACGATATTTAGTAAGATA Majority
                760       770       780       790       800
750   CATGGATTGCTATGTTACTGGCATGAGGTCTCACGATATTTAGTAAGATA 2603_ai1.seq
519   CATGGATTGCTATGTTACTGGCATGAGGTCTCACGATATTTAGTAAGATA 18rs21_ai1.seq
751   CATGGATTGCTATGTTACTGGCATGAGGTCTCACGATATTTAGTAAGATA coh1_ai1.seq
750   CATGGATTGCTATGTTACTGGCATGAGGTCTCACGATATTTAGTAAGATA cjb111_ai1.seq
751   CATGGATTGCTATGTTACTGGCATGAGGTCTCACGATATTTAGTAAGATA nem316_ai1.seq
751   CATGGATTGCTATGTTACTGGCATGAGGTCTCACGATATTTAGTAAGATA a909_ai1.seq

      TTCGTTTGAAGATATTCCCACGTATTTTTTAAAGGTTTTAAGAAAATGTG Majority
                810       820       830       840       850
800   TTCGTTTGAAGATATTCCCACGTATTTTTTAAAGGTTTTAAGAAAATGTG 2603_ai1.seq
569   TTCGTTTGAAGATATTCCCACGTATTTTTTAAAGGTTTTAAGAAAATGTG 18rs21_ai1.seq
801   TTCGTTTGAAGATATTCCCACGTATTTTTTAAAGGTTTTAAGAAAATGTG coh1_ai1.seq
800   TTCGTTTGAAGATATTCCCACGTATTTTTTAAAGGTTTTAAGAAAATGTG cjb111_ai1.seq
801   TTCGTTTGAAGATATTCCCACGTATTTTTTAAAGGTTTTAAGAAAATGTG nem316_ai1.seq
801   TTCGTTTGAAGATATTCCCACGTATTTTTTAAAGGTTTTAAGAAAATGTG a909_ai1.seq

      TGGTGTCGTAAAAATGTAATAATTTCGCTACTTCCCCAATCGGTACCCCT Majority
                860       870       880       890       900
850   TGGTGTCGTAAAAATGTAATAATTTCGCTACTTCCCCAATCGGTACCCCT 2603_ai1.seq
619   TGGTGTCGTAAAAATGTAATAATTTCGCTACTTCCCCAATCGGTACCCCT 18rs21_ai1.seq
851   TGGTGTCGTAAAAATGTAATAATTTCGCTACTTCCCCAATCGGTACCCCT coh1_ai1.seq
850   TGGTGTCGTAAAAATGTAATAATTTCGCTACTTCCCCAATCGGTACCCCT cjb111_ai1.seq
851   TGGTGTCGTAAAAATGTAATAATTTCGCTACTTCCCCAATCGGTACCCCT nem316_ai1.seq
851   TGGTGTCGTAAAAATGTAATAATTTCGCTACTTCCCCAATCGGTACCCCT a909_ai1.seq

      CTTTGCAGTAGTAATTGTCCCTCCTTAATTTTTGCCTTTAGAATATAACT Majority
                910       920       930       940       950
900   CTTTGCAGTAGTAATTGTCCCTCCTTAATTTTTGCCTTTAGAATATAACT 2603_ai1.seq
669   CTTTGCAGTAGTAATTGTCCCTCCTTAATTTTTGCCTTTAGAATATAACT 18rs21_ai1.seq
901   CTTTGCAGTAGTAATTGTCCCTCCTTAATTTTTGCCTTTAGAATATAACT coh1_ai1.seq
900   CTTTGCAGTAGTAATTGTCCCTCCTTAATTTTTGCCTTTAGAATATAACT cjb111_ai1.seq
901   CTTTGCAGTAGTAATTGTCCCTCCTTAATTTTTGCCTTTAGAATATAACT nem316_ai1.seq
901   CTTTGCAGTAGTAATTGTCCCTCCTTAATTTTTGCCTTTAGAATATAACT a909_ai1.seq

      TTGCAAGGAAATGTCAGAGTATTTTTTAAAAACTGAGCGTAAGTGGGAAT Majority
                960       970       980       990       1000
950   TTGCAAGGAAATGTCAGAGTATTTTTTAAAAACTGAGCGTAAGTGGGAAT 2603_ai1.seq
719   TTGCAAGGAAATGTCAGAGTATTTTTTAAAAACTGAGCGTAAGTGGGAAT 18rs21_ai1.seq
951   TTGCAAGGAAATGTCAGAGTATTTTTTAAAAACTGAGCGTAAGTGGGAAT coh1_ai1.seq
950   TTGCAAGGAAATGTCAGAGTATTTTTTAAAAACCGAGCGTAAGTGGGAAT cjb111_ai1.seq
951   TTGCAAGGAAATGTCAGAGTATTTTTTAAAAACCGAGCGTAAGTGGGAAT nem316_ai1.seq
951   TTGCAAGGAAATGTCAGAGTATTTTTTAAAAACCGAGCGTAAGTGGGAAT a909_ai1.seq

      CTGAGATATATAGGTAGTTGGCAATATCAGATACTTTGAGTTTGGAGTAG Majority
                1010      1020      1030      1040      1050
1000  CTGAGATATATAGGTAGTTGGCAATATCAGATACTTTGAGTTTGGAGTAG 2603_ai1.seq
769   CTGAGATATATAGGTAGTTGGCAATATCAGATACTTTGAGTTTGGAGTAG 18rs21_ai1.seq
1001  CTGAGATATATAGGTAGTTGGCAATATCAGATACTTTGAGTTTGGAGTAG coh1_ai1.seq
1000  TTGAGATATATAGGTAGTTGGCAATATCAGATACTTTGAGTTTGGAGTAG cjb111_ai1.seq
1001  CTGAGATATATAGGTAGTTGGCAATATCAGATACTTTGAGTTTGGAGTAG nem316_ai1.seq
1001  CTGAGATATATAGGTAGTTGGCAATATCAGATACTTTGAGTTTGGAGTAG a909_ai1.seq
```

FIGURE 18D

Alignment Report of AI-1_alignment, using J. Hein method with Weighted residue weight table.
Thursday, July 29, 2004 5:46 PM

```
     AGGTGGTTGTCCACATAATGGAGAATACTATTGTACATTTGCTGCTTGTC Majority
               1060      1070      1080      1090      1100
1050 AGGTGGTTGTCCACATAATGGAGAATACTATTGTACATTTGCTGCTTGTC 2603_ai1.seq
819  AGGTGGTTGTCCACATAATGGAGAATACTATTGTACATTTGCTGCTTGTC 18rs21_ai1.seq
1051 AGGTGGTTGTCCACATAATGGAGAATACTATTGTACATTTGCTGCTTGTC coh1_ai1.seq
1050 AGGTGGTTGTCCACATAATGGAGAATACTATTGTACATTTGCTGCTTGTC cjb111_ai1.seq
1051 AGGTGGTTGTCCACATAATGGAGAATACTATTGTACATTTGCTGCTTGTC nem316_ai1.seq
1051 AGGTGGTTGTCCACATAATGGAGAATACTATTGTACATTTGCTGCTTGTC a909_ai1.seq

     AGAGATGCTCTTATTGGTTAAGGATTCTGAAAAATCAATAAGAGCTGCAC Majority
               1110      1120      1130      1140      1150
1100 AGAGATGCTCTTATTGGTTAAGGATTCTGAAAAATCAATAAGAGCTGCAC 2603_ai1.seq
869  AGAGATGCTCTTATTGGTTAAGGATTCTGAAAAATCAATAAGAGCTGCAC 18rs21_ai1.seq
1101 AGAGATGCTCTTATTGGTTAAGGATTCTGAAAAATCAATAAGAGCTGCAC coh1_ai1.seq
1100 AGAGATGCTCTTATTGGTTAAGGATTCTGAAAAATCAATAAGAGCTGCAC cjb111_ai1.seq
1101 AGAGATGCTCTTATTGGTTAAGGATTCTGAAAAATCAATAAGAGCTGCAC nem316_ai1.seq
1101 AGAGATGCTCTTATTGGTTAAGGATTCTGAAAAATCAATAAGAGCTGCAC a909_ai1.seq

     AGCGAATTCTTGAAACATCAATAAGATCAGGAGCCTCTTCGTTTAAAGCC Majority
               1160      1170      1180      1190      1200
1150 AGCGAATTCTTGAAACATCAATAAGATCAGGAGCCTCTTCGTTTAAAGCC 2603_ai1.seq
919  AGCGAATTCTTGAAACATCAATAAGATCAGGAGCCTCTTCGTTTAAAGCC 18rs21_ai1.seq
1151 AGCGAATTCTTGAAACATCAATAAGATCAGGAGCCTCTTCGTTTAAAGCC coh1_ai1.seq
1150 AGCGAATTCTTGAAACATCAATAAGATCAGGAGCCTCTTCGTTTAAAGCC cjb111_ai1.seq
1151 AGCGAATTCTTGAAACATCAATAAGATCAGGAGCCTATTCGTTTAAAGCC nem316_ai1.seq
1151 AGCGAATTCTTGAAACATCAATAAGATCAGGAGCCTCTTCGTTTAAAGCC a909_ai1.seq

     ATATAGTGCTTTACCAGCGCATAACTTTTAGCCACATCAGTATTTTCCTC Majority
               1210      1220      1230      1240      1250
1200 ATATAGTGCTTTACCAGCGCATAACTTTTAGCCACATCAGTATTTTCCTC 2603_ai1.seq
969  ATATAGTGCTTTACCAGCGCATAACTTTTAGCCACATCAGTATTTTCCTC 18rs21_ai1.seq
1201 ATATAGTGCTTTACCAGCGCATAACTTTTAGCCACATCAGTATTTTCCTC coh1_ai1.seq
1200 ATATAGTGCTTTACCAGCGCATAACTTTTAGCCACATCAGTATTTTTCTC cjb111_ai1.seq
1201 ATATAGTGCTTTACCAGCGCATAACTTTTAGCCACATCAGTATTTTCCTC nem316_ai1.seq
1201 ATATAGTGCTTTACCAGCGCATAACTTTTAGCCACATCAGTATTTTCCTC a909_ai1.seq

     GAAACTTAATTCTAGTAATTTTGTTAAGTAAACAACAGTTAAGTTCTTTT Majority
               1260      1270      1280      1290      1300
1250 GAAACTTAATTCTAGTAATTTTGTTAAGTAAACAACAGTTAAGTTCTTTT 2603_ai1.seq
1019 GAAACTTAATTCTAGTAATTTTGTTAAGTAAACAACAGTTAAGTTCTTTT 18rs21_ai1.seq
1251 GAAACTTAATTCTAGTAATTTTGTTAAGTAAACAACAGTTAAGTTCTTTT coh1_ai1.seq
1250 GAAACTTAATTCTAGTAATTTTGTTAAGTAAACAACAGTTAAGTTCTTTT cjb111_ai1.seq
1251 GAAACTTAATTCTAGTAATTTTGTTAAGTAAACAACAGTTAAGTTCTTTT nem316_ai1.seq
1251 GAAACTTAATTCTAGTAATTTTGTTAAGTAAACAACAGTTAAGTTCTTTT a909_ai1.seq

     CAGCTCTTAGGGCAGGGATTGAAGATGAGGTAACACTGGATGATGGGAGG Majority
               1310      1320      1330      1340      1350
1300 CAGCTCTTAGGGCAGGGATTGAAGATGAGGTAACACTGGATGATGGGAGG 2603_ai1.seq
1069 CAGCTCTTAGGGCAGGGATTGAAGATGAGGTAACACTGGATGATGGGAGG 18rs21_ai1.seq
1301 CAGCTCTTAGGGCAGGGATTGAAGATGAGGTAACACTGGATGATGGGAGG coh1_ai1.seq
1300 CAGCTCTTAGGGCAGGGATTGAAGATGAGGTAACACTGGATGATGGGAGG cjb111_ai1.seq
1301 CAGCTCTTAGGGCAGGGATTGAAGATGAGGTAACACTGGATGATGGGAGG nem316_ai1.seq
1301 CAGCTCTTAGGGCAGGGATTGAAGATGAGGTAACACTGGATGATGGGAGG a909_ai1.seq

     CGATTAATTTCTTGCTTTAACAGTTGAGTGTTACCCAGCTTAACGAGATC Majority
               1360      1370      1380      1390      1400
1350 CGATTAATTTCTTGCTTTAACAGTTGAGTGTTACCCAGCTTAACGAGATC 2603_ai1.seq
1119 CGATTAATTTCTTGCTTTAACAGTTGAGTGTTACCCAGCTTAACGAGATC 18rs21_ai1.seq
1351 CGATTAATTTCTTGCTTTAACAGTTGAGTGTTACCCAGCTTAACGAGATC coh1_ai1.seq
1350 CGATTAATTTCTTGCTTTAACAGTTGAGTGTTACCCAGCTTAACGAGATC cjb111_ai1.seq
1351 CGATTAATTTCTTGCTTTAACAGTTGAGTGTTACCCAGCTTAACGAGATC nem316_ai1.seq
1351 CGATTAATTTCTTGCTTTAACAGTTGAGTGTTACCCAGCTTAACGAGATC a909_ai1.seq
```

FIGURE 18E

Alignment Report of AI-1_alignment, using J. Hein method with Weighted residue weight table.
Thursday, July 29, 2004 5:46 PM

```
     AATAATGTGATTGAGATGGTTTAAAACAGTGGGTAACTGAAAAGAGTTTT Majority
               1410      1420      1430      1440      1450
1400 AATAATGTGATTGAGATGGTTTAAAACAGTGGGTAACTGAAAAGAGTTTT 2603_ai1.seq
1169 AATAATGTGATTGAGATGGTTTAAAACAGTGGGTAACTGAAAAGAGTTTT 18rs21_ai1.seq
1401 AATAATGTGATTGAGATGGTTTAAAACAGTGGGTAACTGAAAAGAGTTTT coh1_ai1.seq
1400 AATAATGTGATTGAGATGGTTTAAAACAGTGGGTAACTGAAAAGAGTTTT cjb111_ai1.seq
1401 AATAATGTGATTGAGATGGTTTAAAACAGTGGGTAACTGAAAAGAGTTTT nem316_ai1.seq
1401 AATAATGTGATTGAGATGGTTTAAAACAGTGGGTAACTGAAAAGAGTTTT a909_ai1.seq

     TCTTAGTATGTTTTAGGTGAAGAACAATATCAGGATCCGCAACAATCTGT Majority
               1460      1470      1480      1490      1500
1450 TCTTAGTATGTTTTAGGTGAAGAACAATATCAGGATCCGCAACAATCTGT 2603_ai1.seq
1219 TCTTAGTATGTTTTAGGTGAAGAACAATATCAGGATCCGCAACAATCTGT 18rs21_ai1.seq
1451 TCTTAGTATGTTTTAGGTGAAGAACAATATCAGGATCCGCAACAATCTGT coh1_ai1.seq
1450 TCTTAGTATGTTTTAGGTGAAGAACAATATCAGGATCCGCAACAATCTGT cjb111_ai1.seq
1451 TCTTAGTATGTTTTAGGTGAAGAACAATATCAGGATCCGCAACAATCTGT nem316_ai1.seq
1451 TCTTAGTATGTTTTAGGTGAAGAACAATATCAGGATCCGCAACAATCTGT a909_ai1.seq

     TCTGACTCTTCTAATAAATGATTGATGGCTTGTTGGCAACTAGCCTCAAA Majority
               1510      1520      1530      1540      1550
1500 TCTGACTCTTCTAATAAATGATTGATGACTTGTTGGCAACTAGCCTCAAA 2603_ai1.seq
1269 TCTGACTCTTCTAATAAATGATTGATGACTTGTTGGCAACTAGCCTCAAA 18rs21_ai1.seq
1501 TCTGACTCTTCTAATAAATGATTGATGACTTGTTGGCAACTAGCCTCAAA coh1_ai1.seq
1500 TCTGACTCTTCTAATAAATGATTGATGGCTTGTTGGCAACTAGCCTCAAA cjb111_ai1.seq
1501 TCTGACTCTTCTAATAAATGATTGATGGCTTGTTGGCAACTAGCCTCAAA nem316_ai1.seq
1501 TCTGACTCTTCTAATAAATGATTGATGGCTTGTTGGCAACTAGCCTCAAA a909_ai1.seq

     CTGTGTTTGGAAAAAGGCATCGATAGACACAAGAAGACTACGTATACTGG Majority
               1560      1570      1580      1590      1600
1550 CTGTGTTTGGAAAAAGGCATCGATAGACACAAGAAGACTACGTATACTGG 2603_ai1.seq
1319 CTGTGTTTGGAAAAAGGCATCGATAGACACAAGAAGACTACGTATACTGG 18rs21_ai1.seq
1551 CTGTGTTTGGAAAAAGGCATCGATAGACACAAGAAGACTACGTATACTGG coh1_ai1.seq
1550 CTGTGTTTGGAAAAAGGCATCGATAGACACAAGAAGACTACGTATACTGG cjb111_ai1.seq
1551 CTGTGTTTGGAAAAAGGCATCGATAGACACAAGAAGACTACGTATACTGG nem316_ai1.seq
1551 CTGTGTTTGGAAAAAGGCATCGATAGACACAAGAAGACTACGTATACTGG a909_ai1.seq

     TAGTAGGAAAACAAGGGACAAGCTTTATATAGGATAAGATTTCTTTTTTA Majority
               1610      1620      1630      1640      1650
1600 TAGTAGGAAAACAAGGGACAAGCTTTATATAGGATAAGATTTCTTTTTTA 2603_ai1.seq
1369 TAGTAGGAAAACAAGGGACAAGCTTTATATAGGATAAGATTTCTTTTTTA 18rs21_ai1.seq
1601 TAGTAGGAAAACAAGGGACAAGCTTTATATAGGATAAGATTTCTTTTTTA coh1_ai1.seq
1600 TAGTAGGAAAACAAGGGACAAGCTTTATATAGGATAAGATTTCTTTTTTA cjb111_ai1.seq
1601 TAGTAGGAAAACAAGGGACAAGCTTTATATAGGATAAGATTTCTTTTTTA nem316_ai1.seq
1601 TAGTAGGAAAACAAGGGACAAGCTTTATATAGGATAAGATTTCTTTTTTA a909_ai1.seq

     CTACGATGAGAAAATTGTTCTAGAAAGCGACTGGATAACTGTTCTTGCCT Majority
               1660      1670      1680      1690      1700
1650 TTACGATGAGAAAATTGTTCTAGAAAGCGACTGGATAACTGTTCTTGCCT 2603_ai1.seq
1419 CTACGATGAGAAAATTGTTCTAGAAAGCGACTGGATAACTGTTCTTGCCT 18rs21_ai1.seq
1651 CTACGATGAGAAAATTGTTCTAGAAAGCGACTGGATAACTGTTCTTGCCT coh1_ai1.seq
1650 CTACGATGAGAAAATTGTTCTAGAAAGCGACTGGATAACTGTTCTTGCCT cjb111_ai1.seq
1651 CTACGATGAGAAAATTGTTCTAGAAAGCGACTGGATAACTGTTCTTGCCT nem316_ai1.seq
1651 CTACGATGAGAAAATTGTTCTAGAAAGCGACTGGATAACTGTTCTTGCCT a909_ai1.seq

     ATTGATATCAGGGCTATAGGGATAAAATGGTCCAATAGCAATAAGATATT Majority
               1710      1720      1730      1740      1750
1700 ATTGATATCAGGGCTATAGGGATAAAATGGTCCAATAGCAATAAGATATT 2603_ai1.seq
1469 ATTGATATCAGGGCTATAGGGATAAAATGGTCCAATAGCAATAAGATATT 18rs21_ai1.seq
1701 ATTGATATCAGGGCTATAGGGATAAAATGGTCCAATAGCAATAAGATATT coh1_ai1.seq
1700 ATTGATATCAGGGCTATAGGGATAAAATGGTCCAATAGCAATAAGATATT cjb111_ai1.seq
1701 ATTGATATCAGGGCTATAGGGATAAAATGGTCCAATAGCAATAAGATATT nem316_ai1.seq
1701 ATTGATATCAGGGCTATAGGGATAAAATGGTCCAATAGCAATAAGATATT a909_ai1.seq
```

FIGURE 18F

Alignment Report of AI-1_alignment, using J. Hein method with Weighted residue weight table.
Thursday, July 29, 2004 5:46 PM

```
     G A C A G A C A G G A A A A A T T A A G A A T G A T T C T T C A A A A A G A C C C T C A T A A A C A Majority
                       1760                1770                1780                1790                1800
1750 G A C A G A C A G G A A A A A T T A A G A A T G A T T C T T C A A A A A G A C C C T C A T A A A C A 2603_ai1.seq
1519 G A C A G A C A G G A A A A A T T A A G A A T G A T T C T T C A A A A A G A C C C T C A T A A A C A 18rs21_ai1.seq
1751 G A C A G A C A G G A A A A A T T A A G A A T G A T T C T T C A A A A A G A C C C T C A T A A A C A coh1_ai1.seq
1750 G A C A G A C A G G A A A A A T T A A G A A T G A T T C T T C A A A A A G A C C C T C A T A A A C A cjb111_ai1.seq
1751 G A C A G A C A G G A A A A A T T A A G A A T G A T T C T T C A A A A A G A C C C T C A T A A A C A nem316_ai1.seq
1751 G A C A G A C A G G A A A A A T T A A G A A T G A T T C T T C A A A A A G A T C C T C A T A A A C A a909_ai1.seq

     G T G A T A T C T T G G T T A T A A G G G A T A G C T A A A T G T T T T A A A A A C T G A T A G T A Majority
                       1810                1820                1830                1840                1850
1800 G T G A T A T C T T G G T T A T A A G G G A T A G C T A A A T G T T T T A A A A A C T G A T A G T A 2603_ai1.seq
1569 G T G A T A T C T T G G T T A T A A G G G A T A G C T A A A T G T T T T A A A A A C T G A T A G T A 18rs21_ai1.seq
1801 G T G A T A T C T T G G T T A T A A G G G A T A G C T A A A T G T T T T A A A A A C T G A T A G T A coh1_ai1.seq
1800 G T G A T A T C T T G G T T A T A A G G G A T A G C T A A A T G T T T T A A A A A C T G A T A G T A cjb111_ai1.seq
1801 G T G A T A T C T T G G T T A T A A G G G A T A G C T A A A T G T T T T A A A A A C T G A T A G T A nem316_ai1.seq
1801 G T G A T A T C T T G G T T A T A A G G G A T A G C T A A A T G T T T T A A A A A C T G A T A G T A a909_ai1.seq

     A G G C A A C A G A T A G T C T T C G T T A C C A T A T A A C T G A A C G A G T T C C T T G T C T C Majority
                       1860                1870                1880                1890                1900
1850 A G G C A A C A G A T A G T C T T C G T T A C C A T A T A A C T G A A C G A G T T C C T T G T C T C 2603_ai1.seq
1619 A G G C A A C A G A T A G T C T T C G T T A C C A T A T A A C T G A A C G A G T T C C T T G T C T C 18rs21_ai1.seq
1851 A G G C A A C A G A T A G T C T T C G T T A C T A T A T A A C T G A A C G A G T T C C T T G T C T C coh1_ai1.seq
1850 A G G C A A C A G A T A G T C T T C G T T A C C A T A T A A C T G A A C G A G T T C C T T G T C T C cjb111_ai1.seq
1851 A G G C A A C A G A T A G T C T T C G T T A C C A T A T A A C T G A A C G A G T T C C T T G T C T C nem316_ai1.seq
1851 A G G C A A C A G A T A G T C T T C G T T A C C A T A T A A C T G A A C G A G T T C C T T G T C T C a909_ai1.seq

     G T G A C A T G A C T G A A A T A G G T A G T T G A G A T A T G G T A T G C A A T G T T T G A A C A Majority
                       1910                1920                1930                1940                1950
1900 G T G A C A T G A C T G A A A T A G G T A G T T G A G A T A T G G T A T G C A A T G T T T G A A C A 2603_ai1.seq
1669 G T G A C A T G A C T G A A A T A G G T A G T T G A G A T A T G G T A T G C A A T G T T T G A A C A 18rs21_ai1.seq
1901 G T G A C A T G A C T G A A A T A G G T A G T T G A G A T A T G G T A T G C A A T G T T T G A A C A coh1_ai1.seq
1900 G T G A C A T G A C T G A A A T A G G T A G T T G A G A T A T G G T A T G C A A T G T T T G A A C A cjb111_ai1.seq
1901 G T G A C A T G A C T G A A A T A G G T A G T T G A G A T A T G G T A T G C A A T G T T T G A A C A nem316_ai1.seq
1901 G T G A C A T G A C T G A A A T A G G T A G T T G A G A T A T G G T A T G C A A T G T T T G A A C A a909_ai1.seq

     T G T T T A A A A T C G A A T G T A A C C A T T T G A T A G A C C G C C T T C A T T A T C A T T T C Majority
                       1960                1970                1980                1990                2000
1950 T G T T T A A A A T C G A A T G T A A C C A T T T G A T A G A C C G C C T T C A T T A T C A T T T C 2603_ai1.seq
1719 T G T T T A A A A T C G A A T G T A A C C A T T T G A T A G A C C G C C T T C A T T A T C A T T T C 18rs21_ai1.seq
1951 T G T T T A A A A T C G A A T G T A A C C A T T T G A T A G A C C G C C T T C A T T A T C A T T T C coh1_ai1.seq
1950 T G T T T A A A A T C G A A T G T A A C C A T T T G A T A G A C C G C C T T C A T T A T C A T T T C cjb111_ai1.seq
1951 T G T T T A A A A T C G A A T G T A A C C A T T T G A T A G A C C G C C T T C A T T A T C A T T T C nem316_ai1.seq
1951 T G T T T A A A A T C G A A T G T A A C C A T T T G A T A G A C C G C C T T C A T T A T C A T T T C a909_ai1.seq

     T A G A A T T T T T C T T T A G G T T T G T A A A G A C T A C A A A A T A A A A T G A T G A A A A C Majority
                       2010                2020                2030                2040                2050
2000 T A G A A T T T T T C T T T A G G T T T G T A A A G A C T A C A A A A T A A A A T G A T G A A A A C 2603_ai1.seq
1769 T A G A A T T T T T C T T T A G G T T T G T A A A G A C T A C A A A A T A A A A T G A T G A A A A C 18rs21_ai1.seq
2001 T A G A A T T T T T C T T T A G G T T T G T A A A G A C T A C A A A A T A A A A T G A T G A A A A C coh1_ai1.seq
2000 T A G A A T T T T T C T T T A G G T T T G T A A A G A C T A C A A A A T A A A A T G A T G A A A A C cjb111_ai1.seq
2001 T A G A A T T T T T C T T T A G G T T T G T A A A G A C T A C A A A A T A A A A T G A T G A A A A C nem316_ai1.seq
2001 T A G A A T T T T T C T T T A G G T T T G T A A A G A C T A C A A A A T A A A A T G A T G A A A A C a909_ai1.seq

     A A C T A T C T T G T G G A T A C A C T A A A A A G A C A C G C T A A T T A G C A A A C T C T C T C Majority
                       2060                2070                2080                2090                2100
2050 A A C T A T C T T G T G G A T A C A C T A A A A A G A C A C G C T A A T T A G C A A A C T C T C T C 2603_ai1.seq
1819 A A C T A T C T T G T G G A T A C A C T A A A A A G A C A C G C T A A T T A G C A A A C T C T C T C 18rs21_ai1.seq
2051 A A C T A T C T T G T G G A T A C A C T A A A A A G A C A C G C T A A T T A G C A A A C T C T C T C coh1_ai1.seq
2050 A A C T A T C T T G T G G A T A C A C T A A A A A G A C A C G C T A A T T A G C A A A C T C T C T C cjb111_ai1.seq
2051 A A C T A T C T T G T G G A T A C A C T A A A A A G A C A C G C T A A T T A G C A A A C T C T C T C nem316_ai1.seq
2051 A A C T A T C T T G T G G A T A C A C T A A A A A G A C A C G C T A A T T A G C A A A C T C T C T C a909_ai1.seq
```

FIGURE 18G

Alignment Report of AI-1_alignment, using J. Hein method with Weighted residue weight table.
Thursday, July 29, 2004 5:46 PM

```
     TTCATCATCTCTCACCATTATTATACTACTATTTATATGACAAATAAAGG Majority
               2110      2120      2130      2140      2150
2100 TTCATCATCTCTCACCATTATTATACTACTATTTATATGACAAATAAAGG 2603_ai1.seq
1869 TTCATCATCTCTCACCATTATTATACTACTATTTATATGACAAATAAAGG 18rs21_ai1.seq
2101 TTCATCATCTCTCACCATTATTATACTACTATTTATATGACAAATAAAGG coh1_ai1.seq
2100 TTCATCATCTCTCACCATTATTATACTACTATTTATATGACAAATAAAGG cjb111_ai1.seq
2101 TTCATCATCTCTCACCATTATTATACTACTATTTATATGACAAATAAAGG nem316_ai1.seq
2101 TTCATCATCTCTCACCATTATTATACTACTATTTATATGACAAATAAAGG a909_ai1.seq

     TGATTTTGTTAAAAATATAACTTTGAAAATCCACATATATTTTTAATCTT Majority
               2160      2170      2180      2190      2200
2150 TGATTTTGTTAAAA-TATAACTTTGAAAATCCACATATATTTTTAATCTT 2603_ai1.seq
1919 TGATTTTGTTAAAA-TATAACTTTGAAAATCCACATATATTTTTAATCTT 18rs21_ai1.seq
2151 TTATTTTGTTAAAA-TATAACTTTGAAAATCCACATATATTTTTAATCTT coh1_ai1.seq
2150 TGATTTTGTTAAAAATATAACTTTGAAAATCCACATATATTTTTAATCTT cjb111_ai1.seq
2151 TGATTTTGTTAAAAATATAACTTTGAAAATCCACATATATTTTTAATCTT nem316_ai1.seq
2151 TGATTTTGTTAAAAATATAACTTTGAAAATCCACATATATTTTTAATCTT a909_ai1.seq

     CCGTCTGAAAAAA-TAAATAAAAATAGTAAAAATAAACACGAATTTAAAA Majority
               2210      2220      2230      2240      2250
2199 CCGTCTGAAAAAA-TAAATAAAAATAGTAAAAATAAACACGAATTTAAAA 2603_ai1.seq
1968 CCGTCTGAAAAAA-TAAATAAAAATAGTAAAAATAAACACGAATTTAAAA 18rs21_ai1.seq
2200 CCGTCTGAAAAAA-TAAATAAAAATAGTAAAAATAAACACGAATTTAAAA coh1_ai1.seq
2200 CCGTCTGAAAAAA-TAAATAAAAATAGTAAAAATAAACACGAATTTAAAA cjb111_ai1.seq
2201 CCGTCTGAAAAAAATAAATAAAAATAGTAAAAATAAACACGAATTTAAAA nem316_ai1.seq
2201 CCGTCTGAAAAAA-TAAATAAAAATAGTAAAAATAAACACGAATTTAAAA a909_ai1.seq

     TAAGCAAATTTTTTAAGAAAATCTGTGCTAAACTTTAATAGTTTTGTGCT Majority
               2260      2270      2280      2290      2300
2248 TAAGCAAATTTTTTAAGAAAATCTGTGCTAAACTTTAATAGTTTTGTGCT 2603_ai1.seq
2017 TAAGCAAATTTTTTAAGAAAATCTGTGCTAAACTTTAATAGTTTTGTGCT 18rs21_ai1.seq
2249 TAAGCAAATTTTTTAAGAAAATCTGTGCTAAACTTTAATAGTTTTGTGCT coh1_ai1.seq
2249 TAAGCAAATTTTTTAAGAAAATCTGTGCTAAACTTTAATAGTTTTGTGCT cjb111_ai1.seq
2251 TAAGCAAATTTTTTAAGAAAATCTGTGCTAAACTTTAATAGTTTTGTGCT nem316_ai1.seq
2250 TAAGCAAATTTTTTAAGAAAATCTGTGCTAAACTTTAATAGTTTTGTGCT a909_ai1.seq

     TAATAATAATCAGCACTTACAAAGAACAAAGGGAAAAGCGAGGAGAGAAC Majority
               2310      2320      2330      2340      2350
2298 TAATAATAATCAGCACTTACAAAGAACAAAGGGAAAAGCGAGGAGAGAAC 2603_ai1.seq
2067 TAATAATAATCAGCACTTACAAAGAACAAAGGGAAAAGCGAGGAGAGAAC 18rs21_ai1.seq
2299 TAATAATAATCAGCACTTACAAAGAACAAAGGGAAAAGCGAGGAGAGAAC coh1_ai1.seq
2299 TAATAATAATCAGCACTTACAAAGAACAAAGGGAAAAGCGAGGAGAGAAC cjb111_ai1.seq
2301 TAATAATAATCAGCACTTACAAAGAACAAAGGGAAAAGCGAGGAGAGAAC nem316_ai1.seq
2300 TAATAATAATCAGCACTTACAAAGAACAAAGGGAAAAGCGAGGAGAGAAC a909_ai1.seq

     TTTTAATGAAATTATCGAAGAAGTTATTGTTTTCGGCTGCTGTTTTAACA Majority
               2360      2370      2380      2390      2400
2348 TTTTAATGAAATTATCGAAGAAGTTATTGTTTTCGGCTGCTGTTTTAACA 2603_ai1.seq
2117 TTTTAATGAAATTATCGAAGAAGTTATTGTTTTCGGCTGCTGTTTTAACA 18rs21_ai1.seq
2349 TTTTAATGAAATTATCGAAGAAGTTATTGTTTTCGGCTGCTGTTTTAACA coh1_ai1.seq
2349 TTTTAATGAAATTATCGAAGAAGTTATTGTTTTCGGCTGCTGTTTTAACA cjb111_ai1.seq
2351 TTTTAATGAAATTATCGAAGAAGTTATTGTTTTCGGCTGCTGTTTTAACA nem316_ai1.seq
2350 TTTTAATGAAATTATCGAAGAAGTTATTGTTTTCGGCTGCTGTTTTAACA a909_ai1.seq

     ATGGTGGCGGGGTCAACTGTTGAACCAGTAGCTCAGTTTGCGACTGGAAT Majority
               2410      2420      2430      2440      2450
2398 ATGGTGGCGGGGTCAACTGTTGAACCAGTAGCTCAGTTTGCGACTGGAAT 2603_ai1.seq
2167 ATGGTGGCGGGGTCAACTGTTGAACCAGTAGCTCAGTTTGCGACTGGAAT 18rs21_ai1.seq
2399 ATGGTGGCGGGGTCAACTGTTGAACCAGTAGCTCAGTTTGCGACTGGAAT coh1_ai1.seq
2399 ATAGTGGCGGGGTCAACTGTTGAACCAGTAGCTCAGTTTGCGACTGGAAT cjb111_ai1.seq
2401 ATGGTGGCGGGGTCAACTGTTGAACCAGTAGCTCAGTTTGCGACTGGAAT nem316_ai1.seq
2400 ATAGTGGCGGGGTCAACTGTTGAACCAGTAGCTCAGTTTGCGACTGGAAT a909_ai1.seq
```

FIGURE 18H

Alignment Report of AI-1_alignment, using J. Hein method with Weighted residue weight table.
Thursday, July 29, 2004 5:46 PM

```
     G A G T A T T G T A A G A G C T G C A G A A G T G T C A C A A G A A C G C C C A G C G A A A A C A A Majority
                    2460                2470                2480                2490                2500
2448 G A G T A T T G T A A G A G C T G C A G A A G T G T C A C A A G A A C G C C C A G C G A A A A C A A 2603_ai1.seq
2217 G A G T A T T G T A A G A G C T G C A G A A G T G T C A C A A G A A C G C C C A G C G A A A A C A A 18rs21_ai1.seq
2449 G A G T A T T G T A A G A G C T G C A G A A G T G T C A C A A G A A C G C C C A G C G A A A A C A A coh1_ai1.seq
2449 G A G T A T T G T A A G A G C T G C A G A A G T G T C A C A A G A A C G C C C A G C G A A A A C A A cjb111_ai1.seq
2451 G A G T A T T G T A A G A G C T G C A G A A G T G T C A C A A G A A C G C C C A G C G A A A A C A A nem316_ai1.seq
2450 G A G T A T T G T A A G A G C T G C A G A A G T G T C A C A A G A A C G C C C A G C G A A A A C A A a909_ai1.seq

     C A G T A A A T A T C T A T A A A T T A C A A G C T G A T A G T T A T A A A T C G G A A A T T A C T Majority
                    2510                2520                2530                2540                2550
2498 C A G T A A A T A T C T A T A A A T T A C A A G C T G A T A G T T A T A A A T C G G A A A T T A C T 2603_ai1.seq
2267 C A G T A A A T A T C T A T A A A T T A C A A G C T G A T A G T T A T A A A T C G G A A A T T A C T 18rs21_ai1.seq
2499 C A G T A A A T A T C T A T A A A T T A C A A G C T G A T A G T T A T A A A T C G G A A A T T A C T coh1_ai1.seq
2499 C A G T A A A T A T C T A T A A A T T A C A A G C T G A T A G T T A T A A A T C G G A A A T T A C T cjb111_ai1.seq
2501 C A G T A A A T A T C T A T A A A T T A C A A G C T G A T A G T T A T A A A T C G G A A A T T A C T nem316_ai1.seq
2500 C A G T A A A T A T C T A T A A A T T A C A A G C T G A T A G T T A T A A A T C G G A A A T T A C T a909_ai1.seq

     T C T A A T G G T G G T A T C G A G A A T A A A G A C G G C G A A G T A A T A T C T A A C T A T G C Majority
                    2560                2570                2580                2590                2600
2548 T C T A A T G G T G G T A T C G A G A A T A A A G A C G G C G A A G T A A T A T C T A A C T A T G C 2603_ai1.seq
2317 T C T A A T G G T G G T A T C G A G A A T A A A G A C G G C G A A G T A A T A T C T A A C T A T G C 18rs21_ai1.seq
2549 T C T A A T G G T G G T A T C G A G A A T A A A G A C G G C G A A G T A A T A T C T A A C T A T G C coh1_ai1.seq
2549 T C T A A T G G T G G T A T C G A G A A T A A A G A C G G C G A A G T A A T A T C T A A C T A T G C cjb111_ai1.seq
2551 T C T A A T G G T G G T A T C G A G A A T A A A G A C G G C G A A G T A A T A T C T A A C T A T G C nem316_ai1.seq
2550 T C T A A T G G T G G T A T C G A G A A T A A A G A C G G C G A A G T A A T A T C T A A C T A T G C a909_ai1.seq

     T A A A C T T G G T G A C A A T G T A A A A G G T T T G C A A G G T G T A C A G T T T A A A C G T T Majority
                    2610                2620                2630                2640                2650
2598 T A A A C T T G G T G A C A A T G T A A A A G G T T T G C A A G G T G T A C A G T T T A A A C G T T 2603_ai1.seq
2367 T A A A C T T G G T G A C A A T G T A A A A G G T T T G C A A G G T G T A C A G T T T A A A C G T T 18rs21_ai1.seq
2599 T A A A C T T G G T G A C A A T G T A A A A G G T T T G C A A G G T G T A C A G T T T A A A C G T T coh1_ai1.seq
2599 T A A A C T T G G T G A C A A T G T A A A A G G T T T G C A A G G T G T A C A G T T T A A A C G T T cjb111_ai1.seq
2601 T A A A C T T G G T G A C A A T G T A A A A G G T T T G C A A G G T G T A C A G T T T A A A C G T T nem316_ai1.seq
2600 T A A A C T T G G T G A C A A T G T A A A A G G T T T G C A A G G T G T A C A G T T T A A A C G T T a909_ai1.seq

     A T A A A G T C A A G A C G G A T A T T T C T G T T G A T G A A T T G A A A A A A T T G A C A A C A Majority
                    2660                2670                2680                2690                2700
2648 A T A A A G T C A A G A C G G A T A T T T C T G T T G A T G A A T T G A A A A A A T T G A C A A C A 2603_ai1.seq
2417 A T A A A G T C A A G A C G G A T A T T T C T G T T G A T G A A T T G A A A A A A T T G A C A A C A 18rs21_ai1.seq
2649 A T A A A G T C A A G A C G G A T A T T T C T G T T G A T G A A T T G A A A A A A T T G A C A A C A coh1_ai1.seq
2649 A T A A A G T C A A G A C G G A T A T T T C T G T T G A T G A A T T G A A A A A A T T G A C A A C A cjb111_ai1.seq
2651 A T A A A G T C A A G A C G G A T A T T T C T G T T G A T G A A T T G A A A A A A T T G A C A A C A nem316_ai1.seq
2650 A T A A A G T C A A G A C G G A T A T T T C T G T T G A T G A A T T G A A A A A A T T G A C A A C A a909_ai1.seq

     G T T G A A G C A G C A G A T G C A A A A G T T G G A A C G A T T C T T G A A G A A G G T G T C A G Majority
                    2710                2720                2730                2740                2750
2698 G T T G A A G C A G C A G A T G C A A A A G T T G G A A C G A T T C T T G A A G A A G G T G T C A G 2603_ai1.seq
2467 G T T G A A G C A G C A G A T G C A A A A G T T G G A A C G A T T C T T G A A G A A G G T G T C A G 18rs21_ai1.seq
2699 G T T G A A G C A G C A G A T G C A A A A G T T G G A A C G A T T C T T G A A G A A G G T G T C A G coh1_ai1.seq
2699 G T T G A A G C A G C A G A T G C A A A A G T T G G A A C G A T T C T T G A A G A A G G T G T C A G cjb111_ai1.seq
2701 G T T G A A G C A G C A G A T G C A A A A G T T G G A A C G A T T C T T G A A G A A G G T G T C A G nem316_ai1.seq
2700 G T T G A A G C A G C A G A T G C A A A A G T T G G A A C G A T T C T T G A A G A A G G T G T C A G a909_ai1.seq

     T C T A C C T C A A A A A A C T A A T G C T C A A G G T T T G G T C G T C G A T G C T C T G G A T T Majority
                    2760                2770                2780                2790                2800
2748 T C T A C C T C A A A A A A C T A A T G C T C A A G G T T T G G T C G T C G A T G C T C T G G A T T 2603_ai1.seq
2517 T C T A C C T C A A A A A A C T A A T G C T C A A G G T T T G G T C G T C G A T G C T C T G G A T T 18rs21_ai1.seq
2749 T C T A C C T C A A A A A A C T A A T G C T C A A G G T T T G G T C G T C G A T G C T C T G G A T T coh1_ai1.seq
2749 T C T A C C T C A A A A A A C T A A T G C T C A A G G T T T G G T C G T C G A T G C T C T G G A T T cjb111_ai1.seq
2751 T C T A C C T C A A A A A A C T A A T G C T C A A G G T T T G G T C G T C G A T G C T C T G G A T T nem316_ai1.seq
2750 T C T A C C T C A A A A A A C T A A T G C T C A A G G T T T G G T C G T C G A T G C T C T G G A T T a909_ai1.seq
```

FIGURE 18I

Alignment Report of AI-1_alignment, using J. Hein method with Weighted residue weight table.
Thursday, July 29, 2004 5:46 PM

```
     CAAAAAGTAATGTGAGATACTTGTATGTAGAAGATTTAAAGAATTCACCT Majority
               2810      2820      2830      2840      2850
2798 CAAAAAGTAATGTGAGATACTTGTATGTAGAAGATTTAAAGAATTCACCT 2603_ai1.seq
2567 CAAAAAGTAATGTGAGATACTTGTATGTAGAAGATTTAAAGAATTCACCT 18rs21_ai1.seq
2799 CAAAAAGTAATGTGAGATACTTGTATGTAGAAGATTTAAAGAATTCACCT coh1_ai1.seq
2799 CAAAAAGTAATGTGAGATACTTGTATGTAGAAGATTTAAAGAATTCACCT cjb111_ai1.seq
2801 CAAAAAGTAATGTGAGATACTTGTATGTAGAAGATTTAAAGAATTCACCT nem316_ai1.seq
2800 CAAAAAGTAATGTGAGATACTTGTATGTAGAAGATTTAAAGAATTCACCT a909_ai1.seq

     TCAAACATTACCAAAGCTTATGCTGTACCGTTTGTGTTGGAATTACCAGT Majority
               2860      2870      2880      2890      2900
2848 TCAAACATTACCAAAGCTTATGCTGTACCGTTTGTGTTGGAATTACCAGT 2603_ai1.seq
2617 TCAAACATTACCAAAGCTTATGCTGTACCGTTTGTGTTGGAATTACCAGT 18rs21_ai1.seq
2849 TCAAACATTACCAAAGCTTATGCTGTACCGTTTGTGTTGGAATTACCAGT coh1_ai1.seq
2849 TCAAACATTACCAAAGCTTATGCTGTACCGTTTGTGTTGGAATTACCAGT cjb111_ai1.seq
2851 TCAAACATTACCAAAGCTTATGCTGTACCGTTTGTGTTGGAATTACCAGT nem316_ai1.seq
2850 TCAAACATTACCAAAGCTTATGCTGTACCGTTTGTGTTGGAATTACCAGT a909_ai1.seq

     TGCTAACTCTACAGGTACAGGTTTCCTTTCTGAAATTAATATTTACCCTA Majority
               2910      2920      2930      2940      2950
2898 TGCTAACTCTACAGGTACAGGTTTCCTTTCTGAAATTAATATTTACCCTA 2603_ai1.seq
2667 TGCTAACTCTACAGGTACAGGTTTCCTTTCTGAAATTAATATTTACCCTA 18rs21_ai1.seq
2899 TGCTAACTCTACAGGTACAGGTTTCCTTTCTGAAATTAATATTTACCCTA coh1_ai1.seq
2899 TGCTAACTCTACAGGTACAGGTTTCCTTTCTGAAATTAATATTTACCCTA cjb111_ai1.seq
2901 TGCTAACTCTACAGGTACAGGTTTCCTTTCTGAAATTAATATTTACCCTA nem316_ai1.seq
2900 TGCTAACTCTACAGGTACAGGTTTCCTTTCTGAAATTAATATTTACCCTA a909_ai1.seq

     AAAACGTTGTAACTGATGAACCAAAAACAGATAAAGATGTTAAAAAATTA Majority
               2960      2970      2980      2990      3000
2948 AAAACGTTGTAACTGATGAACCAAAAACAGATAAAGATGTTAAAAAATTA 2603_ai1.seq
2717 AAAACGTTGTAACTGATGAACCAAAAACAGATAAAGATGTTAAATAATTA 18rs21_ai1.seq
2949 AAAACGTTGTAACTGATGAACCAAAAACAGATAAAGATGTTAAAAAATTA coh1_ai1.seq
2949 AAAACGTTGTAACTGATGAACCAAAAACAGATAAAGATGTTAAAAAATTA cjb111_ai1.seq
2951 AAAACGTTGTAACTGATGAACCAAAAACAGATAAAGATGTTAAAAAATTA nem316_ai1.seq
2950 AAAACGTTGTAACTGATGAACCAAAAACAGATAAAGATGTTAAAAAATTA a909_ai1.seq

     GGTCAGGACGATGCAGGTTATACGATTGGTGAAGAATTCAAATGGTTCTT Majority
               3010      3020      3030      3040      3050
2998 GGTCAGGACGATGCAGGTTATACGATTGGTGAAGAATTCAAATGGTTCTT 2603_ai1.seq
2767 GGTCAGGACGATGCAGGTTATACGATTGGTGAAGAATTCAAATGGTTCTT 18rs21_ai1.seq
2999 GGTCAGGACGATGCAGGTTATACGATTGGTGAAGAATTCAAATGGTTCTT coh1_ai1.seq
2999 GGTCAGGACGATGCAGGTTATACGATTGGTGAAGAATTCAAATGGTTCTT cjb111_ai1.seq
3001 GGTCAGGACGATGCAGGTTATACGATTGGTGAAGAATTCAAATGGTTCTT nem316_ai1.seq
3000 GGTCAGGACGATGCAGGTTATACGATTGGTGAAGAATTCAAATGGTTCTT a909_ai1.seq

     GAAATCTACAATCCCTGCCAATTTAGGTGACTATGAAAAATTTGAAATTA Majority
               3060      3070      3080      3090      3100
3048 GAAATCTACAATCCCTGCCAATTTAGGTGACTATGAAAAATTTGAAATTA 2603_ai1.seq
2817 GAAATCTACAATCCCTGCCAATTTAGGTGACTATGAAAAATTTGAAATTA 18rs21_ai1.seq
3049 GAAATCTACAATCCCTGCCAATTTAGGTGACTATGAAAAATTTGAAATTA coh1_ai1.seq
3049 GAAATCTACAATCCCTGCCAATTTAGGTGACTATGAAAAATTTGAAATTA cjb111_ai1.seq
3051 GAAATCTACAATCCCTGCCAATTTAGGTGACTATGAAAAATTTGAAATTA nem316_ai1.seq
3050 GAAATCTACAATCCCTGCCAATTTAGGTGACTATGAAAAATTTGAAATTA a909_ai1.seq

     CTGATAAATTTGCAGATGGCTTGACTTATAAATCTGTTGGAAAAATCAAG Majority
               3110      3120      3130      3140      3150
3098 CTGATAAATTTGCAGATGGCTTGACTTATAAATCTGTTGGAAAAATCAAG 2603_ai1.seq
2867 CTGATAAATTTGCAGATGGCTTGACTTATAAATCTGTTGGAAAAATCAAG 18rs21_ai1.seq
3099 CTGATAAATTTGCAGATGGCTTGACTTATAAATCTGTTGGAAAAATCAAG coh1_ai1.seq
3099 CTGATAAATTTGCAGATGGCTTGACTTATAAATCTGTTGGAAAAATCAAG cjb111_ai1.seq
3101 CTGATAAATTTGCAGATGGCTTGACTTATAAATCTGTTGGAAAAATCAAG nem316_ai1.seq
3100 CTGATAAATTTGCAGATGGCTTGACTTATAAATCTGTTGGAAAAATCAAG a909_ai1.seq
```

FIGURE 18J

Alignment Report of AI-1_alignment, using J. Hein method with Weighted residue weight table.
Thursday, July 29, 2004 5:46 PM

| | | |
|---|---|---|
| | A T T G G T T C G A A A A C A C T G A A T A G A G A T G A G C A C T A C A C T A T T G A T G A A C C | Majority |
| | 3160 3170 3180 3190 3200 | |
| 3148 | A T T G G T T C G A A A A C A C T G A A T A G A G A T G A G C A C T A C A C T A T T G A T G A A C C | 2603_ai1.seq |
| 2917 | A T T G G T T C G A A A A C A C T G A A T A G A G A T G A G C A C T A C A C T A T T G A T G A A C C | 18rs21_ai1.seq |
| 3149 | A T T G G T T C G A A A A C A C T G A A T A G A G A T G A G C A C T A C A C T A T T G A T G A A C C | coh1_ai1.seq |
| 3149 | A T T G G T T C G A A A A C A C T G A A T A G A G A T G A G C A C T A C A C T A T T G A T G A A C C | cjb111_ai1.seq |
| 3151 | A T T G G T T C G A A A A C A C T G A A T A G A G A T G A G C A C T A C A C T A T T G A T G A A C C | nem316_ai1.seq |
| 3150 | A T T G G T T C G A A A A C A C T G A A T A G A G A T G A G C A C T A C A C T A T T G A T G A A C C | a909_ai1.seq |

| | | |
|---|---|---|
| | A A C A G T T G A T A A C C A A A A T A C A T T A A A A A T T A C G T T T A A A C C A G A G A A A T | Majority |
| | 3210 3220 3230 3240 3250 | |
| 3198 | A A C A G T T G A T A A C C A A A A T A C A T T A A A A A T T A C G T T T A A A C C A G A G A A A T | 2603_ai1.seq |
| 2967 | A A C A G T T G A T A A C C A A A A T A C A T T A A A A A T T A C G T T T A A A C C A G A G A A A T | 18rs21_ai1.seq |
| 3199 | A A C A G T T G A T A A C C A A A A T A C A T T A A A A A T T A C G T T T A A A C C A G A G A A A T | coh1_ai1.seq |
| 3199 | A A C A G T T G A T A A C C A A A A T A C A T T A A A A A T T A C G T T T A A A C C A G A G A A A T | cjb111_ai1.seq |
| 3201 | A A C A G T T G A T A A C C A A A A T A C A T T A A A A A T T A C G T T T A A A C C A G A G A A A T | nem316_ai1.seq |
| 3200 | A A C A G T T G A T A A C C A A A A T A C A T T A A A A A T T A C G T T T A A A C C A G A G A A A T | a909_ai1.seq |

| | | |
|---|---|---|
| | T T A A A G A A A T T G C T G A G C T A C T T A A A G G A A T G A C C C T T G T T A A A A A T C A A | Majority |
| | 3260 3270 3280 3290 3300 | |
| 3248 | T T A A A G A A A T T G C T G A G C T A C T T A A A G G A A T G A C C C T T G T T A A A A A T C A A | 2603_ai1.seq |
| 3017 | T T A A A G A A A T T G C T G A G C T A C T T A A A G G A A T G A C C C T T G T T A A A A A T C A A | 18rs21_ai1.seq |
| 3249 | T T A A A G A A A T T G C T G A G C T A C T T A A A G G A A T G A C C C T T G T T A A A A A T C A A | coh1_ai1.seq |
| 3249 | T T A A A G A A A T T G C T G A G C T A C T T A A A G G A A T G A C C C T T G T T A A A A A T C A A | cjb111_ai1.seq |
| 3251 | T T A A A G A A A T T G C T G A G C T A C T T A A A G G A A T G A C C C T T G T T A A A A A T C A A | nem316_ai1.seq |
| 3250 | T T A A A G A A A T T G C T G A G C T A C T T A A A G G A A T G A C C C T T G T T A A A A A T C A A | a909_ai1.seq |

| | | |
|---|---|---|
| | G A T G C T C T T G A T A A A G C T A C T G C A A A T A C A G A T G A T G C G G C A T T T T T G G A | Majority |
| | 3310 3320 3330 3340 3350 | |
| 3298 | G A T G C T C T T G A T A A A G C T A C T G C A A A T A C A G A T G A T G C G G C A T T T T T G G A | 2603_ai1.seq |
| 3067 | G A T G C T C T T G A T A A A G C T A C T G C A A A T A C A G A T G A T G C G G C A T T T T T G G A | 18rs21_ai1.seq |
| 3299 | G A T G C T C T T G A T A A A G C T A C T G C A A A T A C A G A T G A T G C G G C A T T T T T G G A | coh1_ai1.seq |
| 3299 | G A T G C T C T T G A T A A A G C T A C T G C A A A T A C A G A T G A T G C G G C A T T T T T G G A | cjb111_ai1.seq |
| 3301 | G A T G C T C T T G A T A A A G C T A C T G C A A A T A C A G A T G A T G C G G C A T T T T T G G A | nem316_ai1.seq |
| 3300 | G A T G C T C T T G A T A A A G C T A C T G C A A A T A C A G A T G A T G C G G C A T T T T T G G A | a909_ai1.seq |

| | | |
|---|---|---|
| | A A T T C C A G T T G C A T C A A C T A T T A A T G A A A A A G C A G T T T T A G G A A A A G C A A | Majority |
| | 3360 3370 3380 3390 3400 | |
| 3348 | A A T T C C A G T T G C A T C A A C T A T T A A T G A A A A A G C A G T T T T A G G A A A A G C A A | 2603_ai1.seq |
| 3117 | A A T T C C A G T T G C A T C A A C T A T T A A T G A A A A A G C A G T T T T A G G A A A A G C A A | 18rs21_ai1.seq |
| 3349 | A A T T C C A G T T G C A T C A A C T A T T A A T G A A A A A G C A G T T T T A G G A A A A G C A A | coh1_ai1.seq |
| 3349 | A A T T C C A G T T G C A T C A A C T A T T A A T G A A A A A G C A G T T T T A G G A A A A G C A A | cjb111_ai1.seq |
| 3351 | A A T T C C A G T T G C A T C A A C T A T T A A T G A A A A A G C A G T T T T A G G A A A A G C A A | nem316_ai1.seq |
| 3350 | A A T T C C A G T T G C A T C A A C T A T T A A T G A A A A A G C A G T T T T A G G A A A A G C A A | a909_ai1.seq |

| | | |
|---|---|---|
| | T T G A A A A T A C T T T T G A A C T T C A A T A T G A C C A T A C T C C T G A T A A A G C T G A C | Majority |
| | 3410 3420 3430 3440 3450 | |
| 3398 | T T G A A A A T A C T T T T G A A C T T C A A T A T G A C C A T A C T C C T G A T A A A G C T G A C | 2603_ai1.seq |
| 3167 | T T G A A A A T A C T T T T G A A C T T C A A T A T G A C C A T A C T C C T G A T A A A G C T G A C | 18rs21_ai1.seq |
| 3399 | T T G A A A A T A C T T T T G A A C T T C A A T A T G A C C A T A C T C C T G A T A A A G C T G A C | coh1_ai1.seq |
| 3399 | T T G A A A A T A C T T T T G A A C T T C A A T A T G A C C A T A C T C C T G A T A A A G C T G A C | cjb111_ai1.seq |
| 3401 | T T G A A A A T A C T T T T G A A C T T C A A T A T G A C C A T A C T C C T G A T A A A G C T G A C | nem316_ai1.seq |
| 3400 | T T G A A A A T A C T T T T G A A C T T C A A T A T G A C C A T A C T C C T G A T A A A G C T G A C | a909_ai1.seq |

| | | |
|---|---|---|
| | A A T C C A A A A C C A T C T A A T C C T C C A A G A A A A C C A G A A G T T C A T A C T G G T G G | Majority |
| | 3460 3470 3480 3490 3500 | |
| 3448 | A A T C C A A A A C C A T C T A A T C C T C C A A G A A A A C C A G A A G T T C A T A C T G G T G G | 2603_ai1.seq |
| 3217 | A A T C C A A A A C C A T C T A A T C C T C C A A G A A A A C C A G A A G T T C A T A C T G G T G G | 18rs21_ai1.seq |
| 3449 | A A T C C A A A A C C A T C T A A T C C T C C A A G A A A A C C A G A A G T T C A T A C T G G T G G | coh1_ai1.seq |
| 3449 | A A T C C A A A A C C A T C T A A T C C T C C A A G A A A A C C A G A A G T T C A T A C T G G T G G | cjb111_ai1.seq |
| 3451 | A A T C C A A A A C C A T C T A A T C C T C C A A G A A A A C C A G A A G T T C A T A C T G G T G G | nem316_ai1.seq |
| 3450 | A A T C C A A A A C C A T C T A A T C C T C C A A G A A A A C C A G A A G T T C A T A C T G G T G G | a909_ai1.seq |

FIGURE 18K

Alignment Report of AI-1_alignment, using J. Hein method with Weighted residue weight table.
Thursday, July 29, 2004 5:46 PM

```
     G A A A C G A T T T G T A A A G A A A G A C T C A A C A G A A A C A C A A A C A C T A G G T G G T G Majority
                        3510                3520                3530                3540                3550
3498 G A A A C G A T T T G T A A A G A A A G A C T C A A C A G A A A C A C A A A C A C T A G G T G G T G 2603_ai1.seq
3267 G A A A C G A T T T G T A A A G A A A G A C T C A A C A G A A A C A C A A A C A C T A G G T G G T G 18rs21_ai1.seq
3499 G A A A C G A T T T G T A A A G A A A G A C T C A A C A G A A A C A C A A A C A C T A G G T G G T G coh1_ai1.seq
3499 G A A A C G A T T T G T A A A G A A A G A C T C A A C A G A A A C A C A A A C A C T A G G T G G T G cjb111_ai1.seq
3501 G A A A C G A T T T G T A A A G A A A G A C T C A A C A G A A A C A C A A A C A C T A G G T G G T G nem316_ai1.seq
3500 G A A A C G A T T T G T A A A G A A A G A C T C A A C A G A A A C A C A A A C A C T A G G T G G T G a909_ai1.seq

     C T G A G T T T G A T T T G T T G G C T T C T G A T G G G A C A G C A G T A A A A T G G A C A G A T Majority
                        3560                3570                3580                3590                3600
3548 C T G A G T T T G A T T T G T T G G C T T C T G A T G G G A C A G C A G T A A A A T G G A C A G A T 2603_ai1.seq
3317 C T G A G T T T G A T T T G T T G G C T T C T G A T G G G A C A G C A G T A A A A T G G A C A G A T 18rs21_ai1.seq
3549 C T G A G T T T G A T T T G T T G G C T T C T G A T G G G A C A G C A G T A A A A T G G A C A G A T coh1_ai1.seq
3549 C T G A G T T T G A T T T G T T G G C T T C T G A T G G G A C A G C A G T A A A A T G G A C A G A T cjb111_ai1.seq
3551 C T G A G T T T G A T T T G T T G G C T T C T G A T G G G A C A G C A G T A A A A T G G A C A G A T nem316_ai1.seq
3550 C T G A G T T T G A T T T G T T G G C T T C T G A T G G G A C A G C A G T A A A A T G G A C A G A T a909_ai1.seq

     G C T C T T A T T A A A G C G A A T A C T A A T A A A A A C T A T A T T G C T G G A G A A G C T G T Majority
                        3610                3620                3630                3640                3650
3598 G C T C T T A T T A A A G C G A A T A C T A A T A A A A A C T A T A T T G C T G G A G A A G C T G T 2603_ai1.seq
3367 G C T C T T A T T A A A G C G A A T A C T A A T A A A A A C T A T A T T G C T G G A G A A G C T G T 18rs21_ai1.seq
3599 G C T C T T A T T A A A G C G A A T A C T A A T A A A A A C T A T A T T G C T G G A G A A G C T G T coh1_ai1.seq
3599 G C T C T T A T T A A A G C G A A T A C T A A T A A A A A C T A T A T T G C T G G A G A A G C T G T cjb111_ai1.seq
3601 G C T C T T A T T A A A G C G A A T A C T A A T A A A A A C T A T A T T G C T G G A G A A G C T G T nem316_ai1.seq
3600 G C T C T T A T T A A A G C G A A T A C T A A T A A A A A C T A T A T T G C T G G A G A A G C T G T a909_ai1.seq

     T A C T G G G C A A C C A A T C A A A T T G A A A T C A C A T A C A G A C G G T A C G T T T G A G A Majority
                        3660                3670                3680                3690                3700
3648 T A C T G G G C A A C C A A T C A A A T T G A A A T C A C A T A C A G A C G G T A C G T T T G A G A 2603_ai1.seq
3417 T A C T G G G C A A C C A A T C A A A T T G A A A T C A C A T A C A G A C G G T A C G T T T G A G A 18rs21_ai1.seq
3649 T A C T G G G C A A C C A A T C A A A T T G A A A T C A C A T A C A G A C G G T A C G T T T G A G A coh1_ai1.seq
3649 T A C T G G G C A A C C A A T C A A A T T G A A A T C A C A T A C A G A C G G T A C G T T T G A G A cjb111_ai1.seq
3651 T A C T G G G C A A C C A A T C A A A T T G A A A T C A C A T A C A G A C G G T A C G T T T G A G A nem316_ai1.seq
3650 T A C T G G G C A A C C A A T C A A A T T G A A A T C A C A T A C A G A C G G T A C G T T T G A G A a909_ai1.seq

     T T A A A G G T T T G G C T T A T G C A G T T G A T G C G A A T G C A G A G G G T A C A G C A G T A Majority
                        3710                3720                3730                3740                3750
3698 T T A A A G G T T T G G C T T A T G C A G T T G A T G C G A A T G C A G A G G G T A C A G C A G T A 2603_ai1.seq
3467 T T A A A G G T T T G G C T T A T G C A G T T G A T G C G A A T G C A G A G G G T A C A G C A G T A 18rs21_ai1.seq
3699 T T A A A G G T T T G G C T T A T G C A G T T G A T G C G A A T G C A G A G G G T A C A G C A G T A coh1_ai1.seq
3699 T T A A A G G T T T G G C T T A T G C A G T T G A T G C G A A T G C A G A G G G T A C A G C A G T A cjb111_ai1.seq
3701 T T A A A G G T T T G G C T T A T G C A G T T G A T G C G A A T G C A G A G G G T A C A G C A G T A nem316_ai1.seq
3700 T T A A A G G T T T G G C T T A T G C A G T T G A T G C G A A T G C A G A G G G T A C A G C A G T A a909_ai1.seq

     A C T T A C A A A T T A A A A G A A A C A A A A G C A C C A G A A G G T T A T G T A A T C C C T G A Majority
                        3760                3770                3780                3790                3800
3748 A C T T A C A A A T T A A A A G A A A C A A A A G C A C C A G A A G G T T A T G T A A T C C C T G A 2603_ai1.seq
3517 A C T T A C A A A T T A A A A G A A A C A A A A G C A C C A G A A G G T T A T G T A A T C C C T G A 18rs21_ai1.seq
3749 A C T T A C A A A T T A A A A G A A A C A A A A G C A C C A G A A G G T T A T G T A A T C C C T G A coh1_ai1.seq
3749 A C T T A C A A A T T A A A A G A A A C A A A A G C A C C A G A A G G T T A T G T A A T C C C T G A cjb111_ai1.seq
3751 A C T T A C A A A T T A A A A G A A A C A A A A G C A C C A G A A G G T T A T G T A A T C C C T G A nem316_ai1.seq
3750 A C T T A C A A A T T A A A A G A A A C A A A A G C A C C A G A A G G T T A T G T A A T C C C T G A a909_ai1.seq

     T A A A G A A A T C G A G T T T A C A G T A T C A C A A A C A T C T T A T A A T A C A A A A C C A A Majority
                        3810                3820                3830                3840                3850
3798 T A A A G A A A T C G A G T T T A C A G T A T C A C A A A C A T C T T A T A A T A C A A A A C C A A 2603_ai1.seq
3567 T A A A G A A A T C G A G T T T A C A G T A T C A C A A A C A T C T T A T A A T A C A A A A C C A A 18rs21_ai1.seq
3799 T A A A G A A A T C G A G T T T A C A G T A T C A C A A A C A T C T T A T A A T A C A A A A C C A A coh1_ai1.seq
3799 T A A A G A A A T C G A G T T T A C A G T A T C A C A A A C A T C T T A T A A T A C A A A A C C A A cjb111_ai1.seq
3801 T A A A G A A A T C G A G T T T A C A G T A T C A C A A A C A T C T T A T A A T A C A A A A C C A A nem316_ai1.seq
3800 T A A A G A A A T C G A G T T T A C A G T A T C A C A A A C A T C T T A T A A T A C A A A A C C A A a909_ai1.seq
```

FIGURE 18L

Alignment Report of AI-1_alignment, using J. Hein method with Weighted residue weight table.
Thursday, July 29, 2004 5:46 PM

```
     CTGACATCACGGTTGATAGTGCTGATGCAACACCTGATACAATTAAAAAC Majority
               3860      3870      3880      3890      3900
3848 CTGACATCACGGTTGATAGTGCTGATGCAACACCTGATACAATTAAAAAC 2603_ai1.seq
3617 CTGACATCACGGTTGATAGTGCTGATGCAACACCTGATACAATTAAAAAC 18rs21_ai1.seq
3849 CTGACATCACGGTTGATAGTGCTGATGCAACACCTGATACAATTAAAAAC coh1_ai1.seq
3849 CTGACATCACGGTTGATAGTGCTGATGCAACACCTGATACAATTAAAAAC cjb111_ai1.seq
3851 CTGACATCACGGTTGATAGTGCTGATGCAACACCTGATACAATTAAAAAC nem316_ai1.seq
3850 CTGACATCACGGTTGATAGTGCTGATGCAACACCTGATACAATTAAAAAC a909_ai1.seq

     AACAAACGTCCTTCAATCCCTAATACTGGTGGTATTGGTACGGCTATCTT Majority
               3910      3920      3930      3940      3950
3898 AACAAACGTCCTTCAATCCCTAATACTGGTGGTATTGGTACGGCTATCTT 2603_ai1.seq
3667 AACAAACGTCCTTCAATCCCTAATACTGGTGGTATTGGTACGGCTATCTT 18rs21_ai1.seq
3899 AACAAACGTCCTTCAATCCCTAATACTGGTGGTATTGGTACGGCTATCTT coh1_ai1.seq
3899 AACAAACGTCCTTCAATCCCTAATACTGGTGGTATTGGTACGGCTATCTT cjb111_ai1.seq
3901 AACAAACGTCCTTCAATCCCTAATACTGGTGGTATTGGTACGGCTATCTT nem316_ai1.seq
3900 AACAAACGTCCTTCAATCCCTAATACTGGTGGTATTGGTACGGCTATCTT a909_ai1.seq

     TGTCGCTATCGGTGCTGCGGTGATGGCTTTTGCTGTTAAGGGGATGAAGC Majority
               3960      3970      3980      3990      4000
3948 TGTCGCTATCGGTGCTGCGGTGATGGCTTTTGCTGTTAAGGGGATGAAGC 2603_ai1.seq
3717 TGTCGCTATCGGTGCTGCGGTGATGGCTTTTGCTGTTAAGGGGATGAAGC 18rs21_ai1.seq
3949 TGTCGCTATCGGTGCTGCGGTGATGGCTTTTGCTGTTAAGGGGATGAAGC coh1_ai1.seq
3949 TGTCGCTATCGGTGCTGCGGTGATGGCTTTTGCTGTTAAGGGGATGAAGC cjb111_ai1.seq
3951 TGTCGCTATCGGTGCTGCGGTGATGGCTTTTGCTGTTAAGGGGATGAAGC nem316_ai1.seq
3950 TGTCGCTATCGGTGCTGCGGTGATGGCTTTTGCTGTTAAGGGGATGAAGC a909_ai1.seq

     GTCGTACAAAAGATAACTAAATAAAAGGCTACTTCTTAAGTAACCATGTT Majority
               4010      4020      4030      4040      4050
3998 GTCGTACAAAAGATAACTAAATAAAAGGCTACTTCTTAAGTAACCATGTT 2603_ai1.seq
3767 GTCGTACAAAAGATAACTAAATAAAAGGCTACTTCTTAAGTAACCATGTT 18rs21_ai1.seq
3999 GTCGTACAAAAGATAACTAAATAAAAGGCTACTTCTTAAGTAACCATGTT coh1_ai1.seq
3999 GTCGTACAAAAGATAACTAAATAAAAGGCTACTTCTTAAGTAACCATGTT cjb111_ai1.seq
4001 GTCGTACAAAAGATAACTAAATAAAAGGCTACTTCTTAAGTAACCATGTT nem316_ai1.seq
4000 GTCGTACAAAAGATAACTAAATAAAAGGCTACTTCTTAAGTAACCATGTT a909_ai1.seq

     TAAGAAAAGAGAAATAGCCTTATTTCTCTTTTTGTCGTTTTTAAAATAAA Majority
               4060      4070      4080      4090      4100
4048 TAAGAAAAGAGAAATAGCCTTATTTCTCTTTTTGTCGTTTTTAAAATAAA 2603_ai1.seq
3817 TAAGAAAAGAGAAATAGCCTTATTTCTCTTTTTGTCGTTTTTAAAATAAA 18rs21_ai1.seq
4049 TAAGAAAAGAGAAATAGCCTTATTTCTCTTTTTGTCGTTTTTAAAATAAA coh1_ai1.seq
4049 TAAGAAAAGAGAAATAGCCTTATTTCTCTTTTTGTCGTTTTTAAAATAAA cjb111_ai1.seq
4051 TAAGAAAAGAGAAATAGCCTTATTTCTCTTTTTGTCGTTTTTAAAATAAA nem316_ai1.seq
4050 TAAGAAAAGAGAAATAGCCTTATTTCTCTTTTTGTCGTTTTTAAAATAAA a909_ai1.seq

     GGAACATCATGAAACAAACATTAAAACTTATGTTTTCTTTTCTGTTGATG Majority
               4110      4120      4130      4140      4150
4098 GGAACATCATGAAACAAACATTAAAACTTATGTTTTCTTTTCTGTTGATG 2603_ai1.seq
3867 GGAACATCATGAAACAAACATTAAAACTTATGTTTTCTTTTCTGTTGATG 18rs21_ai1.seq
4099 GGAACATCATGAAACAAACATTAAAACTTATGTTTTCTTTTCTGTTGATG coh1_ai1.seq
4099 GGAACATCATGAAACAAACATTAAAACTTATGTTTTCTTTTCTGTTGATG cjb111_ai1.seq
4101 GGAACATCATGAAACAAACATTAAAACTTATGTTTTCTTTTCTGTTGATG nem316_ai1.seq
4100 GGAACATCATGAAACAAACATTAAAACTTATGTTTTCTTTTCTGTTGATG a909_ai1.seq

     TTAGGGACTATGTTTGGAATTAGCCAAACTGTTTTAGCGCAAGAAACTCA Majority
               4160      4170      4180      4190      4200
4148 TTAGGGACTATGTTTGGAATTAGCCAAACTGTTTTAGCGCAAGAAACTCA 2603_ai1.seq
3917 TTAGGGACTATGTTTGGAATTAGCCAAACTGTTTTAGCGCAAGAAACTCA 18rs21_ai1.seq
4149 TTAGGGACTATGTTTGGAATTAGCCAAACTGTTTTAGCGCAAGAAACTCA coh1_ai1.seq
4149 TTAGGGACTATGTTTGGAATTAGCCAAACTGTTTTAGCGCAAGAAACTCA cjb111_ai1.seq
4151 TTAGGGACTATGTTTGGAATTAGCCAAACTGTTTTAGCGCAAGAAACTCA nem316_ai1.seq
4150 TTAGGGACTATGTTTGGAATTAGCCAAACTGTTTTAGCGCAAGAAACTCA a909_ai1.seq
```

FIGURE 18M

Alignment Report of AI-1_alignment, using J. Hein method with Weighted residue weight table.
Thursday, July 29, 2004 5:46 PM

```
     TCAGTTGACGATTGTTCATCTTGAAGCAAGGGATATTGATCGTCCAAATC Majority
              4210      4220      4230      4240      4250
4198 TCAGTTGACGATTGTTCATCTTGAAGCAAGGGATATTGATCGTCCAAATC 2603_ai1.seq
3967 TCAGTTGACGATTGTTCATCTTGAAGCAAGGGATATTGATCGTCCAAATC 18rs21_ai1.seq
4199 TCAGTTGACGATTGTTCATCTTGAAGCAAGGGATATTGATCGTCCAAATC coh1_ai1.seq
4199 TCAGTTGACGATTGTTCATCTTGAAGCAAGGGATATTGATCGTCCAAATC cjb111_ai1.seq
4201 TCAGTTGACGATTGTTCATCTTGAAGCAAGGGATATTGATCGTCCAAATC nem316_ai1.seq
4200 TCAGTTGACGATTGTTCATCTTGAAGCAAGGGATATTGATCGTCCAAATC a909_ai1.seq

     CACAGTTGGAGATTGCCCCTAAAGAAGGGACTCCAATTGAAGGAGTACTC Majority
              4260      4270      4280      4290      4300
4248 CACAGTTGGAGATTGCCCCTAAAGAAGGGACTCCAATTGAAGGAGTACTC 2603_ai1.seq
4017 CACAGTTGGAGATTGCCCCTAAAGAAGGGACTCCAATTGAAGGAGTACTC 18rs21_ai1.seq
4249 CACAGTTGGAGATTGCCCCTAAAGAAGGGACTCCAATTGAAGGAGTACTC coh1_ai1.seq
4249 CACAGTTGGAGATTGCCCCTAAAGAAGGGACTCCAATTGAAGGAGTACTC cjb111_ai1.seq
4251 CACAGTTGGAGATTGCCCCTAAAGAAGGGACTCCAATTGAAGGAGTACTC nem316_ai1.seq
4250 CACAGTTGGAGATTGCCCCTAAAGAAGGGACTCCAATTGAAGGAGTACTC a909_ai1.seq

     TATCAGTTGTACCAATTAAAATCAACTGAAGATGGCGATTTGTTGGCACA Majority
              4310      4320      4330      4340      4350
4298 TATCAGTTGTACCAATTAAAATCAACTGAAGATGGCGATTTGTTGGCACA 2603_ai1.seq
4067 TATCAGTTGTACCAATTAAAATCAACTGAAGATGGCGATTTGTTGGCACA 18rs21_ai1.seq
4299 TATCAGTTGTACCAATTAAAATCAACTGAAGATGGCGATTTGTTGGCACA coh1_ai1.seq
4299 TATCAGTTGTACCAATTAAAATCAACTGAAGATGGCGATTTGTTGGCACA cjb111_ai1.seq
4301 TATCAGTTGTACCAATTAAAATCAACTGAAGATGGCGATTTGTTGGCACA nem316_ai1.seq
4300 TATCAGTTGTACCAATTAAAATCAACTGAAGATGGCGATTTGTTGGCACA a909_ai1.seq

     TTGGAATTCCCTAACTATCACAGAATTGAAAAAACAGGCGCAGCAGGTTT Majority
              4360      4370      4380      4390      4400
4348 TTGGAATTCCCTAACTATCACAGAATTGAAAAAACAGGCGCAGCAGGTTT 2603_ai1.seq
4117 TTGGAATTCCCTAACTATCACAGAATTGAAAAAACAGGCGCAGCAGGTTT 18rs21_ai1.seq
4349 TTGGAATTCCCTAACTATCACAGAATTGAAAAAACAGGCGCAGCAGGTTT coh1_ai1.seq
4349 TTGGAATTCCCTAACTATCACAGAATTGAAAAAACAGGCGCAGCAGGTTT cjb111_ai1.seq
4351 TTGGAATTCCCTAACTATCACAGAATTGAAAAAACAGGCGCAGCAGGTTT nem316_ai1.seq
4350 TTGGAATTCCCTAACTATCACAGAATTGAAAAAACAGGCGCAGCAGGTTT a909_ai1.seq

     TTGAAGCCACTACTAATCAACAAGGAAAGGCTACATTTAACCAACTACCA Majority
              4410      4420      4430      4440      4450
4398 TTGAAGCCACTACTAATCAACAAGGAAAGGCTACATTTAACCAACTACCA 2603_ai1.seq
4167 TTGAAGCCACTACTAATCAACAAGGAAAGGCTACATTTAACCAACTACCA 18rs21_ai1.seq
4399 TTGAAGCCACTACTAATCAACAAGGAAAGGCTACATTTAACCAACTACCA coh1_ai1.seq
4399 TTGAAGCCACTACTAATCAACAAGGAAAGGCTACATTTAACCAACTACCA cjb111_ai1.seq
4401 TTGAAGCCACTACTAATCAACAAGGAAAGGCTACATTTAACCAACTACCA nem316_ai1.seq
4400 TTGAAGCCACTACTAATCAACAAGGAAAGGCTACATTTAACCAACTACCA a909_ai1.seq

     GATGGAATTTATTATGGTCTGGCGGTTAAAGCCGGTGAAAAAAATCGTAA Majority
              4460      4470      4480      4490      4500
4448 GATGGAATTTATTATGGTCTGGCGGTTAAAGCCGGTGAAAAAAATCGTAA 2603_ai1.seq
4217 GATGGAATTTATTATGGTCTGGCGGTTAAAGCCGGTGAAAAAAATCGTAA 18rs21_ai1.seq
4449 GATGGAATTTATTATGGTCTGGCGGTTAAAGCCGGTGAAAAAAATCGTAA coh1_ai1.seq
4449 GATGGAATTTATTATGGTCTGGCGGTTAAAGCCGGTGAAAAAAATCGTAA cjb111_ai1.seq
4451 GATGGAATTTATTATGGTCTGGCGGTTAAAGCCGGTGAAAAAAATCGTAA nem316_ai1.seq
4450 GATGGAATTTATTATGGTCTGGCGGTTAAAGCCGGTGAAAAAAATCGTAA a909_ai1.seq

     TGTCTCAGCTTTCTTGGTTGACTTGTCTGAGGATAAAGTGATTTATCCTA Majority
              4510      4520      4530      4540      4550
4498 TGTCTCAGCTTTCTTGGTTGACTTGTCTGAGGATAAAGTGATTTATCCTA 2603_ai1.seq
4267 TGTCTCAGCTTTCTTGGTTGACTTGTCTGAGGATAAAGTGATTTATCCTA 18rs21_ai1.seq
4499 TGTCTCAGCTTTCTTGGTTGACTTGTCTGAGGATAAAGTGATTTATCCTA coh1_ai1.seq
4499 TGTCTCAGCTTTCTTGGTTGACTTGTCTGAGGATAAAGTGATTTATCCTA cjb111_ai1.seq
4501 TGTCTCAGCTTTCTTGGTTGACTTGTCTGAGGATAAAGTGATTTATCCTA nem316_ai1.seq
4500 TGTCTCAGCTTTCTTGGTTGACTTGTCTGAGGATAAAGTGATTTATCCTA a909_ai1.seq
```

FIGURE 18N

Alignment Report of AI-1_alignment, using J. Hein method with Weighted residue weight table.
Thursday, July 29, 2004 5:46 PM

```
     AAATCATCTGGTCCACAGGTGAGTTGGACTTGCTTAAAGTTGGTGTGGAT Majority
               4560      4570      4580      4590      4600
4548 AAATCATCTGGTCCACAGGTGAGTTGGACTTGCTTAAAGTTGGTGTGGAT 2603_ai1.seq
4317 AAATCATCTGGTCCACAGGTGAGTTGGACTTGCTTAAAGTTGGTGTGGAT 18rs21_ai1.seq
4549 AAATCATCTGGTCCACAGGTGAGTTGGACTTGCTTAAAGTTGGTGTGGAT coh1_ai1.seq
4549 AAATCATCTGGTCCACAGGTGAGTTGGACTTGCTTAAAGTTGGTGTGGAT cjb111_ai1.seq
4551 AAATCATCTGGTCCACAGGTGAGTTGGACTTGCTTAAAGTTGGTGTGGAT nem316_ai1.seq
4550 AAATCATCTGGTCCACAGGTGAGTTGGACTTGCTTAAAGTTGGTGTGGAT a909_ai1.seq

     GGTGATACCAAAAAACCACTAGCAGGCGTTGTCTTTGAACTTTATGAAAA Majority
               4610      4620      4630      4640      4650
4598 GGTGATACCAAAAAACCACTAGCAGGCGTTGTCTTTGAACTTTATGAAAA 2603_ai1.seq
4367 GGTGATACCAAAAAACCACTAGCAGGCGTTGTCTTTGAACTTTATGAAAA 18rs21_ai1.seq
4599 GGTGATACCAAAAAACCACTAGCAGGCGTTGTCTTTGAACTTTATGAAAA coh1_ai1.seq
4599 GGTGATACCAAAAAACCACTAGCAGGCGTTGTCTTTGAACTTTATGAAAA cjb111_ai1.seq
4601 GGTGATACCAAAAAACCACTAGCAGGCGTTGTCTTTGAACTTTATGAAAA nem316_ai1.seq
4600 GGTGATACCAAAAAAACACTAGCAGGCGTTGTCTTTGAACTTTATGAAAA a909_ai1.seq

     GAATGGTAGGACTCCTATTCGTGTGAAAAATGGGGTGCATTCTCAAGATA Majority
               4660      4670      4680      4690      4700
4648 GAATGGTAGGACTCCTATTCGTGTGAAAAATGGGGTGCATTCTCAAGATA 2603_ai1.seq
4417 GAATGGTAGGACTCCTATTCGTGTGAAAAATGGGGTGCATTCTCAAGATA 18rs21_ai1.seq
4649 GAATGGTAGGACTCCTATTCGTGTGAAAAATGGGGTGCATTCTCAAGATA coh1_ai1.seq
4649 GAATGGTAGGACTCCTATTCGTGTGAAAAATGGGGTGCATTCTCAAGATA cjb111_ai1.seq
4651 GAATGGTAGGACTCCTATTCGTGTGAAAAATGGGGTGCATTCTCAAGATA nem316_ai1.seq
4650 GAATGGTAGGACTCCTATTCGTGTGAAAAATGGGGTGCATTCTCAAGATA a909_ai1.seq

     TTGACGCTGCAAAACATTTAGAAACAGATTCATCAGGGCATATCAGAATT Majority
               4710      4720      4730      4740      4750
4698 TTGACGCTGCAAAACATTTAGAAACAGATTCATCAGGGCATATCAGAATT 2603_ai1.seq
4467 TTGACGCTGCAAAACATTTAGAAACAGATTCATCAGGGCATATCAGAATT 18rs21_ai1.seq
4699 TTGACGCTGCAAAACATTTAGAAACAGATTCATCAGGGCATATCAGAATT coh1_ai1.seq
4699 TTGACGCTGCAAAACATTTAGAAACAGATTCATCAGGGCATATCAGAATT cjb111_ai1.seq
4701 TTGACGCTGCAAAACATTTAGAAACAGATTCATCAGGGCATATCAGAATT nem316_ai1.seq
4700 TTGACGCTGCAAAACATTTAGAAACAGATTCATCAGGGCATATCAGAATT a909_ai1.seq

     TCCGGGCTCATCCATGGGGACTATGTCTTAAAAGAAATCGAGACACAGTC Majority
               4760      4770      4780      4790      4800
4748 TCCGGGCTCATCCATGGGGACTATGTCTTAAAAGAAATCGAGACACAGTC 2603_ai1.seq
4517 TCCGGGCTCATCCATGGGGACTATGTCTTAAAAGAAATCGAGACACAGTC 18rs21_ai1.seq
4749 TCCGGGCTCATCCATGGGGACTATGTCTTAAAAGAAATCGAGACACAGTC coh1_ai1.seq
4749 TCCGGGCTCATCCATGGGGACTATGTCTTAAAAGAAATCGAGACACAGTC cjb111_ai1.seq
4751 TCCGGGCTCATCCATGGGGACTATGTCTTAAAAGAAATCGAGACACAGTC nem316_ai1.seq
4750 TCCGGGCTCATCCATGGGGACTATGTCTTAAAAGAAATCGAGACACAGTC a909_ai1.seq

     AGGATATCAGATCGGACAGGCAGAGACTGCTGTGACTATTGAAAAATCAA Majority
               4810      4820      4830      4840      4850
4798 AGGATATCAGATCGGACAGGCAGAGACTGCTGTGACTATTGAAAAATCAA 2603_ai1.seq
4567 AGGATATCAGATCGGACAGGCAGAGACTGCTGTGACTATTGAAAAATCAA 18rs21_ai1.seq
4799 AGGATATCAGATCGGACAGGCAGAGACTGCTGTGACTATTGAAAAATCAA coh1_ai1.seq
4799 AGGATATCAGATCGGACAGGCAGAGACTGCTGTGACTATTGAAAAATCAA cjb111_ai1.seq
4801 AGGATATCAGATCGGACAGGCAGAGACTGCTGTGACTATTGAAAAATCAA nem316_ai1.seq
4800 AGGATATCAGATCGGACAGGCAGAGACTGCTGTGACTATTGAAAAATCAA a909_ai1.seq

     AAACAGTAACAGTAACGATTGAAAATAAAAAAGTTCCGACACCTAAAGTG Majority
               4860      4870      4880      4890      4900
4848 AAACAGTAACAGTAACGATTGAAAATAAAAAAGTTCCGACACCTAAAGTG 2603_ai1.seq
4617 AAACAGTAACAGTAACGATTGAAAATAAAAAAGTTCCGACACCTAAAGTG 18rs21_ai1.seq
4849 AAACAGTAACAGTAACGATTGAAAATAAAAAAGTTCCGACACCTAAAGTG coh1_ai1.seq
4849 AAACAGTAACAGTAACGATTGAAAATAAAAAAGTTCCGACACCTAAAGTG cjb111_ai1.seq
4851 AAACAGTAACAGTAACGATTGAAAATAAAAAAGTTCCGACACCTAAAGTG nem316_ai1.seq
4850 AAACAGTAACAGTAACGATTGAAAATAAAAAAGTTCCGACACCTAAAGTG a909_ai1.seq
```

FIGURE 180

Alignment Report of AI-1_alignment, using J. Hein method with Weighted residue weight table.
Thursday, July 29, 2004 5:46 PM

```
     C C A T C T C G A G G A G G T C T T A T T C C C A A A A C A G G T G A G C A A C A G G C A A T G G C Majority
                         4910                4920                4930                4940                4950
4898 C C A T C T C G A G G A G G T C T T A T T C C C A A A A C A G G T G A G C A A C A G G C A A T G G C 2603_ai1.seq
4667 C C A T C T C G A G G A G G T C T T A T T C C C A A A A C A G G T G A G C A A C A G G C A A T G G C 18rs21_ai1.seq
4899 C C A T C T C G A G G A G G T C T T A T T C C C A A A A C A G G T G A G C A A C A G G C A A T G G C coh1_ai1.seq
4899 C C A T C T C G A G G A G G T C T T A T T C C C A A A A C A G G T G A G C A A C A G G C A A T G G C cjb111_ai1.seq
4901 C C A T C T C G A G G A G G T C T T A T T C C C A A A A C A G G T G A G C A A C A G G C A A T G G C nem316_ai1.seq
4900 C C A T C T C G A G G A G G T C T T A T T C C C A A A A C A G G T G A G C A A C A G G C A A T G G C a909_ai1.seq

     A C T T G T A A T T A T T G G T G G T A T T T T A A T T G C T T T A G C C T T A C G A T T A C T A T Majority
                         4960                4970                4980                4990                5000
4948 A C T T G T A A T T A T T G G T G G T A T T T T A A T T G C T T T A G C C T T A C G A T T A C T A T 2603_ai1.seq
4717 A C T T G T A A T T A T T G G T G G T A T T T T A A T T G C T T T A G C C T T A C G A T T A C T A T 18rs21_ai1.seq
4949 A C T T G T A A T T A T T G G T G G T A T T T T A A T T G C T T T A G C C T T A C G A T T A C T A T coh1_ai1.seq
4949 A C T T G T A A T T A T T G G T G G T A T T T T A A T T G C T T T A G C C T T A C G A T T A C T A T cjb111_ai1.seq
4951 A C T T G T A A T T A T T G G T G G T A T T T T A A T T G C T T T A G C C T T A C G A T T A C T A T nem316_ai1.seq
4950 A C T T G T A A T T A T T G G T G G T A T T T T A A T T G C T T T A G C C T T A C G A T T A C T A T a909_ai1.seq

     C A A A A C A T C G G A A A C A T C A A A A T A A G G A T T A G C A T G G G A C A A A A A T C A A A Majority
                         5010                5020                5030                5040                5050
4998 C A A A A C A T C G G A A A C A T C A A A A T A A G G A T T A G C A T G G G A C A A A A A T C A A A 2603_ai1.seq
4767 C A A A A C A T C G G A A A C A T C A A A A T A A G G A T T A G C A T G G G A C A A A A A T C A A A 18rs21_ai1.seq
4999 C A A A A C A T C G G A A A C A T C A A A A T A A G G A T T A G C A T G G G A C A A A A A T C A A A coh1_ai1.seq
4999 C A A A A C A T C G G A A A C A T C A A A A T A A G G A T T A G C A T G G G A C A A A A A T C A A A cjb111_ai1.seq
5001 C A A A A C A T C G G A A A C A T C A A A A T A A G G A T T A G C A T G G G A C A A A A A T C A A A nem316_ai1.seq
5000 C A A A A C A T C G G A A A C A T C A A A A T A A G G A T T A G C A T G G G A C A A A A A T C A A A a909_ai1.seq

     A A T A T C T C T A G C T A C G A A T A T T C G T A T A T G G A T T T T T C G T T T A A T T T T C T Majority
                         5060                5070                5080                5090                5100
5048 A A T A T C T C T A G C T A C G A A T A T T C G T A T A T G G A T T T T T C G T T T A A T T T T C T 2603_ai1.seq
4817 A A T A T C T C T A G C T A C G A A T A T T C G T A T A T G G A T T T T T C G T T T A A T T T T C T 18rs21_ai1.seq
5049 A A T A T C T C T A G C T A C G A A T A T T C G T A T A T G G A T T T T T C G T T T A A T T T T C T coh1_ai1.seq
5049 A A T A T C T C T A G C T A C G A A T A T T C G T A T A T G G A T T T T T C G T T T A A T T T T C T cjb111_ai1.seq
5051 A A T A T C T C T A G C T A C G A A T A T T C G T A T A T G G A T T T T T C G T T T A A T T T T C T nem316_ai1.seq
5050 A A T A T C T C T A G C T A C G A A T A T T C G T A T A T G G A T T T T T C G T T T A A T T T T C T a909_ai1.seq

     T A G C G G G T T T C C T T G T T T T G G C A T T T C C C A T C G T T A G T C A G G T C A T G T A C Majority
                         5110                5120                5130                5140                5150
5098 T A G C G G G T T T C C T T G T T T T G G C A T T T C C C A T C G T T A G T C A G G T C A T G T A C 2603_ai1.seq
4867 T A G C G G G T T T C C T T G T T T T G G C A T T T C C C A T C G T T A G T C A G G T C A T G T A C 18rs21_ai1.seq
5099 T A G C G G G T T T C C T T G T T T T G G C A T T T C C C A T C G T T A G T C A G G T C A T G T A C coh1_ai1.seq
5099 T A G C G G G T T T C C T T G T T T T G G C A T T T C C C A T C G T T A G T C A G G T C A T G T A C cjb111_ai1.seq
5101 T A G C G G G T T T C C T T G T T T T G G C A T T T C C C A T C G T T A G T C A G G T C A T G T A C nem316_ai1.seq
5100 T A G C G G G T T T C C T T G T T T T G G C A T T T C C C A T C G T T A G T C A G G T C A T G T A C a909_ai1.seq

     T T T C A A G C C T C T C A C G C C A A T A T T A A T G C T T T T A A A G A A G C T G T T A C C A A Majority
                         5160                5170                5180                5190                5200
5148 T T T C A A G C C T C T C A C G C C A A T A T T A A T G C T T T T A A A G A A G C T G T T A C C A A 2603_ai1.seq
4917 T T T C A A G C C T C T C A C G C C A A T A T T A A T G C T T T T A A A G A A G C T G T T A C C A A 18rs21_ai1.seq
5149 T T T C A A G C C T C T C A C G C C A A T A T T A A T G C T T T T A A A G A A G C T G T T A C C A A coh1_ai1.seq
5149 T T T C A A G C C T C T C A C G C C A A T A T T A A T G C T T T T A A A G A A G C T G T T A C C A A cjb111_ai1.seq
5151 T T T C A A G C C T C T C A C G C C A A T A T T A A T G C T T T T A A A G A A G C T G T T A C C A A nem316_ai1.seq
5150 T T T C A A G C C T C T C A C G C C A A T A T T A A T G C T T T T A A A G A A G C T G T T A C C A A a909_ai1.seq

     G A T T G A C C G G G T G G A G A T T A A T C G G C G T T T A G A A C T T G C T T A T G C T T A T A Majority
                         5210                5220                5230                5240                5250
5198 G A T T G A C C G G G T G G A G A T T A A T C G G C G T T T A G A A C T T G C T T A T G C T T A T A 2603_ai1.seq
4967 G A T T G A C C G G G T G G A G A T T A A T C G G C G T T T A G A A C T T G C T T A T G C T T A T A 18rs21_ai1.seq
5199 G A T T G A C C G G G T G G A G A T T A A T C G G C G T T T A G A A C T T G C T T A T G C T T A T A coh1_ai1.seq
5199 G A T T G A C C G G G T G G A G A T T A A T C G G C G T T T A G A A C T T G C T T A T G C T T A T A cjb111_ai1.seq
5201 G A T T G A C C G G G T G G A G A T T A A T C G G C G T T T A G A A C T T G C T T A T G C T T A T A nem316_ai1.seq
5200 G A T T G A C C G G G T G G A G A T T A A T C G G C G T T T A G A A C T T G C T T A T G C T T A T A a909_ai1.seq
```

FIGURE 18P

Alignment Report of AI-1_alignment, using J. Hein method with Weighted residue weight table.
Thursday, July 29, 2004 5:46 PM

```
     ACGCCAGTATAGCAGGTGCCAAAACTAATGGCGAATATCCAGCGCTTAAA Majority
               5260      5270      5280      5290      5300
5248 ACGCCAGTATAGCAGGTGCCAAAACTAATGGCGAATATCCAGCGCTTAAA 2603_ai1.seq
5017 ACGCCAGTATAGCAGGTGCCAAAACTAATGGCGAATATCCAGCGCTTAAA 18rs21_ai1.seq
5249 ACGCCAGTATAGCAGGTGCCAAAACTAATGGCGAATATCCAGCGCTTAAA coh1_ai1.seq
5249 ACGCCAGTATAGCAGGTGCCAAAACTAATGGCGAATATCCAGCGCTTAAA cjb111_ai1.seq
5251 ACGCCAGTATAGCAGGTGCCAAAACTAATGGCGAATATTCAGCGCTTAAA nem316_ai1.seq
5250 ACGCCAGTATAGCAGGTGCCAAAACTAATGGCGAATATCCAGCGCTTAAA a909_ai1.seq

     GACCCCTACTCTGCTGAACAAAAGCAGGCAGGGGTCGTTGAGTACGCCCG Majority
               5310      5320      5330      5340      5350
5298 GACCCCTACTCTGCTGAACAAAAGCAGGCAGGGGTCGTTGAGTACGCCCG 2603_ai1.seq
5067 GACCCCTACTCTGCTGAACAAAAGCAGGCAGGGGTCGTTGAGTACGCCCG 18rs21_ai1.seq
5299 GACCCCTACTCTGCTGAACAAAAGCAGGCAGGGGTCGTTGAGTACGCCCG coh1_ai1.seq
5299 GACCCCTACTCTGCTGAACAAAAGCAGGCAGGGGTCGTTGAGTACGCCCG cjb111_ai1.seq
5301 GACCCCTACTCTGCTGAACAAAAGCAGGCAGGGGTCGTTGAGTACGCCCG nem316_ai1.seq
5300 GACCCCTACTCTGCTGAACAAAAGCAGGCAGGGGTCGTTGAGTACGCCCG a909_ai1.seq

     CATGCTTGAAGTCAAAGAACAAATAGGTCATGTGATTATTCCAAGAATTA Majority
               5360      5370      5380      5390      5400
5348 CATGCTTGAAGTCAAAGAACAAATAGGTCATGTGATTATTCCAAGAATTA 2603_ai1.seq
5117 CATGCTTGAAGTCAAAGAACAAATAGGTCATGTGATTATTCCAAGAATTA 18rs21_ai1.seq
5349 CATGCTTGAAGTCAAAGAACAAATAGGTCATGTGATTATTCCAAGAATTA coh1_ai1.seq
5349 CATGCTTGAAGTCAAAGAACAAATAGGTCATGTGATTATTCCAAGAATTA cjb111_ai1.seq
5351 CATGCTTGAAGTCAAAGAACAAATAGGTCATGTGATTATTCCAAGAATTA nem316_ai1.seq
5350 CATGCTTGAAGTCAAAGAACAAATAGGTCATGTGATTATTCCAAGAATTA a909_ai1.seq

     ATCAGGATATCCCTATTTACGCTGGCTCTGCTGAAGAAAATCTTCAGAGG Majority
               5410      5420      5430      5440      5450
5398 ATCAGGATATCCCTATTTACGCTGGCTCTGCTGAAGAAAATCTTCAGAGG 2603_ai1.seq
5167 ATCAGGATATCCCTATTTACGCTGGCTCTGCTGAAGAAAATCTTCAGAGG 18rs21_ai1.seq
5399 ATCAGGATATCCCTATTTACGCTGGCTCTGCTGAAGAAAATCTTCAGAGG coh1_ai1.seq
5399 ATCAGGATATCCCTATTTACGCTGGCTCTGCTGAAGAAAATCTTCAGAGG cjb111_ai1.seq
5401 ATCAGGATATCCCTATTTACGCTGGCTCTGCTGAAGAAAATCTTCAGAGG nem316_ai1.seq
5400 ATCAGGATATCCCTATTTACGCTGGCTCTGCTGAAGAAAATCTTCAGAGG a909_ai1.seq

     GGCGTTGGACATTTAGAGGGGACCAGTCTTCCAGTCGGTGGTGAGTCAAC Majority
               5460      5470      5480      5490      5500
5448 GGCGTTGGACATTTAGAGGGGACCAGTCTTCCAGTCGGTGGTGAGTCAAC 2603_ai1.seq
5217 GGCGTTGGACATTTAGAGGGGACCAGTCTTCCAGTCGGTGGTGAGTCAAC 18rs21_ai1.seq
5449 GGCGTTGGACATTTAGAGGGGACCAGTCTTCCAGTCGGTGGTGAGTCAAC coh1_ai1.seq
5449 GGCGTTGGACATTTAGAGGGGACCAGTCTTCCAGTCGGTGGTGAGTCAAC cjb111_ai1.seq
5451 GGCGTTGGACATTTAGAGGGGACCAGTCTTCCAGTCGGTGGTGAGTCAAC nem316_ai1.seq
5450 GGCGTTGGACATTTAGAGGGGACCAGTCTTCCAGTCGGTGGTGAGTCAAC a909_ai1.seq

     TCATGCCGTTCTAACTGCCCATCGAGGGCTACCAACGGCCAAGCTATTTA Majority
               5510      5520      5530      5540      5550
5498 TCATGCCGTTCTAACTGCCCATCGAGGGCTACCAACGGCCAAGCTATTTA 2603_ai1.seq
5267 TCATGCCGTTCTAACTGCCCATCGAGGGCTACCAACGGCCAAGCTATTTA 18rs21_ai1.seq
5499 TCATGCCGTTCTAACTGCCCATCGAGGGCTACCAACGGCCAAGCTATTTA coh1_ai1.seq
5499 TCATGCCGTTCTAACTGCCCATCGAGGGCTACCAACGGCCAAGCTATTTA cjb111_ai1.seq
5501 TCATGCCGTTCTAACTGCCCATCGAGGGCTACCAACGGCCAAGCTATTTA nem316_ai1.seq
5500 TCATGCCGTTCTAACTGCCCATCGAGGGCTACCAACGGCCAAGCTATTTA a909_ai1.seq

     CCAATTTAGACAAGGTAACAGTAGGTGACCGTTTTTACATTGAACACATC Majority
               5560      5570      5580      5590      5600
5548 CCAATTTAGACAAGGTAACAGTAGGTGACCGTTTTTACATTGAACACATC 2603_ai1.seq
5317 CCAATTTAGACAAGGTAACAGTAGGTGACCGTTTTTACATTGAACACATC 18rs21_ai1.seq
5549 CCAATTTAGACAAGGTAACAGTAGGTGACCGTTTTTACATTGAACACATC coh1_ai1.seq
5549 CCAATTTAGACAAGGTAACAGTAGGTGACCGTTTTTACATTGAACACATC cjb111_ai1.seq
5551 CCAATTTAGACAAGGTAACAGTAGGTGACCGTTTTTACATTGAACACATC nem316_ai1.seq
5550 CCAATTTAGACAAGGTAACAGTAGGTGACCGTTTTTACATTGAACACATC a909_ai1.seq
```

FIGURE 18Q

Alignment Report of AI-1_alignment, using J. Hein method with Weighted residue weight table.
Thursday, July 29, 2004 5:46 PM

```
     GGCGGAAAGATTGCTTATCAGGTAGACCAAATCAAAGTTATCGCCCCTGA Majority
                   5610      5620      5630      5640      5650
5598 GGCGGAAAGATTGCTTATCAGGTAGACCAAATCAAAGTTATCGCCCCTGA 2603_ai1.seq
5367 GGCGGAAAGATTGCTTATCAGGTAGACCAAATCAAAGTTATCGCCCCTGA 18rs21_ai1.seq
5599 GGCGGAAAGATTGCTTATCAGGTAGACCAAATCAAAGTTATCGCCCCTGA coh1_ai1.seq
5599 GGCGGAAAGATTGCTTATCAGGTAGACCAAATCAAAGTTATCGCCCCTGA cjb111_ai1.seq
5601 GGCGGAAAGATTGCTTATCAGGTAGACCAAATCAAAGTTATCGCCCCTGA nem316_ai1.seq
5600 GGCGGAAAGATTGCTTATCAGGTAGACCAAATCAAAGTTATCGCCCCTGA a909_ai1.seq

     TCAGTTAGAGGATTTGTACGTGATTCAAGGAGAAGATCACGTCACCCTAT Majority
                   5660      5670      5680      5690      5700
5648 TCAGTTAGAGGATTTGTACGTGATTCAAGGAGAAGATCACGTCACCCTAT 2603_ai1.seq
5417 TCAGTTAGAGGATTTGTACGTGATTCAAGGAGAAGATCACGTCACCCTAT 18rs21_ai1.seq
5649 TCAGTTAGAGGATTTGTACGTGATTCAAGGAGAAGATCACGTCACCCTAT coh1_ai1.seq
5649 TCAGTTAGAGGATTTGTACGTGATTCAAGGAGAAGATCACGTCACCCTAT cjb111_ai1.seq
5651 TCAGTTAGAGGATTTGTACGTGATTCAAGGAGAAGATCACGTCACCCTAT nem316_ai1.seq
5650 TCAGTTAGAGGATTTGTACGTGATTCAAGGAGAAGATCACGTCACCCTAT a909_ai1.seq

     TAACTTGCACACCTTATATGATAAATAGTCATCGCCTCCTCGTTCGAGGC Majority
                   5710      5720      5730      5740      5750
5698 TAACTTGCACACCTTATATGATAAATAGTCATCGCCTCCTCGTTCGAGGC 2603_ai1.seq
5467 TAACTTGCACACCTTATATGATAAATAGTCATCGCCTCCTCGTTCGAGGC 18rs21_ai1.seq
5699 TAACTTGCACACCTTATATGATAAATAGTCATCGCCTCCTCGTTCGAGGC coh1_ai1.seq
5699 TAACTTGCACACCTTATATGATAAATAGTCATCGCCTCCTCGTTCGAGGC cjb111_ai1.seq
5701 TAACTTGCACACCTTATATGATAAATAGTCATCGCCTCCTCGTTCGAGGC nem316_ai1.seq
5700 TAACTTGCACACCTTATATGATAAATAGTCATCGCCTCCTCGTTCGAGGC a909_ai1.seq

     AAGCGAATTCCTTATGTGGAAAAAACAGTGCAGAAAGATTCAAAGACCTT Majority
                   5760      5770      5780      5790      5800
5748 AAGCGAATTCCTTATGTGGAAAAAACAGTGCAGAAAGATTCAAAGACCTT 2603_ai1.seq
5517 AAGCGAATTCCTTATGTGGAAAAAACAGTGCAGAAAGATTCAAAGACCTT 18rs21_ai1.seq
5749 AAGCGAATTCCTTATGTGGAAAAAACAGTGCAGAAAGATTCAAAGACCTT coh1_ai1.seq
5749 AAGCGAATTCCTTATGTGGAAAAAACAGTGCAGAAAGATTCAAAGACCTT cjb111_ai1.seq
5751 AAGCGAATTCCTTATGTGGAAAAAACAGTGCAGAAAGATTCAAAGACCTT nem316_ai1.seq
5750 AAGCGAATTCCTTATGTGGAAAAAACAGTGCAGAAAGATTCAAAGACCTT a909_ai1.seq

     CAGGCAACAACAATACCTAACCTATGCTATGTGGGTAGTCGTTGGACTTA Majority
                   5810      5820      5830      5840      5850
5798 CAGGCAACAACAATACCTAACCTATGCTATGTGGGTAGTCGTTGGACTTA 2603_ai1.seq
5567 CAGGCAACAACAATACCTAACCTATGCTATGTGGGTAGTCGTTGGACTTA 18rs21_ai1.seq
5799 CAGGCAACAACAATACCTAACCTATGCTATGTGGGTAGTCGTTGGACTTA coh1_ai1.seq
5799 CAGGCAACAACAATACCTAACCTATGCTATGTGGGTAGTCGTTGGACTTA cjb111_ai1.seq
5801 CAGGCAACAACAATACCTAACCTATGCTATGTGGGTAGTCGTTGGACTTA nem316_ai1.seq
5800 CAGGCAACAACAATACCTAACCTATGCTATGTGGGTAGTCGTTGGACTTA a909_ai1.seq

     TCTTGCTGTCGCTTCTCATTTGGTTTAAAAAGACGAAACAGAAAAAGCGG Majority
                   5860      5870      5880      5890      5900
5848 TCTTGCTGTCGCTTCTCATTTGGTTTAAAAAGACGAAACAGAAAAAGCGG 2603_ai1.seq
5617 TCTTGCTGTCGCTTCTCATTTGGTTTAAAAAGACGAAACAGAAAAAGCGG 18rs21_ai1.seq
5849 TCTTGCTGTCGCTTCTCATTTGGTTTAAAAAGACGAAACAGAAAAAGCGG coh1_ai1.seq
5849 TCTTGCTGTCGCTTCTCATTTGGTTTAAAAAGACGAAACAGAAAAAGCGG cjb111_ai1.seq
5851 TCTTGCTGTCGCTTCTCATTTGGTTTAAAAAGACGAAACAGAAAAAGCGG nem316_ai1.seq
5850 TCTTGCTGTCGCTTCTCATTTGGTTTAAAAAGACGAAACAGAAAAAGCGG a909_ai1.seq

     AGAAAGAATGAAAAAGCGGCTAGTCAAAATAGTCACAATAATTCGAAATA Majority
                   5910      5920      5930      5940      5950
5898 AGAAAGAATGAAAAAGCGGCTAGTCAAAATAGTCACAATAATTCGAAATA 2603_ai1.seq
5667 AGAAAGAATGAAAAAGCGGCTAGTCAAAATAGTCACAATAATTCGAAATA 18rs21_ai1.seq
5899 AGAAAGAATGAAAAAGCGGCTAGTCAAAATAGTCACAATAATTCGAAATA coh1_ai1.seq
5899 AGAAAGAATGAAAAAGCGGCTAGTCAAAATAGTCACAATAATTCGAAATA cjb111_ai1.seq
5901 AGAAAGAATGAAAAAGCGGCTAGTCAAAATAGTCACAATAATTCGAAATA nem316_ai1.seq
5900 AGAAAGAATGAAAAAGCGGCTAGTCAAAATAGTCACAATAATTCGAAATA a909_ai1.seq
```

FIGURE 18R

Alignment Report of AI-1_alignment, using J. Hein method with Weighted residue weight table.
Thursday, July 29, 2004 5:46 PM

```
     ATAAAATCAGAACCCTCATTTTTGTGATGGGAAGTCTGATTCTCTTATTT Majority
              5960      5970      5980      5990      6000
5948 ATAAAATCAGAACCCTCATTTTTGTGATGGGAAGTCTGATTCTCTTATTT 2603_ai1.seq
5717 ATAAAATCAGAACCCTCATTTTTGTGATGGGAAGTCTGATTCTCTTATTT 18rs21_ai1.seq
5949 ATAAAATCAGAACCCTCATTTTTGTGATGGGAAGTCTGATTCTCTTATTT coh1_ai1.seq
5949 ATAAAATCAGAACCCTCATTTTTGTGATGGGAAGTCTGATTCTCTTATTT cjb111_ai1.seq
5951 ATAAAATCAGAACCCTCATTTTTGTGATGGGAAGTCTGATTCTCTTATTT nem316_ai1.seq
5950 ATAAAATCAGAACCCTCATTTTTGTGATGGGAAGTCTGATTCTCTTATTT a909_ai1.seq

     CCGATTGTGAGCCAGGTAAGTTACTACCTTGCTTCGCATCAAAATATTAA Majority
              6010      6020      6030      6040      6050
5998 CCGATTGTGAGCCAGGTAAGTTACTACCTTGCTTCGCATCAAAATATTAA 2603_ai1.seq
5767 CCGATTGTGAGCCAGGTAAGTTACTACCTTGCTTCGCATCAAAATATTAA 18rs21_ai1.seq
5999 CCGATTGTGAGCCAGGTAAGTTACTACCTTGCTTCGCATCAAAATATTAA coh1_ai1.seq
5999 CCGATTGTGAGCCAGGTAAGTTACTACCTTGCTTCGCATCAAAATATTAA cjb111_ai1.seq
6001 CCGATTGTGAGCCAGGTAAGTTACTACCTTGCTTCGCATCAAAATATTAA nem316_ai1.seq
6000 CCGATTGTGAGCCAGGTAAGTTACTACCTTGCTTCGCATCAAAATATTAA a909_ai1.seq

     TCAATTTAAGCGGGAAGTCGCTAAGATTGATACTAATACGGTTGAACGAC Majority
              6060      6070      6080      6090      6100
6048 TCAATTTAAGCGGGAAGTCGCTAAGATTGATACTAATACGGTTGAACGAC 2603_ai1.seq
5817 TCAATTTAAGCGGGAAGTCGCTAAGATTGATACTAATACGGTTGAACGAC 18rs21_ai1.seq
6049 TCAATTTAAGCGGGAAGTCGCTAAGATTGATACTAATACGGTTGAACGAC coh1_ai1.seq
6049 TCAATTTAAGCGGGAAGTCGCTAAGATTGATACTAATACGGTTGAACGAC cjb111_ai1.seq
6051 TCAATTTAAGCGGGAAGTCGCTAAGATTGATACTAATACGGTTGAACGAC nem316_ai1.seq
6050 TCAATTTAAGCGGGAAGTCGCTAAGATTGATACTAATACGGTTGAACGAC a909_ai1.seq

     GCATCGCTTTAGCTAATGCTTACAATGAGACGTTATCAAGGAATCCCTTG Majority
              6110      6120      6130      6140      6150
6098 GCATCGCTTTAGCTAATGCTTACAATGAGACGTTATCAAGGAATCCCTTG 2603_ai1.seq
5867 GCATCGCTTTAGCTAATGCTTACAATGAGACGTTATCAAGGAATCCCTTG 18rs21_ai1.seq
6099 GCATCGCTTTAGCTAATGCTTACAATGAGACGTTATCAAGGAATCCCTTG coh1_ai1.seq
6099 GCATCGCTTTAGCTAATGCTTACAATGAGACGTTATCAAGGAATCCCTTG cjb111_ai1.seq
6101 GCATCGCTTTAGCTAATGCTTACAATGAGACGTTATCAAGGAATCCCTTG nem316_ai1.seq
6100 GCATCGCTTTAGCTAATGCTTACAATGAGACGTTATCAAGGAATCCCTTG a909_ai1.seq

     CTTATAGACCCTTTTACCAGTAAGCAAAAAGAAGGTTTGAGAGAGTATGC Majority
              6160      6170      6180      6190      6200
6148 CTTATAGACCCTTTTACCAGTAAGCAAAAAGAAGGTTTGAGAGAGTATGC 2603_ai1.seq
5917 CTTATAGACCCTTTTACCAGTAAGCAAAAAGAAGGTTTGAGAGAGTATGC 18rs21_ai1.seq
6149 CTTATAGACCCTTTTACCAGTAAGCAAAAAGAAGGTTTGAGAGAGTATGC coh1_ai1.seq
6149 CTTATAGACCCTTTTACCAGTAAGCAAAAAGAAGGTTTGAGAGAGTATGC cjb111_ai1.seq
6151 CTTATAGACCCTTTTACCAGTAAGCAAAAAGAAGGTTTGAGAGAGTATGC nem316_ai1.seq
6150 CTTATAGACCCTTTTACCAGTAAGCAAAAAGAAGGTTTGAGAGAGTATGC a909_ai1.seq

     TCGTATGCTTGAAGTTCATGAGCAAATAGGTCATGTGGCAATCCCAAGTA Majority
              6210      6220      6230      6240      6250
6198 TCGTATGCTTGAAGTTCATGAGCAAATAGGTCATGTGGCAATCCCAAGTA 2603_ai1.seq
5967 TCGTATGCTTGAAGTTCATGAGCAAATAGGTCATGTGGCAATCCCAAGTA 18rs21_ai1.seq
6199 TCGTATGCTTGAAGTTCATGAGCAAATAGGTCATGTGGCAATCCCAAGTA coh1_ai1.seq
6199 TCGTATGCTTGAAGTTCATGAGCAAATAGGTCATGTGGCAATCCCAAGTA cjb111_ai1.seq
6201 TCGTATGCTTGAAGTTCATGAGCAAATAGGTCATGTGGCAATCCCAAGTA nem316_ai1.seq
6200 TCGTATGCTTGAAGTTCATGAGCAAATAGGTCATGTGGCAATCCCAAGTA a909_ai1.seq

     TTGGGGTTGATATTCCAATTTATGCTGGAACATCCGAAACTGTGCTTCAG Majority
              6260      6270      6280      6290      6300
6248 TTGGGGTTGATATTCCAATTTATGCTGGAACATCCGAAACTGTGCTTCAG 2603_ai1.seq
6017 TTGGGGTTGATATTCCAATTTATGCTGGAACATCCGAAACTGTGCTTCAG 18rs21_ai1.seq
6249 TTGGGGTTGATATTCCAATTTATGCTGGAACATCCGAAACTGTGCTTCAG coh1_ai1.seq
6249 TTGGGGTTGATATTCCAATTTATGCTGGAACATCCGAAACTGTGCTTCAG cjb111_ai1.seq
6251 TTGGGGTTGATATTCCAATTTATGCTGGAACATCCGAAACTGTGCTTCAG nem316_ai1.seq
6250 TTGGGGTTGATATTCCAATTTATGCTGGAACATCCGAAACTGTGCTTCAG a909_ai1.seq
```

FIGURE 18S

Alignment Report of AI-1_alignment, using J. Hein method with Weighted residue weight table.
Thursday, July 29, 2004 5:46 PM

```
     AAAGGTAGTGGGCATTTGGAGGGAACCAGTCTTCCAGTGGGAGGTTTGTC Majority
               6310      6320      6330      6340      6350
6298 AAAGGTAGTGGGCATTTGGAGGGAACCAGTCTTCCAGTGGGAGGTTTGTC 2603_ai1.seq
6067 AAAGGTAGTGGGCATTTGGAGGGAACCAGTCTTCCAGTGGGAGGTTTGTC 18rs21_ai1.seq
6299 AAAGGTAGTGGGCATTTGGAGGGAACCAGTCTTCCAGTGGGAGGTTTGTC coh1_ai1.seq
6299 AAAGGTAGTGGGCATTTGGAGGGAACCAGTCTTCCAGTGGGAGGTTTGTC cjb111_ai1.seq
6301 AAAGGTAGTGGGCATTTGGAGGGAACCAGTCTTCCAGTGGGAGGTTTGTC nem316_ai1.seq
6300 AAAGGTAGTGGGCATTTGGAGGGAACCAGTCTTCCAGTGGGAGGTTTGTC a909_ai1.seq

     AACCCATTCAGTACTAACTGCCCACCGTGGCTTGCCAACAGCTAGGCTAT Majority
               6360      6370      6380      6390      6400
6348 AACCCATTCAGTACTAACTGCCCACCGTGGCTTGCCAACAGCTAGGCTAT 2603_ai1.seq
6117 AACCCATTCAGTACTAACTGCCCACCGTGGCTTGCCAACAGCTAGGCTAT 18rs21_ai1.seq
6349 AACCCATTCAGTACTAACTGCCCACCGTGGCTTGCCAACAGCTAGGCTAT coh1_ai1.seq
6349 AACCCATTCAGTACTAACTGCCCACCGTGGCTTGCCAACAGCTAGGCTAT cjb111_ai1.seq
6351 AACCCATTCAGTACTAACTGCCCACCGTGGCTTGCCAACAGCTAGGCTAT nem316_ai1.seq
6350 AACCCATTCAGTACTAACTGCCCACCGTGGCTTGCCAACAGCTAGGCTAT a909_ai1.seq

     TTACCGACTTAAATAAAGTTAAAAAAGGCCAGATTTTCTATGTGACGAAC Majority
               6410      6420      6430      6440      6450
6398 TTACCGACTTAAATAAAGTTAAAAAAGGCCAGATTTTCTATGTGACGAAC 2603_ai1.seq
6167 TTACCGACTTAAATAAAGTTAAAAAAGGCCAGATTTTCTATGTGACGAAC 18rs21_ai1.seq
6399 TTACCGACTTAAATAAAGTTAAAAAAGGCCAGATTTTCTATGTGACGAAC coh1_ai1.seq
6399 TTACCGACTTAAATAAAGTTAAAAAAGGCCAGATTTTCTATGTGACGAAC cjb111_ai1.seq
6401 TTACCGACTTAAATAAAGTTAAAAAAGGCCAGATTTTCTATGTGACGAAC nem316_ai1.seq
6400 TTACCGACTTAAATAAAGTTAAAAAAGGCCAGATTTTCTATGTGACGAAC a909_ai1.seq

     ATCAAGGAAACACTTGCCTACAAAGTCGTGTCTATCAAAGTTGTGGATCC Majority
               6460      6470      6480      6490      6500
6448 ATCAAGGAAACACTTGCCTACAAAGTCGTGTCTATCAAAGTTGTGGATCC 2603_ai1.seq
6217 ATCAAGGAAACACTTGCCTACAAAGTCGTGTCTATCAAAGTTGTGGATCC 18rs21_ai1.seq
6449 ATCAAGGAAACACTTGCCTACAAAGTCGTGTCTATCAAAGTTGTGGATCC coh1_ai1.seq
6449 ATCAAGGAAACACTTGCCTACAAAGTCGTGTCTATCAAAGTTGTGGATCC cjb111_ai1.seq
6451 ATCAAAGAAACACTTGCCTACAAAGTCGTGTCTATCAAAGTTGTGGATCC nem316_ai1.seq
6450 ATCAAGGAAACACTTGCCTACAAAGTCGTGTCTATCAAAGTTGTGGATCC a909_ai1.seq

     AACAGCTTTAAGTGAGGTTAAGATTGTCAATGGTAAGGATTATATAACCT Majority
               6510      6520      6530      6540      6550
6498 AACAGCTTTAAGTGAGGTTAAGATTGTCAATGGTAAGGATTATATAACCT 2603_ai1.seq
6267 AACAGCTTTAAGTGAGGTTAAGATTGTCAATGGTAAGGATTATATAACCT 18rs21_ai1.seq
6499 AACAGCTTTAAGTGAGGTTAAGATTGTCAATGGTAAGGATTATATAACCT coh1_ai1.seq
6499 AACAGCTTTAAGTGAGGTTAAGATTGTCAATGGTAAGGATTATATAACCT cjb111_ai1.seq
6501 AACAGCTTTAAGTGAGGTTAAGATTGTCAATGGTAAGGATTATATAACCT nem316_ai1.seq
6500 AACAGCTTTAAGTGAGGTTAAGATTGTCAATGGTAAGGATTATATAACCT a909_ai1.seq

     TGCTGACTTGCACACCTTACATGATCAATAGTCATCGTCTCTTGGTAAAA Majority
               6560      6570      6580      6590      6600
6548 TGCTGACTTGCACACCTTACATGATCAATAGTCATCGTCTCTTGGTAAAA 2603_ai1.seq
6317 TGCTGACTTGCACACCTTACATGATCAATAGTCATCGTCTCTTGGTAAAA 18rs21_ai1.seq
6549 TGCTGACTTGCACACCTTACATGATCAATAGTCATCGTCTCTTGGTAAAA coh1_ai1.seq
6549 TGCTGACTTGCACACCTTACATGATCAATAGTCATCGTCTCTTGGTAAAA cjb111_ai1.seq
6551 TGCTGACTTGCACACCTTACATGATCAATAGTCATCGTCTCTTGGTAAAA nem316_ai1.seq
6550 TGCTGACTTGCACACCTTACATGATCAATAGTCATCGTCTCTTGGTAAAA a909_ai1.seq

     GGAGAGCGTATTCCTTATGATTCTACCGAGGCGGAAAAGCACAAAGAACA Majority
               6610      6620      6630      6640      6650
6598 GGAGAGCGTATTCCTTATGATTCTACCGAGGCGGAAAAGCACAAAGAACA 2603_ai1.seq
6367 GGAGAGCGTATTCCTTATGATTCTACCGAGGCGGAAAAGCACAAAGAACA 18rs21_ai1.seq
6599 GGAGAGCGTATTCCTTATGATTCTACCGAGGCGGAAAAGCACAAAGAACA coh1_ai1.seq
6599 GGAGAGCGTATTCCTTATGATTCTACCGAGGCGGAAAAGCACAAAGAACA cjb111_ai1.seq
6601 GGAGAGCGTATTCCTTATGATTCTACCGAGGCGGAAAAGCACAAAGAACA nem316_ai1.seq
6600 GGAGAGCGTATTCCTTATGATTCTACCGAGGCGGAAAAGCACAAAGAACA a909_ai1.seq
```

FIGURE 18T

Alignment Report of AI-1_alignment, using J. Hein method with Weighted residue weight table.
Thursday, July 29, 2004 5:46 PM A A C C G T A C A A G A T T A T C G T T T G T C A C T A G T G T T G A A G A T A C T A C T A G T A T Majority 6660 6670 6680 6690 6700

6648 A A C C G T A C A A G A T T A T C G T T T G T C A C T A G T G T T G A A G A T A C T A C T A G T A T 2603_ai1.seq
6417 A A C C G T A C A A G A T T A T C G T T T G T C A C T A G T G T T G A A G A T A C T A C T A G T A T 18rs21_ai1.seq
6649 A A C C G T A C A A G A T T A T C G T T T G T C A C T A G T G T T G A A G A T A C T A C T A G T A T coh1_ai1.seq
6649 A A C C G T A C A A G A T T A T C G T T T G T C A C T A G T G T T G A A G A T A C T A C T A G T A T cjb111_ai1.seq
6651 A A C C G T A C A A G A T T A T C G T T T G T C A C T A G T G T T G A A G A T A C T A C T A G T A T nem316_ai1.seq
6650 A A C C G T A C A A G A T T A T C G T T T G T C A C T A G T G T T G A A G A T A C T A C T A G T A T a909_ai1.seq T A T T A A T T G G A C T C T T C A T C G T G A T A A T G A T G A G A A G A T G G A T G C A A C A T Majority 6710 6720 6730 6740 6750

6698 T A T T A A T T G G A C T C T T C A T C G T G A T A A T G A T G A G A A G A T G G A T G C A A C A T 2603_ai1.seq
6467 T A T T A A T T G G A C T C T T C A T C G T G A T A A T G A T G A G A A G A T G G A T G C A A C A T 18rs21_ai1.seq
6699 T A T T A A T T G G A C T C T T C A T C G T G A T A A T G A T G A G A A G A T G G A T G C A A C A T coh1_ai1.seq
6699 T A T T A A T T G G A C T C T T C A T C G T G A T A A T G A T G A G A A G A T G G A T G C A A C A T cjb111_ai1.seq
6701 T A T T A A T T G G A C T C T T C A T C G T G A T A A T G A T G A G A A G A T G G A T G C A A C A T nem316_ai1.seq
6700 T A T T A A T T G G A C T C T T C A T C G T G A T A A T G A T G A G A A G A T G G A T G C A A C A T a909_ai1.seq C G T C A A T A A C G A T G T T G T G A A T G G C T T A C T T A C T T A T C A A A T A G G T G A C T Majority 6760 6770 6780 6790 6800

6748 C G T C A A T A A C G A T G T T G T G A A T G G C T T A C T T - - - - A T C A A A T A G G T G A C T 2603_ai1.seq
6517 C G T C A A T A A C G A T G T T G T G A A T G G C T T A C T T A C T T A T C A A A T A G G T G A C T 18rs21_ai1.seq
6749 C G T C A A T A A C G A T G T T G T G A A T G G C T T A C T T A C T T A T C A A A T A G G T G A C T coh1_ai1.seq
6749 C G T C A A T A A C G A T G T T G T G A A T G G C T T A C T T A C T T A T C A A A T A G G T G A C T cjb111_ai1.seq
6751 C G T C A A T A A C G A T G T T G T G A A T G G C T T A C T T A C T T A T C A A A T A G G T G A C T nem316_ai1.seq
6750 C G T C A A T A A C G A T G T T G T G A A T G G C T T A C T T A C T T A T C A A A T A G G T G A C T a909_ai1.seq A A T G A T G A T T G T G A A T A A T G G T T A T C T A G A A G G G A G A A A A A T G A A A A A G A Majority 6810 6820 6830 6840 6850

6794 A A T G A T G A T T G T G A A T A A T G G T T A T C T A G A A G G G A G A A A A A T G A A A A A G A 2603_ai1.seq
6567 A A T G A T G A T T G T G A A T A A T G G T T A T C T A G A A G G G A G A A A A A T G A A A A A G A 18rs21_ai1.seq
6799 A A T G A T G A T T G T G A A T A A T G G T T A T C T A G A A G G G A G A A A A A T G A A A A A G A coh1_ai1.seq
6799 A A T G A T G A T T G T G A A T A A T G G T T A T C T A G A A G G G A G A A A A A T G A A A A A G A cjb111_ai1.seq
6801 A A T G A T G A T T G T G A A T A A T G G T T A T C T A G A A G G G A G A A A A A T G A A A A A G A nem316_ai1.seq
6800 A A T G A T G A T T G T G A A T A A T G G T T A T C T A G A A G G G A G A A A A A T G A A A A A G A a909_ai1.seq G A C A A A A A A T A T G G A G A G G G T T A T C A G T T A C T T T A C T A A T C C T G T C C C A A Majority 6860 6870 6880 6890 6900

6844 G A C A A A A A A T A T G G A G A G G G T T A T C A G T T A C T T T A C T A A T C C T G T C C C A A 2603_ai1.seq
6617 G A C A A A A A A T A T G G A G A G G G T T A T C A G T T A C T T T A C T A A T C C T G T C C C A A 18rs21_ai1.seq
6849 G A C A A A A A A T A T G G A G A G G G T T A T C A G T T A C T T T A C T A A T C C T G T C C C A A coh1_ai1.seq
6849 G A C A A A A A A T A T G G A G A G G G T T A T C A G T T A C T T T A C T A A T C C T G T C C C A A cjb111_ai1.seq
6851 G A C A A A A A A T A T G G A G A G G G T T A T C A G T T A C T T T A C T A A T C C T G T C C C A A nem316_ai1.seq
6850 G A C A A A A A A T A T G G A G A G G G T T A T C A G T T A C T T T A C T A A T C C T G T C C C A A a909_ai1.seq A T T C C A T T T G G T A T A T T G G T A C A A G G T G A A A C C C A A G A T A C C A A T C A A G C Majority 6910 6920 6930 6940 6950

6894 A T T C C A T T T G G T A T A T T G G T A C A A G G T G A A A C C C A A G A T A C C A A T C A A G C 2603_ai1.seq
6667 A T T C C A T T T G G T A T A T T G G T A C A A G G T G A A A C C C A A G A T A C C A A T C A A G C 18rs21_ai1.seq
6899 A T T C C A T T T G G T A T A T T G G T A C A A G G T G A A A C C C A A G A T A C C A A T C A A G C coh1_ai1.seq
6899 A T T C C A T T T G G T A T A T T G G T A C A A G G T G A A A C C C A A G A T A C C A A T C A A G C cjb111_ai1.seq
6901 A T T C C A T T T G G T A T A T T G G T A C A A G G T G A A A C C C A A G A T A C C A A T C A A G C nem316_ai1.seq
6900 A T T C C A T T T G G T A T A T T G G T A C A A G G T G A A A C C C A A G A T A C C A A T C A A G C a909_ai1.seq A C T T G G A A A A G T A A T T G T T A A A A A A A C G G G A G A C A A T G C T A C A C C A T T A G Majority 6960 6970 6980 6990 7000

6944 A C T T G G A A A A G T A A T T G T T A A A A A A A C G G G A G A C A A T G C T A C A C C A T T A G 2603_ai1.seq
6717 A C T T G G A A A A G T A A T T G T T A A A A A A A C G G G A G A C A A T G C T A C A C C A T T A G 18rs21_ai1.seq
6949 A C T T G G A A A A G T A A T T G T T A A A A A A A C G G G A G A C A A T G C T A C A C C A T T A G coh1_ai1.seq
6949 A C T T G G A A A A G T A A T T G T T A A A A A A A C G G G A G A C A A T G C T A C A C C A T T A G cjb111_ai1.seq
6951 A C T T G G A A A A G T A A T T G T T A A A A A A A C G G G A G A C A A T G C T A C A C C A T T A G nem316_ai1.seq
6950 A C T T G G A A A A G T A A T T G T T A A A A A A A C G G G G G A C A A T G C T A C A C C A T T A G a909_ai1.seq

FIGURE 18U

Alignment Report of AI-1_alignment, using J. Hein method with Weighted residue weight table.
Thursday, July 29, 2004 5:46 PM

```
     GCAAAGCGACTTTTGTGTTAAAAAATGACAATGATAAGTCAGAAACAAGT Majority
               7010      7020      7030      7040      7050
6994 GCAAAGCGACTTTTGTGTTAAAAAATGACAATGATAAGTCAGAAACAAGT 2603_ai1.seq
6767 GCAAAGCGACTTTTGTGTTAAAAAATGACAATGATAAGTCAGAAACAAGT 18rs21_ai1.seq
6999 GCAAAGCGACTTTTGTGTTAAAAAATGACAATGATAAGTCAGAAACAAGT coh1_ai1.seq
6999 GCAAAGCGACTTTTGTGTTAAAAAATGACAATGATAAGTCAGAAACAAGT cjb111_ai1.seq
7001 GCAAAGCGACTTTTGTGTTAAAAAATGACAATGATAAGTCAGAAACAAGT nem316_ai1.seq
7000 GCAAAGCGACTTTTGTGTTAAAAAATGACAATGATAAGTCAGAAACAAGT a909_ai1.seq

     CACGAAACGGTAGAGGGTTCTGGAGAAGCAACCTTTGAAAACATAAAACC Majority
               7060      7070      7080      7090      7100
7044 CACGAAACGGTAGAGGGTTCTGGAGAAGCAACCTTTGAAAACATAAAACC 2603_ai1.seq
6817 CACGAAACGGTAGAGGGTTCTGGAGAAGCAACCTTTGAAAACATAAAACC 18rs21_ai1.seq
7049 CACGAAACGGTAGAGGGTTCTGGAGAAGCAACCTTTGAAAACATAAAACC coh1_ai1.seq
7049 CACGAAACGGTAGAGGGTTCTGGAGAAGCAACCTTTGAAAACATAAAACC cjb111_ai1.seq
7051 CACGAAACGGTAGAGGGTTCTGGAGAAGCAACCTTTGAAAACATAAAACC nem316_ai1.seq
7050 CACGAAACGGTAGAGGGTTCTGGAGAAGCAACCTTTGAAAACATAAAACC a909_ai1.seq

     TGGAGACTACACATTAAGAGAAGAAACAGCACCAATTGGTTATAAAAAAA Majority
               7110      7120      7130      7140      7150
7094 TGGAGACTACACATTAAGAGAAGAAACAGCACCAATTGGTTATAAAAAAA 2603_ai1.seq
6867 TGGAGACTACACATTAAGAGAAGAAACAGCACCAATTGGTTATAAAAAAA 18rs21_ai1.seq
7099 TGGAGACTACACATTAAGAGAAGAAACAGCACCAATTGGTTATAAAAAAA coh1_ai1.seq
7099 TGGAGACTACACATTAAGAGAAGAAACAGCACCAATTGGTTATAAAAAAA cjb111_ai1.seq
7101 TGGAGACTACACATTAAGAGAAGAAACAGCACCAATTGGTTATAAAAAAA nem316_ai1.seq
7100 TGGAGACTACACATTAAGAGAAGAAACAGCACCAATTGGTTATAAAAAAA a909_ai1.seq

     CTGATAAAACCTGGAAAGTTAAAGTTGCAGATAACGGAGCAACAATAATC Majority
               7160      7170      7180      7190      7200
7144 CTGATAAAACCTGGAAAGTTAAAGTTGCAGATAACGGAGCAACAATAATC 2603_ai1.seq
6917 CTGATAAAACCTGGAAAGTTAAAGTTGCAGATAACGGAGCAACAATAATC 18rs21_ai1.seq
7149 CTGATAAAACCTGGAAAGTTAAAGTTGCAGATAACGGAGCAACAATAATC coh1_ai1.seq
7149 CTGATAAAACCTGGAAAGTTAAAGTTGCAGATAACGGAGCAACAATAATC cjb111_ai1.seq
7151 CTGATAAAACCTGGAAAGTTAAAGTTGCAGATAACGGAGCAACAATAATC nem316_ai1.seq
7150 CTGATAAAACCTGGAAAGTTAAAGTTGCAGATAACGGAGCAACAATAATC a909_ai1.seq

     GAGGGTATGGATGCAGATAAAGCAGAGAAACGAAAAGAAGTTTTGAATGC Majority
               7210      7220      7230      7240      7250
7194 GAGGGTATGGATGCAGATAAAGCAGAGAAACGAAAAGAAGTTTTGAATGC 2603_ai1.seq
6967 GAGGGTATGGATGCAGATAAAGCAGAGAAACGAAAAGAAGTTTTGAATGC 18rs21_ai1.seq
7199 GAGGGTATGGATGCAGATAAAGCAGAGAAACGAAAAGAAGTTTTGAATGC coh1_ai1.seq
7199 GAGGGTATGGATGCAGATAAAGCAGAGAAACGAAAAGAAGTTTTGAATGC cjb111_ai1.seq
7201 GAGGGTATGGATGCAGATAAAGCAGAGAAACGAAAAGAAGTTTTGAATGC nem316_ai1.seq
7200 GAGGGTATGGATGCAGATAAAGCAGAGAAACGAAAAGAAGTTTTGAATGC a909_ai1.seq

     CCAATATCCAAAATCAGCTATTTATGAGGATACAAAAGAAAATTACCCAT Majority
               7260      7270      7280      7290      7300
7244 CCAATATCCAAAATCAGCTATTTATGAGGATACAAAAGAAAATTACCCAT 2603_ai1.seq
7017 CCAATATCCAAAATCAGCTATTTATGAGGATACAAAAGAAAATTACCCAT 18rs21_ai1.seq
7249 CCAATATCCAAAATCAGCTATTTATGAGGATACAAAAGAAAATTACCCAT coh1_ai1.seq
7249 CCAATATCCAAAATCAGCTATTTATGAGGATACAAAAGAAAATTACCCAT cjb111_ai1.seq
7251 CCAATATCCAAAATCAGCTATTTATGAGGATACAAAAGAAAATTACCCAT nem316_ai1.seq
7250 CCAATATCCAAAATCAGCTATTTATGAGGATACAAAAGAAAATTACCCAT a909_ai1.seq

     TAGTTAATGTAGAGGGTTCCAAAGTTGGTGAACAATACAAAGCATTGAAT Majority
               7310      7320      7330      7340      7350
7294 TAGTTAATGTAGAGGGTTCCAAAGTTGGTGAACAATACAAAGCATTGAAT 2603_ai1.seq
7067 TAGTTAATGTAGAGGGTTCCAAAGTTGGTGAACAATACAAAGCATTGAAT 18rs21_ai1.seq
7299 TAGTTAATGTAGAGGGTTCCAAAGTTGGTGAACAATACAAAGCATTGAAT coh1_ai1.seq
7299 TAGTTAATGTAGAGGGTTCCAAAGTTGGTGAACAATACAAAGCATTGAAT cjb111_ai1.seq
7301 TAGTTAATGTAGAGGGTTCCAAAGTTGGTGAACAATACAAAGCATTGAAT nem316_ai1.seq
7300 TAGTTAATGTAGAGGGTTCCAAAGTTGGTGAACAATACAAAGCATTGAAT a909_ai1.seq
```

FIGURE 18V

Alignment Report of AI-1_alignment, using J. Hein method with Weighted residue weight table.
Thursday, July 29, 2004 5:46 PM

```
     C C A A T A A A T G G A A A A G A T G G T C G A A G A G A G A T T G C T G A A G G T T G G T T A T C Majority
                       7360                7370                7380                7390                7400
7344 C C A A T A A A T G G A A A A G A T G G T C G A A G A G A G A T T G C T G A A G G T T G G T T A T C 2603_ai1.seq
7117 C C A A T A A A T G G A A A A G A T G G T C G A A G A G A G A T T G C T G A A G G T T G G T T A T C 18rs21_ai1.seq
7349 C C A A T A A A T G G A A A A G A T G G T C G A A G A G A G A T T G C T G A A G G T T G G T T A T C coh1_ai1.seq
7349 C C A A T A A A T G G A A A A G A T G G T C G A A G A G A G A T T G C T G A A G G T T G G T T A T C cjb111_ai1.seq
7351 C C A A T A A A T G G A A A A G A T G G T C G A A G A G A G A T T G C T G A A G G T T G G T T A T C nem316_ai1.seq
7350 C C A A T A A A T G G A A A A G A T G G T C G A A G A G A G A T T G C T G A A G G T T G G T T A T C a909_ai1.seq

     A A A A A A A A T T A C A G G G G T C A A T G A T C T C G A T A A G A A T A A A T A T A A A A T T G Majority
                       7410                7420                7430                7440                7450
7394 A A A A A A A A T T A C A G G G G T C A A T G A T C T C G A T A A G A A T A A A T A T A A A A T T G 2603_ai1.seq
7167 A A A A A A A A T T A C A G G G G T C A A T G A T C T C G A T A A G A A T A A A T A T A A A A T T G 18rs21_ai1.seq
7399 A A A A A A A A A T A C A G G G G T C A A T G A T C T C G A T A A G A A T A A A T A T A A A A T T G coh1_ai1.seq
7399 A A A A A A A A T T A C A G G G G T C A A T G A T C T C G A T A A G A A T A A A T A T A A A A T T G cjb111_ai1.seq
7401 A A A A A A A A T T A C A G G G G T C A A T G A T C T C G A T A A G A A T A A A T A T A A A A T T G nem316_ai1.seq
7400 A A A A A A A A T T A C A G G G G T C A A T G A T C T C G A T A A G A A T A A A T A T A A A A T T G a909_ai1.seq

     A A T T A A C T G T T G A G G G T A A A A C C A C T G T T G A A A C G A A A G A A C T T A A T C A A Majority
                       7460                7470                7480                7490                7500
7444 A A T T A A C T G T T G A G G G T A A A A C C A C T G T T G A A A C G A A A G A A C T T A A T C A A 2603_ai1.seq
7217 A A T T A A C T G T T G A G G G T A A A A C C A C T G T T G A A A C G A A A G A A C T T A A T C A A 18rs21_ai1.seq
7449 A A T T A A C T G T T G A G G G T A A A A C C A C T G T T G A A A C G A A A G A A C T T A A T C A A coh1_ai1.seq
7449 A A T T A A C T G T T G A G G G T A A A A C C A C T G T T G A A A C G A A A G A A C T T A A T C A A cjb111_ai1.seq
7451 A A T T A A C T G T T G A G G G T A A A A C C A C T G T T G A A A C G A A A G A A C T T A A T C A A nem316_ai1.seq
7450 A A T T A A C T G T T G A G G G T A A A A C C A C T G T T G A A A C G A A A G A A C T T A A T C A A a909_ai1.seq

     C C A C T A G A T G T C G T T G T G C T A T T A G A T A A T T C A A A T A G T A T G A A T A A T G A Majority
                       7510                7520                7530                7540                7550
7494 C C A C T A G A T G T C G T T G T G C T A T T A G A T A A T T C A A A T A G T A T G A A T A A T G A 2603_ai1.seq
7267 C C A C T A G A T G T C G T T G T G C T A T T A G A T A A T T C A A A T A G T A T G A A T A A T G A 18rs21_ai1.seq
7499 C C A C T A G A T G T C G T T G T G C T A T T A G A T A A T T C A A A T A G T A T G A A T A A T G A coh1_ai1.seq
7499 C C A C T A G A T G T C G T T G T G C T A T T A G A T A A T T C A A A T A G T A T G A A T A A T G A cjb111_ai1.seq
7501 C C A C T A G A T G T C G T T G T G C T A T T A G A T A A T T C A A A T A G T A T G A A T A A T G A nem316_ai1.seq
7500 C C A C T A G A T G T C G T T G T G C T A T T A G A T A A T T C A A A T A G T A T G A A T A A T G A a909_ai1.seq

     A A G A G C C A A T A A T T C T C A A A G A G C A T T A A A A G C T G G G G A A G C A G T T G A A A Majority
                       7560                7570                7580                7590                7600
7544 A A G A G C C A A T A A T T C T C A A A G A G C A T T A A A A G C T G G G G A A G C A G T T G A A A 2603_ai1.seq
7317 A A G A G C C A A T A A T T C T C A A A G A G C A T T A A A A G C T G G G G A A G C A G T T G A A A 18rs21_ai1.seq
7549 A A G A G C C A A T A A T T C T C A A A G A G C A T T A A A A G C T G G G G A A G C A G T T G A A A coh1_ai1.seq
7549 A A G A G C C A A T A A T T C T C A A A G A G C A T T A A A A G C T G G G G A A G C A G T T G A A A cjb111_ai1.seq
7551 A A G A G C C A A T A A T T C T C A A A G A G C A T T A A A A G C T G G G G A A G C A G T T G A A A nem316_ai1.seq
7550 A A G A G C C A A T A A T T C T C A A A G A G C A T T A A A A G C T G G G G A A G C A G T T G A A A a909_ai1.seq

     A G C T G A T T G A T A A A A T T A C A T C A A A T A A A G A C A A T A G A G T A G C T C T T G T G Majority
                       7610                7620                7630                7640                7650
7594 A G C T G A T T G A T A A A A T T A C A T C A A A T A A A G A C A A T A G A G T A G C T C T T G T G 2603_ai1.seq
7367 A G C T G A T T G A T A A A A T T A C A T C A A A T A A A G A C A A T A G A G T A G C T C T T G T G 18rs21_ai1.seq
7599 A G C T G A T T G A T A A A A T T A C A T C A A A T A A A G A C A A T A G A G T A G C T C T T G T G coh1_ai1.seq
7599 A G C T G A T T G A T A A A A T T A C A T C A A A T A A A G A C A A T A G A G T A G C T C T T G T G cjb111_ai1.seq
7601 A G C T G A T T G A T A A A A T T A C A T C A A A T A A A G A C A A T A G A G T A G C T C T T G T G nem316_ai1.seq
7600 A G C T G A T T G A T A A A A T T A C A T C A A A T A A A G A C A A T A G A G T A G C T C T T G T G a909_ai1.seq

     A C A T A T G C C T C A A C C A T T T T T G A T G G T A C T G A A G C G A C C G T A T C A A A G G G Majority
                       7660                7670                7680                7690                7700
7644 A C A T A T G C C T C A A C C A T T T T T G A T G G T A C T G A A G C G A C C G T A T C A A A G G G 2603_ai1.seq
7417 A C A T A T G C C T C A A C C A T T T T T G A T G G T A C T G A A G C G A C C G T A T C A A A G G G 18rs21_ai1.seq
7649 A C A T A T G C C T C A A C C A T T T T T G A T G G T A C T G A A G C G A C C G T A T C A A A G G G coh1_ai1.seq
7649 A C A T A T G C C T C A A C C A T T T T T G A T G G T A C T G A A G C G A C C G T A T C A A A G G G cjb111_ai1.seq
7651 A C A T A T G C C T C A A C C A T T T T T G A T G G T A C T G A A G C G A C C G T A T C A A A G G G nem316_ai1.seq
7650 A C A T A T G C C T C A A C C A T T T T T G A T G G T A C T G A A G C G A C C G T A T C A A A G G G a909_ai1.seq
```

FIGURE 18W

Alignment Report of AI-1_alignment, using J. Hein method with Weighted residue weight table.
Thursday, July 29, 2004 5:46 PM

```
     AGTTGCCGATCAAAATGGTAAAGCGCTGAATGATAGTGTATCATGGGATT Majority
              7710      7720      7730      7740      7750
7694 AGTTGCCGATCAAAATGGTAAAGCGCTGAATGATAGTGTATCATGGGATT 2603_ai1.seq
7467 AGTTGCCGATCAAAATGGTAAAGCGCTGAATGATAGTGTATCATGGGATT 18rs21_ai1.seq
7699 AGTTGCCGATCAAAATGGTAAAGCGCTGAATGATAGTGTATCATGGGATT coh1_ai1.seq
7699 AGTTGCCGATCAAAATGGTAAAGCGCTGAATGATAGTGTATCATGGGATT cjb111_ai1.seq
7701 AGTTGCCGATCAAAATGGTAAAGCGCTGAATGATAGTGTATCATGGGATT nem316_ai1.seq
7700 AGTTGCCGATCAAAATGGTAAAGCGCTGAATGATAGTGTATCATGGGATT a909_ai1.seq

     ATCATAAAACTACTTTTACAGCAACTACACATAATTACAGTTATTTAAAT Majority
              7760      7770      7780      7790      7800
7744 ATCATAAAACTACTTTTACAGCAACTACACATAATTACAGTTATTTAAAT 2603_ai1.seq
7517 ATCATAAAACTACTTTTACAGCAACTACACATAATTACAGTTATTTAAAT 18rs21_ai1.seq
7749 ATCATAAAACTACTTTTACAGCAACTACACATAATTACAGTTATTTAAAT coh1_ai1.seq
7749 ATCATAAAACTACTTTTACAGCAACTACACATAATTACAGTTATTTAAAT cjb111_ai1.seq
7751 ATCATAAAACTACTTTTACAGCAACTACACATAATTACAGTTATTTAAAT nem316_ai1.seq
7750 ATCATAAAACTACTTTTACAGCAACTACACATAATTACAGTTATTTAAAT a909_ai1.seq

     TTAACAAATGATGCTAACGAAGTTAATATTCTAAAGTCAAGAATTCCAAA Majority
              7810      7820      7830      7840      7850
7794 TTAACAAATGATGCTAACGAAGTTAATATTCTAAAGTCAAGAATTCCAAA 2603_ai1.seq
7567 TTAACAAATGATGCTAACGAAGTTAATATTCTAAAGTCAAGAATTCCAAA 18rs21_ai1.seq
7799 TTAACAAATGATGCTAACGAAGTTAATATTCTAAAGTCAAGAATTCCAAA coh1_ai1.seq
7799 TTAACAAATGATGCTAACGAAGTTAATATTCTAAAGTCAAGAATTCCAAA cjb111_ai1.seq
7801 TTAACAAATGATGCTAACGAAGTTAATATTCTAAAGTCAAGAATTCCAAA nem316_ai1.seq
7800 TTAACAAATGATGCTAACGAAGTTAATATTCTAAAGTCAAGAATTCCAAA a909_ai1.seq

     GGAAGCGGAGCATATAAATGGGGATCGCACGCTCTATCAATTTGGTGCGA Majority
              7860      7870      7880      7890      7900
7844 GGAAGCGGAGCATATAAATGGGGATCGCACGCTCTATCAATTTGGTGCGA 2603_ai1.seq
7617 GGAAGCGGAGCATATAAATGGGGATCGCACGCTCTATCAATTTGGTGCGA 18rs21_ai1.seq
7849 GGAAGCGGAGCATATAAATGGGGATCGCACGCTCTATCAATTTGGTGCGA coh1_ai1.seq
7849 GGAAGCGGAGCATATAAATGGGGATCGCACGCTCTATCAATTTGGTGCGA cjb111_ai1.seq
7851 GGAAGCGGAGCATATAAATGGGGATCGCACGCTCTATCAATTTGGTGCGA nem316_ai1.seq
7850 GGAAGCGGAGCATATAAATGGGGATCGCACGCTCTATCAATTTGGTGCGA a909_ai1.seq

     CATTTACTCAAAAAGCTCTAATGAAAGCAAATGAAATTTTAGAGACACAA Majority
              7910      7920      7930      7940      7950
7894 CATTTACTCAAAAAGCTCTAATGAAAGCAAATGAAATTTTAGAGACACAA 2603_ai1.seq
7667 CATTTACTCAAAAAGCTCTAATGAAAGCAAATGAAATTTTAGAGACACAA 18rs21_ai1.seq
7899 CATTTACTCAAAAAGCTCTAATGAAAGCAAATGAAATTTTAGAGACACAA coh1_ai1.seq
7899 CATTTACTCAAAAAGCTCTAATGAAAGCAAATGAAATTTTAGAGACACAA cjb111_ai1.seq
7901 CATTTACTCAAAAAGCTCTAATGAAAGCAAATGAAATTTTAGAGACACAA nem316_ai1.seq
7900 CATTTACTCAAAAAGCTCTAATGAAAGCAAATGAAATTTTAGAGACACAA a909_ai1.seq

     AGTTCTAATGCTAGAAAAAAACTTATTTTTCACGTAACTGATGGTGTCCC Majority
              7960      7970      7980      7990      8000
7944 AGTTCTAATGCTAGAAAAAAACTTATTTTTCACGTAACTGATGGTGTCCC 2603_ai1.seq
7717 AGTTCTAATGCTAGAAAAAAACTTATTTTTCACGTAACTGATGGTGTCCC 18rs21_ai1.seq
7949 AGTTCTAATGCTAGAAAAAAACTTATTTTTCACGTAACTGATGGTGTCCC coh1_ai1.seq
7949 AGTTCTAATGCTAGAAAAAAACTTATTTTTCACGTAACTGATGGTGTCCC cjb111_ai1.seq
7951 AGTTCTAATGCTAGAAAAAAACTTATTTTTCACGTAACTGATGGTGTCCC nem316_ai1.seq
7950 AGTTCTAATGCTAGAAAAAAACTTATTTTTCACGTAACTGATGGTGTCCC a909_ai1.seq

     TACGATGTCTTATGCCATAAATTTTAATCCTTATATATCAACATCTTACC Majority
              8010      8020      8030      8040      8050
7994 TACGATGTCTTATGCCATAAATTTTAATCCTTATATATCAACATCTTACC 2603_ai1.seq
7767 TACGATGTCTTATGCCATAAATTTTAATCCTTATATATCAACATCTTACC 18rs21_ai1.seq
7999 TACGATGTCTTATGCCATAAATTTTAATCCTTATATATCAACATCTTACC coh1_ai1.seq
7999 TACGATGTCTTATGCCATAAATTTTAATCCTTATATATCAACATCTTACC cjb111_ai1.seq
8001 TACGATGTCTTATGCCATAAATTTTAATCCTTATATATCAACATCTTACC nem316_ai1.seq
8000 TACGATGTCTTATGCCATAAATTTTAATCCTTATATATCAACATCTTACC a909_ai1.seq
```

FIGURE 18X

Alignment Report of AI-1_alignment, using J. Hein method with Weighted residue weight table.
Thursday, July 29, 2004 5:46 PM

```
     AAAACCAGTTTAATTCTTTTTTAAATAAAATACCAGATAGAAGTGGTATT Majority
               8060      8070      8080      8090      8100
8044 AAAACCAGTTTAATTCTTTTTTAAATAAAATACCAGATAGAAGTGGTATT 2603_ai1.seq
7817 AAAACCAGTTTAATTCTTTTTTAAATAAAATACCAGATAGAAGTGGTATT 18rs21_ai1.seq
8049 AAAACCAGTTTAATTCTTTTTTAAATAAAATACCAGATAGAAGTGGTATT coh1_ai1.seq
8049 AAAACCAGTTTAATTCTTTTTTAAATAAAATACCAGATAGAAGTGGTATT cjb111_ai1.seq
8051 AAAACCAGTTTAATTCTTTTTTAAATAAAATACCAGATAGAAGTGGTATT nem316_ai1.seq
8050 AAAACCAGTTTAATTCTTTTTTAAATAAAATACCAGATAGAAGTGGTATT a909_ai1.seq

     CTCCAAGAGGATTTTATAATCAATGGTGATGATTATCAAATAGTAAAAGG Majority
               8110      8120      8130      8140      8150
8094 CTCCAAGAGGATTTTATAATCAATGGTGATGATTATCAAATAGTAAAAGG 2603_ai1.seq
7867 CTCCAAGAGGATTTTATAATCAATGGTGATGATTATCAAATAGTAAAAGG 18rs21_ai1.seq
8099 CTCCAAGAGGATTTTATAATCAATGGTGATGATTATCAAATAGTAAAAGG coh1_ai1.seq
8099 CTCCAAGAGGATTTTATAATCAATGGTGATGATTATCAAATAGTAAAAGG cjb111_ai1.seq
8101 CTCCAAGAGGATTTTATAATCAATGGTGATGATTATCAAATAGTAAAAGG nem316_ai1.seq
8100 CTCCAAGAGGATTTTATAATCAATGGTGATGATTATCAAATAGTAAAAGG a909_ai1.seq

     AGATGGAGAGAGTTTTAAACTGTTTTCGGATAGAAAAGTTCCTGTTACTG Majority
               8160      8170      8180      8190      8200
8144 AGATGGAGAGAGTTTTAAACTGTTTTCGGATAGAAAAGTTCCTGTTACTG 2603_ai1.seq
7917 AGATGGAGAGAGTTTTAAACTGTTTTCGGATAGAAAAGTTCCTGTTACTG 18rs21_ai1.seq
8149 AGATGGAGAGAGTTTTAAACTGTTTTCGGATAGAAAAGTTCCTGTTACTG coh1_ai1.seq
8149 AGATGGAGAGAGTTTTAAACTGTTTTCGGATAGAAAAGTTCCTGTTACTG cjb111_ai1.seq
8151 AGATGGAGAGAGTTTTAAACTGTTTTCGGATAGAAAAGTTCCTGTTACTG nem316_ai1.seq
8150 AGATGGAGAGAGTTTTAAACTGTTTTCGGATAGAAAAGTTCCTGTTACTG a909_ai1.seq

     GAGGAACGACACAAGCAGCTTATCGAGTACCGCAAAATCAACTCTCTGTA Majority
               8210      8220      8230      8240      8250
8194 GAGGAACGACACAAGCAGCTTATCGAGTACCGCAAAATCAACTCTCTGTA 2603_ai1.seq
7967 GAGGAACGACACAAGCAGCTTATCGAGTACCGCAAAATCAACTCTCTGTA 18rs21_ai1.seq
8199 GAGGAACGACACAAGCAGCTTATCGAGTACCGCAAAATCAACTCTCTGTA coh1_ai1.seq
8199 GAGGAACGACACAAGCAGCTTATCGAGTACCGCAAAATCAACTCTCTGTA cjb111_ai1.seq
8201 GAGGAACGACACAAGCAGCTTATCGAGTACCGCAAAATCAACTCTCTGTA nem316_ai1.seq
8200 GAGGAACGACACAAGCAGCTTATCGAGTACCGCAAAATCAACTCTCTGTA a909_ai1.seq

     ATGAGTAATGAGGGATATGCAATTAATAGTGGATATATTTATCTCTATTG Majority
               8260      8270      8280      8290      8300
8244 ATGAGTAATGAGGGATATGCAATTAATAGTGGATATATTTATCTCTATTG 2603_ai1.seq
8017 ATGAGTAATGAGGGATATGCAATTAATAGTGGATATATTTATCTCTATTG 18rs21_ai1.seq
8249 ATGAGTAATGAGGGATATGCAATTAATAGTGGATATATTTATCTCTATTG coh1_ai1.seq
8249 ATGAGTAATGAGGGATATGCAATTAATAGTGGATATATTTATCTCTATTG cjb111_ai1.seq
8251 ATGAGTAATGAGGGATATGCAATTAATAGTGGATATATTTATCTCTATTG nem316_ai1.seq
8250 ATGAGTAATGAGGGATATGCAATTAATAGTGGATATATTTATCTCTATTG a909_ai1.seq

     GAGAGATTACAACTGGGTCTATCCATTTGATCCTAAGACAAAGAAAGTTT Majority
               8310      8320      8330      8340      8350
8294 GAGAGATTACAACTGGGTCTATCCATTTGATCCTAAGACAAAGAAAGTTT 2603_ai1.seq
8067 GAGAGATTACAACTGGGTCTATCCATTTGATCCTAAGACAAAGAAAGTTT 18rs21_ai1.seq
8299 GAGAGATTACAACTGGGTCTATCCATTTGATCCTAAGACAAAGAAAGTTT coh1_ai1.seq
8299 GAGAGATTACAACTGGGTCTATCCATTTGATCCTAAGACAAAGAAAGTTT cjb111_ai1.seq
8301 GAGAGATTACAACTGGGTCTATCCATTTGATCCTAAGACAAAGAAAGTTT nem316_ai1.seq
8300 GAGAGATTACAACTGGGTCTATCCATTTGATCCTAAGACAAAGAAAGTTT a909_ai1.seq

     CTGCAACGAAACAAATCAAAACTCATGGTGAGCCAACAACATTATACTTT Majority
               8360      8370      8380      8390      8400
8344 CTGCAACGAAACAAATCAAAACTCATGGTGAGCCAACAACATTATACTTT 2603_ai1.seq
8117 CTGCAACGAAACAAATCAAAACTCATGGTGAGCCAACAACATTATACTTT 18rs21_ai1.seq
8349 CTGCAACGAAACAAATCAAAACTCATGGTGAGCCAACAACATTATACTTT coh1_ai1.seq
8349 CTGCAACGAAACAAATCAAAACTCATGGTGAGCCAACAACATTATACTTT cjb111_ai1.seq
8351 CTGCAACGAAACAAATCAAAACTCATGGTGAGCCAACAACATTATACTTT nem316_ai1.seq
8350 CTGCAACGAAACAAATCAAAACTCATGGTGAGCCAACAACATTATACTTT a909_ai1.seq
```

FIGURE 18Y

Alignment Report of AI-1_alignment, using J. Hein method with Weighted residue weight table.
Thursday, July 29, 2004 5:46 PM

```
     A A T G G A A A T A T A A G A C C T A A A G G T T A T G A C A T T T T T A C T G T T G G G A T T G G Majority
                       8410                8420                8430                8440                8450
8394 A A T G G A A A T A T A A G A C C T A A A G G T T A T G A C A T T T T T A C T G T T G G G A T T G G 2603_ai1.seq
8167 A A T G G A A A T A T A A G A C C T A A A G G T T A T G A C A T T T T T A C T G T T G G G A T T G G 18rs21_ai1.seq
8399 A A T G G A A A T A T A A G A C C T A A A G G T T A T G A C A T T T T T A C T G T T G G G A T T G G coh1_ai1.seq
8399 A A T G G A A A T A T A A G A C C T A A A G G T T A T G A C A T T T T T A C T G T T G G G A T T G G cjb111_ai1.seq
8401 A A T G G A A A T A T A A G A C C T A A A G G T T A T G A C A T T T T T A C T G T T G G G A T T G G nem316_ai1.seq
8400 A A T G G A A A T A T A A G A C C T A A A G G T T A T G A C A T T T T T A C T G T T G G G A T T G G a909_ai1.seq

     T G T A A A C G G A G A T C C T G G T G C A A C T C C T C T T G A A G C T G A G A A A T T T A T G C Majority
                       8460                8470                8480                8490                8500
8444 T G T A A A C G G A G A T C C T G G T G C A A C T C C T C T T G A A G C T G A G A A A T T T A T G C 2603_ai1.seq
8217 T G T A A A C G G A G A T C C T G G T G C A A C T C C T C T T G A A G C T G A G A A A T T T A T G C 18rs21_ai1.seq
8449 T G T A A A C G G A G A T C C T G G T G C A A C T C C T C T T G A A G C T G A G A A A T T T A T G C coh1_ai1.seq
8449 T G T A A A C G G A G A T C C T G G T G C A A C T C C T C T T G A A G C T G A G A A A T T T A T G C cjb111_ai1.seq
8451 T G T A A A C G G A G A T C C T G G T G C A A C T C C T C T T G A A G C T G A G A A A T T T A T G C nem316_ai1.seq
8450 T G T A A A C G G A G A T C C T G G T G C A A C T C C T C T T G A A G C T G A G A A A T T T A T G C a909_ai1.seq

     A A T C A A T A T C A A G T A A A A C A G A A A A T T A T A C T A A T G T T G A T G A T A C A A A T Majority
                       8510                8520                8530                8540                8550
8494 A A T C A A T A T C A A G T A A A A C A G A A A A T T A T A C T A A T G T T G A T G A T A C A A A T 2603_ai1.seq
8267 A A T C A A T A T C A A G T A A A A C A G A A A A T T A T A C T A A T G T T G A T G A T A C A A A T 18rs21_ai1.seq
8499 A A T C A A T A T C A A G T A A A A C A G A A A A T T A T A C T A A T G T T G A T G A T A C A A A T coh1_ai1.seq
8499 A A T C A A T A T C A A G T A A A A C A G A A A A T T A T A C T A A T G T T G A T G A T A C A A A T cjb111_ai1.seq
8501 A A T C A A T A T C A A G T A A A A C A G A A A A T T A T A C T A A T G T T G A T G A T A C A A A T nem316_ai1.seq
8500 A A T C A A T A T C A A G T A A A A C A G A A A A T T A T A C T A A T G T T G A T G A T A C A A A T a909_ai1.seq

     A A A A T T T A T G A T G A G C T A A A T A A A T A C T T T A A A A C A A T T G T T G A G G A A A A Majority
                       8560                8570                8580                8590                8600
8544 A A A A T T T A T G A T G A G C T A A A T A A A T A C T T T A A A A C A A T T G T T G A G G A A A A 2603_ai1.seq
8317 A A A A T T T A T G A T G A G C T A A A T A A A T A C T T T A A A A C A A T T G T T G A G G A A A A 18rs21_ai1.seq
8549 A A A A T T T A T G A T G A G C T A A A T A A A T A C T T T A A A A C A A T T G T T G A G G A A A A coh1_ai1.seq
8549 A A A A T T T A T G A T G A G C T A A A T A A A T A C T T T A A A A C A A T T G T T G A G G A A A A cjb111_ai1.seq
8551 A A A A T T T A T G A T G A G C T A A A T A A A T A C T T T A A A A C A A T T G T T G A G G A A A A nem316_ai1.seq
8550 A A A A T T T A T G A T G A G C T A A A T A A A T A C T T T A A A A C A A T T G T T G A G G A A A A a909_ai1.seq

     A C A T T C T A T T G T T G A T G G A A A T G T G A C T G A T C C T A T G G G A G A G A T G A T T G Majority
                       8610                8620                8630                8640                8650
8594 A C A T T C T A T T G T T G A T G G A A A T G T G A C T G A T C C T A T G G G A G A G A T G A T T G 2603_ai1.seq
8367 A C A T T C T A T T G T T G A T G G A A A T G T G A C T G A T C C T A T G G G A G A G A T G A T T G 18rs21_ai1.seq
8599 A C A T T C T A T T G T T G A T G G A A A T G T G A C T G A T C C T A T G G G A G A G A T G A T T G coh1_ai1.seq
8599 A C A T T C T A T T G T T G A T G G A A A T G T G A C T G A T C C T A T G G G A G A G A T G A T T G cjb111_ai1.seq
8601 A C A T T C T A T T G T T G A T G G A A A T G T G A C T G A T C C T A T G G G A G A G A T G A T T G nem316_ai1.seq
8600 A C A T T C T A T T G T T G A T G G A A A T G T G A C T G A T C C T A T G G G A G A G A T G A T T G a909_ai1.seq

     A A T T C C A A T T A A A A A A T G G T C A A A G T T T T A C A C A T G A T G A T T A C G T T T T G Majority
                       8660                8670                8680                8690                8700
8644 A A T T C C A A T T A A A A A A T G G T C A A A G T T T T A C A C A T G A T G A T T A C G T T T T G 2603_ai1.seq
8417 A A T T C C A A T T A A A A A A T G G T C A A A G T T T T A C A C A T G A T G A T T A C G T T T T G 18rs21_ai1.seq
8649 A A T T C C A A T T A A A A A A T G G T C A A A G T T T T A C A C A T G A T G A T T A C G T T T T G coh1_ai1.seq
8649 A A T T C C A A T T A A A A A A T G G T C A A A G T T T T A C A C A T G A T G A T T A C G T T T T G cjb111_ai1.seq
8651 A A T T C C A A T T A A A A A A T G G T C A A A G T T T T A C A C A T G A T G A T T A C G T T T T G nem316_ai1.seq
8650 A A T T C C A A T T A A A A A A T G G T C A A A G T T T T A C A C A T G A T G A T T A C G T T T T G a909_ai1.seq

     G T T G G A A A T G A T G G C A G T C A A T T A A A A A A T G G T G T G G C T C T T G G T G G A C C Majority
                       8710                8720                8730                8740                8750
8694 G T T G G A A A T G A T G G C A G T C A A T T A A A A A A T G G T G T G G C T C T T G G T G G A C C 2603_ai1.seq
8467 G T T G G A A A T G A T G G C A G T C A A T T A A A A A A T G G T G T G G C T C T T G G T G G A C C 18rs21_ai1.seq
8699 G T T G G A A A T G A T G G C A G T C A A T T A A A A A A T G G T G T G G C T C T T G G T G G A C C coh1_ai1.seq
8699 G T T G G A A A T G A T G G C A G T C A A T T A A A A A A T G G T G T G G C T C T T G G T G G A C C cjb111_ai1.seq
8701 G T T G G A A A T G A T G G C A G T C A A T T A A A A A A T G G T G T G G C T C T T G G T G G A C C nem316_ai1.seq
8700 G T T G G A A A T G A T G G C A G T C A A T T A A A A A A T G G T G T G G C T C T T G G T G G A C C a909_ai1.seq
```

FIGURE 18Z

Alignment Report of AI-1_alignment, using J. Hein method with Weighted residue weight table.
Thursday, July 29, 2004 5:46 PM

```
                    A A A C A G T G A T G G G G G A A T T T T A A A A G A T G T T A C A G T G A C T T A T G A T A A G A  Majority
                                  8760              8770              8780              8790              8800
8744                A A A C A G T G A T G G G G G A A T T T T A A A A G A T G T T A C A G T G A C T T A T G A T A A G A  2603_ai1.seq
8517                A A A C A G T G A T G G G G G A A T T T T A A A A G A T G T T A C A G T G A C T T A T G A T A A G A  18rs21_ai1.seq
8749                A A A C A G T G A T G G G G G A A T T T T A A A A G A T G T T A C A G T G A C T T A T G A T A A G A  coh1_ai1.seq
8749                A A A C A G T G A T G G G G G A A T T T T A A A A G A T G T T A C A G T G A C T T A T G A T A A G A  cjb111_ai1.seq
8751                A A A C A G T G A T G G G G G A A T T T T A A A A G A T G T T A C A G T G A C T T A T G A T A A G A  nem316_ai1.seq
8750                A A A C A G T G A T G G G G G A A T T T T A A A A G A T G T T A C A G T G A C T T A T G A T A A G A  a909_ai1.seq

                    C A T C T C A A A C C A T C A A A A T C A A T C A T T T G A A C T T A G G A A G T G G A C A A A A A  Majority
                                  8810              8820              8830              8840              8850
8794                C A T C T C A A A C C A T C A A A A T C A A T C A T T T G A A C T T A G G A A G T G G A C A A A A A  2603_ai1.seq
8567                C A T C T C A A A C C A T C A A A A T C A A T C A T T T G A A C T T A G G A A G T G G A C A A A A A  18rs21_ai1.seq
8799                C A T C T C A A A C C A T C A A A A T C A A T C A T T T G A A C T T A G G A A G T G G A C A A A A A  coh1_ai1.seq
8799                C A T C T C A A A C C A T C A A A A T C A A T C A T T T G A A C T T A G G A A G T G G A C A A A A A  cjb111_ai1.seq
8801                C A T C T C A A A C C A T C A A A A T C A A T C A T T T G A A C T T A G G A A G T G G A C A A A A A  nem316_ai1.seq
8800                C A T C T C A A A C C A T C A A A A T C A A T C A T T T G A A C T T A G G A A G T G G A C A A A A A  a909_ai1.seq

                    G T A G T T C T T A C C T A T G A T G T A C G T T T A A A A G A T A A C T A T A T A A G T A A C A A  Majority
                                  8860              8870              8880              8890              8900
8844                G T A G T T C T T A C C T A T G A T G T A C G T T T A A A A G A T A A C T A T A T A A G T A A C A A  2603_ai1.seq
8617                G T A G T T C T T A C C T A T G A T G T A C G T T T A A A A G A T A A C T A T A T A A G T A A C A A  18rs21_ai1.seq
8849                G T A G T T C T T A C C T A T G A T G T A C G T T T A A A A G A T A A C T A T A T A A G T A A C A A  coh1_ai1.seq
8849                G T A G T T C T T A C C T A T G A T G T A C G T T T A A A A G A T A A C T A T A T A A G T A A C A A  cjb111_ai1.seq
8851                G T A G T T C T T A C C T A T G A T G T A C G T T T A A A A G A T A A C T A T A T A A G T A A C A A  nem316_ai1.seq
8850                G T A G T T C T T A C C T A T G A T G T A C G T T T A A A A G A T A A C T A T A T A A G T A A C A A  a909_ai1.seq

                    A T T T T A C A A T A C A A A T A A T C G T A C A A C G C T A A G T C C G A A G A G T G A A A A A G  Majority
                                  8910              8920              8930              8940              8950
8894                A T T T T A C A A T A C A A A T A A T C G T A C A A C G C T A A G T C C G A A G A G T G A A A A A G  2603_ai1.seq
8667                A T T T T A C A A T A C A A A T A A T C G T A C A A C G C T A A G T C C G A A G A G T G A A A A A G  18rs21_ai1.seq
8899                A T T T T A C A A T A C A A A T A A T C G T A C A A C G C T A A G T C C G A A G A G T G A A A A A G  coh1_ai1.seq
8899                A T T T T A C A A T A C A A A T A A T C G T A C A A C G C T A A G T C C G A A G A G T G A A A A A G  cjb111_ai1.seq
8901                A T T T T A C A A T A C A A A T A A T C G T A C A A C G C T A A G T C C G A A G A G T G A A A A A G  nem316_ai1.seq
8900                A T T T T A C A A T A C A A A T A A T C G T A C A A C G C T A A G T C C G A A G A G T G A A A A A G  a909_ai1.seq

                    A A C C A A A T A C T A T T C G T G A T T T C C C A A T T C C C A A A A T T C G T G A T G T T C G T  Majority
                                  8960              8970              8980              8990              9000
8944                A A C C A A A T A C T A T T C G T G A T T T C C C A A T T C C C A A A A T T C G T G A T G T T C G T  2603_ai1.seq
8717                A A C C A A A T A C T A T T C G T G A T T T C C C A A T T C C C A A A A T T C G T G A T G T T C G T  18rs21_ai1.seq
8949                A A C C A A A T A C T A T T C G T G A T T T C C C A A T T C C C A A A A T T C G T G A T G T T C G T  coh1_ai1.seq
8949                A A C C A A A T A C T A T T C G T G A T T T C C C A A T T C C C A A A A T T C G T G A T G T T C G T  cjb111_ai1.seq
8951                A A C C A A A T A C T A T T C G T G A T T T C C C A A T T C C C A A A A T T C G T G A T G T T C G T  nem316_ai1.seq
8950                A A C C A A A T A C T A T T C G T G A T T T C C C A A T T C C C A A A A T T C G T G A T G T T C G T  a909_ai1.seq

                    G A G T T T C C G G T A C T A A C C A T C A G T A A T C A G A A G A A A A T G G G T G A G G T T G A  Majority
                                  9010              9020              9030              9040              9050
8994                G A G T T T C C G G T A C T A A C C A T C A G T A A T C A G A A G A A A A T G G G T G A G G T T G A  2603_ai1.seq
8767                G A G T T T C C G G T A C T A A C C A T C A G T A A T C A G A A G A A A A T G G G T G A G G T T G A  18rs21_ai1.seq
8999                G A G T T T C C G G T A C T A A C C A T C A G T A A T C A G A A G A A A A T G G G T G A G G T T G A  coh1_ai1.seq
8999                G A G T T T C C G G T A C T A A C C A T C A G T A A T C A G A A G A A A A T G G G T G A G G T T G A  cjb111_ai1.seq
9001                G A G T T T C C G G T A C T A A C C A T C A G T A A T C A G A A G A A A A T G G G T G A G G T T G A  nem316_ai1.seq
9000                G A G T T T C C G G T A C T A A C C A T C A G T A A T C A G A A G A A A A T G G G T G A G G T T G A  a909_ai1.seq

                    A T T T A T T A A A G T T A A T A A A G A C A A A C A T T C A G A A T C G C T T T T G G G A G C T A  Majority
                                  9060              9070              9080              9090              9100
9044                A T T T A T T A A A G T T A A T A A A G A C A A A C A T T C A G A A T C G C T T T T G G G A G C T A  2603_ai1.seq
8817                A T T T A T T A A A G T T A A T A A A G A C A A A C A T T C A G A A T C G C T T T T G G G A G C T A  18rs21_ai1.seq
9049                A T T T A T T A A A G T T A A T A A A G A C A A A C A T T C A G A A T C G C T T T T G G G A G C T A  coh1_ai1.seq
9049                A T T T A T T A A A G T T A A T A A A G A C A A A C A T T C A G A A T C G C T T T T G G G A G C T A  cjb111_ai1.seq
9051                A T T T A T T A A A G T T A A T A A A G A C A A A C A T T C A G A A T C G C T T T T G G G A G C T A  nem316_ai1.seq
9050                A T T T A T T A A A G T T A A T A A A G A C A A A C A T T C A G A A T C G C T T T T G G G A G C T A  a909_ai1.seq
```

FIGURE 18AA

Alignment Report of AI-1_alignment, using J. Hein method with Weighted residue weight table.
Thursday, July 29, 2004 5:46 PM

```
     A G T T T C A A C T T C A G A T A G A A A A A G A T T T T T C T G G G T A T A A G C A A T T T G T T Majority
                   9110                9120                9130                9140                9150
9094 A G T T T C A A C T T C A G A T A G A A A A A G A T T T T T C T G G G T A T A A G C A A T T T G T T 2603_ai1.seq
8867 A G T T T C A A C T T C A G A T A G A A A A A G A T T T T T C T G G G T A T A A G C A A T T T G T T 18rs21_ai1.seq
9099 A G T T T C A A C T T C A G A T A G A A A A A G A T T T T T C T G G G T A T A A G C A A T T T G T T coh1_ai1.seq
9099 A G T T T C A A C T T C A G A T A G A A A A A G A T T T T T C T G G G T A T A A G C A A T T T G T T cjb111_ai1.seq
9101 A G T T T C A A C T T C A G A T A G A A A A A G A T T T T T C T G G G T A T A A G C A A T T T G T T nem316_ai1.seq
9100 A G T T T C A A C T T C A G A T A G A A A A A G A T T T T T C T G G G T A T A A G C A A T T T G T T a909_ai1.seq

     C C A G A G G G A A G T G A T G T T A C A A C A A A G A A T G A T G G T A A A A T T T A T T T T A A Majority
                   9160                9170                9180                9190                9200
9144 C C A G A G G G A A G T G A T G T T A C A A C A A A G A A T G A T G G T A A A A T T T A T T T T A A 2603_ai1.seq
8917 C C A G A G G G A A G T G A T G T T A C A A C A A A G A A T G A T G G T A A A A T T T A T T T T A A 18rs21_ai1.seq
9149 C C A G A G G G A A G T G A T G T T A C A A C A A A G A A T G A T G G T A A A A T T T A T T T T A A coh1_ai1.seq
9149 C C A G A G G G A A G T G A T G T T A C A A C A A A G A A T G A T G G T A A A A T T T A T T T T A A cjb111_ai1.seq
9151 C C A G A G G G A A G T G A T G T T A C A A C A A A G A A T G A T G G T A A A A T T T A T T T T A A nem316_ai1.seq
9150 C C A G A G G G A A G T G A T G T T A C A A C A A A G A A T G A T G G T A A A A T T T A T T T T A A a909_ai1.seq

     A G C A C T T C A A G A T G G T A A C T A T A A A T T A T A T G A A A T T T C A A G T C C A G A T G Majority
                   9210                9220                9230                9240                9250
9194 A G C A C T T C A A G A T G G T A A C T A T A A A T T A T A T G A A A T T T C A A G T C C A G A T G 2603_ai1.seq
8967 A G C A C T T C A A G A T G G T A A C T A T A A A T T A T A T G A A A T T T C A A G T C C A G A T G 18rs21_ai1.seq
9199 A G C A C T T C A A G A T G G T A A C T A T A A A T T A T A T G A A A T T T C A A G T C C A G A T G coh1_ai1.seq
9199 A G C A C T T C A A G A T G G T A A C T A T A A A T T A T A T G A A A T T T C A A G T C C A G A T G cjb111_ai1.seq
9201 A G C A C T T C A A G A T G G T A A C T A T A A A T T A T A T G A A A T T T C A A G T C C A G A T G nem316_ai1.seq
9200 A G C A C T T C A A G A T G G T A A C T A T A A A T T A T A T G A A A T T T C A A G T C C A G A T G a909_ai1.seq

     G C T A T A T A G A G G T T A A A A C G A A A C C T G T T G T G A C A T T T A C A A T T C A A A A T Majority
                   9260                9270                9280                9290                9300
9244 G C T A T A T A G A G G T T A A A A C G A A A C C T G T T G T G A C A T T T A C A A T T C A A A A T 2603_ai1.seq
9017 G C T A T A T A G A G G T T A A A A C G A A A C C T G T T G T G A C A T T T A C A A T T C A A A A T 18rs21_ai1.seq
9249 G C T A T A T A G A G G T T A A A A C G A A A C C T G T T G T G A C A T T T A C A A T T C A A A A T coh1_ai1.seq
9249 G C T A T A T A G A G G T T A A A A C G A A A C C T G T T G T G A C A T T T A C A A T T C A A A A T cjb111_ai1.seq
9251 G C T A T A T A G A G G T T A A A A C G A A A C C T G T T G T G A C A T T T A C A A T T C A A A A T nem316_ai1.seq
9250 G C T A T A T A G A G G T T A A A A C G A A A C C T G T T G T G A C A T T T A C A A T T C A A A A T a909_ai1.seq

     G G A G A A G T T A C G A A C C T G A A A G C A G A T C C A A A T G C T A A T A A A A A T C A A A T Majority
                   9310                9320                9330                9340                9350
9294 G G A G A A G T T A C G A A C C T G A A A G C A G A T C C A A A T G C T A A T A A A A A T C A A A T 2603_ai1.seq
9067 G G A G A A G T T A C G A A C C T G A A A G C A G A T C C A A A T G C T A A T A A A A A T C A A A T 18rs21_ai1.seq
9299 G G A G A A G T T A C G A A C C T G A A A G C A G A T C C A A A T G C T A A T A A A A A T C A A A T coh1_ai1.seq
9299 G G A G A A G T T A C G A A C C T G A A A G C A G A T C C A A A T G C T A A T A A A A A T C A A A T cjb111_ai1.seq
9301 G G A G A A G T T A C G A A C C T G A A A G C A G A T C C A A A T G C T A A T A A A A A T C A A A T nem316_ai1.seq
9300 G G A G A A G T T A C G A A C C T G A A A G C A G A T C C A A A T G C T A A T A A A A A T C A A A T a909_ai1.seq

     C G G G T A T C T T G A A G G A A A T G G T A A A C A T C T T A T T A C C A A C A C T C C C A A A C Majority
                   9360                9370                9380                9390                9400
9344 C G G G T A T C T T G A A G G A A A T G G T A A A C A T C T T A T T A C C A A C A C T C C C A A A C 2603_ai1.seq
9117 C G G G T A T C T T G A A G G A A A T G G T A A A C A T C T T A T T A C C A A C A C T C C C A A A C 18rs21_ai1.seq
9349 C G G G T A T C T T G A A G G A A A T G G T A A A C A T C T T A T T A C C A A C A C T C C C A A A C coh1_ai1.seq
9349 C G G G T A T C T T G A A G G A A A T G G T A A A C A T C T T A T T A C C A A C A C T C C C A A A C cjb111_ai1.seq
9351 C G G G T A T C T T G A A G G A A A T G G T A A A C A T C T T A T T A C C A A C A C T C C C A A A C nem316_ai1.seq
9350 C G G G T A T C T T G A A G G A A A T G G T A A A C A T C T T A T T A C C A A C A C T C C C A A A C a909_ai1.seq

     G C C C A C C A G G T G T T T T T C C T A A A A C A G G G G G A A T T G G T A C A A T T G T C T A T Majority
                   9410                9420                9430                9440                9450
9394 G C C C A C C A G G T G T T T T T C C T A A A A C A G G G G G A A T T G G T A C A A T T G T C T A T 2603_ai1.seq
9167 G C C C A C C A G G T G T T T T T C C T A A A A C A G G G G G A A T T G G T A C A A T T G T C T A T 18rs21_ai1.seq
9399 G C C C A C C A G G T G T T T T T C C T A A A A C A G G G G G A A T T G G T A C A A T T G T C T A T coh1_ai1.seq
9399 G C C C A C C A G G T G T T T T T C C T A A A A C A G G G G G A A T T G G T A C A A T T G T C T A T cjb111_ai1.seq
9401 G C C C A C C A G G T G T T T T T C C T A A A A C A G G G G G A A T T G G T A C A A T T G T C T A T nem316_ai1.seq
9400 G C C C A C C A G G T G T T T T T C C T A A A A C A G G G G G A A T T G G T A C A A T T G T C T A T a909_ai1.seq
```

FIGURE 18AB

Alignment Report of AI-1_alignment, using J. Hein method with Weighted residue weight table.
Thursday, July 29, 2004 5:46 PM

```
     A T A T T A G T T G G T T C T A C T T T T A T G A T A C T T A C C A T T T G T T C T T T C C G T C G Majority
                         9460                9470                9480                9490                9500
9444 A T A T T A G T T G G T T C T A C T T T T A T G A T A C T T A C C A T T T G T T C T T T C C G T C G 2603_ai1.seq
9217 A T A T T A G T T G G T T C T A C T T T T A T G A T A C T T A C C A T T T G T T C T T T C C G T C G 18rs21_ai1.seq
9449 A T A T T A G T T G G T T C T A C T T T T A T G A T A C T T A C C A T T T G T T C T T T C C G T C G coh1_ai1.seq
9449 A T A T T A G T T G G T T C T A C T T T T A T G A T A C T T A C C A T T T G T T C T T T C C G T C G cjb111_ai1.seq
9451 A T A T T A G T T G G T T C T A C T T T T A T G A T A C T T A C C A T T T G T T C T T T C C G T C G nem316_ai1.seq
9450 A T A T T A G T T G G T T C T A C T T T T A T G A T A C T T A C C A T T T G T T C T T T C C G T C G a909_ai1.seq

     T A A A C A A T T G T A A G G T G T C G T T G A A A T T A T T A A A T A A T A G A A A A T G A C T A Majority
                         9510                9520                9530                9540                9550
9494 T A A A C A A T T G T A A G G T G T C G T T G A A A T T A T T A A A T A A T A G A A A A T G A C T A 2603_ai1.seq
9267 T A A A C A A T T G T A A G G T G T C G T T G A A A T T A T T A A A T A A T A G A A A A T G A C T A 18rs21_ai1.seq
9499 T A A A C A A T T G T A A G G T G T C G T T G A A A T T A T T A A A T A A T A G A A A A T G A C T A coh1_ai1.seq
9499 T A A A C A A T T G T A A G G T G T C G T T G A A A T T A T T A A A T A A T A G A A A A T G A C T A cjb111_ai1.seq
9501 T A A A C A A T T G T A A G G T G T C G T T G A A A T T A T T A A A T A A T A G A A A A T G A C T A nem316_ai1.seq
9500 T A A A C A A T T G T A A G G T G T C G T T G A A A T T A T T A A A T A A T A G A A A A T G A C T A a909_ai1.seq

     G T T T T G G C C T T T C C C T A T T G T C A G T C A G A T T A G T T A T T A T C A A G C T T C T C Majority
                         9560                9570                9580                9590                9600
9544 G T T T T G G C C T T T C C C T A T T G T C A G T C A G A T T A G T T A T T A T C A A G C T T C T C 2603_ai1.seq
9317 G T T T T G G C C T T T C C C T A T T G T C A G T C A G A T T A G T T A T T A T C A A G C T T C T C 18rs21_ai1.seq
9549 G T T T T G G C C T T T C C C T A T T G T C A G T C A G A T T A G T T A T T A T C A A G C T T C T C coh1_ai1.seq
9549 G T T T T G G C C T T T C C C T A T T G T C A G T C A G A T T A G T T A T T A T C A A G C T T C T C cjb111_ai1.seq
9551 G T T T T G G C C T T T C C C T A T T G T C A G T C A G A T T A G T T A T T A T C A A G C T T C T C nem316_ai1.seq
9550 G T T T T G G C C T T T C C C T A T T G T C A G T C A G A T T A G T T A T T A T C A A G C T T C T C a909_ai1.seq

     A T G C C A A T A T T A A T G C C T T T A A A A G A A C A G T T A C A A C C A T T G A C C G T A C G Majority
                         9610                9620                9630                9640                9650
9594 A T G C C A A T A T T A A T G C C T T T A A A A G A A C A G T T A C A A C C A T T G A C C G T A C G 2603_ai1.seq
9367 A T G C C A A T A T T A A T G C C T T T A A A A G A A C A G T T A C A A C C A T T G A C C G T A C G 18rs21_ai1.seq
9599 A T G C C A A T A T T A A T G C C T T T A A A A G A A C A G T T A C A A C C A T T G A C C G T A C G coh1_ai1.seq
9599 A T G C C A A T A T T A A T G C C T T T A A A A G A A C A G T T A C A A C C A T T G A C C G T A C G cjb111_ai1.seq
9601 A T G C C A A T A T T A A T G C C T T T A A A A G A A C A G T T A C A A C C A T T G A C C G T A C G nem316_ai1.seq
9600 A T G C C A A T A T T A A T G C C T T T A A A A G A A C A G T T A C A A C C A T T G A C C G T A C G a909_ai1.seq

     G A G A T T C A A C G A C G G T T A G G T C T G G C T A A A G C C T A C A A T G C T A G T A T T T C Majority
                         9660                9670                9680                9690                9700
9644 G A G A T T C A A C G A C G G T T A G G T C T G G C T A A A G C C T A C A A T G C T A G T A T T T C 2603_ai1.seq
9417 G A G A T T C A A C G A C G G T T A G G T C T G G C T A A A G C C T A C A A T G C T A G T A T T T C 18rs21_ai1.seq
9649 G A G A T T C A A C G A C G G T T A G G T C T G G C T A A A G C C T A C A A T G C T A G T A T T T C coh1_ai1.seq
9649 G A G A T T C A A C G A C G G T T A G G T C T G G C T A A A G C C T A C A A T G C T A G T A T T T C cjb111_ai1.seq
9651 G A G A T T C A A C G A C G G T T A G G T C T G T C T A A A G C C T A C A A T G C T A G T A T T T C nem316_ai1.seq
9650 G A G A T T C A A C G A C G G T T A G G T C T G G C T A A A G C C T A C A A T G C T A G T A T T T C a909_ai1.seq

     T G G A A C A A G T A G T C A G T C G A C T C A A T C T G T G C T G A G A G A T T C T T A T T C T G Majority
                         9710                9720                9730                9740                9750
9694 T G G A A C A A G T A G T C A G T C G A C T C A A T C T G T G C T G A G A G A T T C T T A T T C T G 2603_ai1.seq
9467 T G G A A C A A G T A G T C A G T C G A C T C A A T C T G T G C T G A G A G A T T C T T A T T C T G 18rs21_ai1.seq
9699 T G G A A C A A G T A G T C A G T C G A C T C A A T C T G T G C T G A G A G A T T C T T A T T C T G coh1_ai1.seq
9699 T G G A A C A A G T A G T C A G T C G A C T C A A T C T G T G C T G A G A G A T T C T T A T T C T G cjb111_ai1.seq
9701 T G G A A C A A G T A G T C A G T C G A C T C A A T C T G T G C T G A G A G A T T C T T A T T C T G nem316_ai1.seq
9700 T G G A A C A A G T A G T C A G T C G A C T C A A T C T G T G C T G A G A G A T T C T T A T T C T G a909_ai1.seq

     A G G A G C A A A A A A G G C A G G G T G G A C T G A A T A C G C T A G G A T G T T A G A A G T C A Majority
                         9760                9770                9780                9790                9800
9744 A G G A G C A A A A A A G G C A G G G T G G A C T G A A T A C G C T A G G A T G T T A G A A G T C A 2603_ai1.seq
9517 A G G A G C A A A A A A G G C A G G G T G G A C T G A A T A C G C T A G G A T G T T A G A A G T C A 18rs21_ai1.seq
9749 A G G A G C A A A A A A G G C A G G G T G G A C T G A A T A C G C T A G G A T G T T A G A A G T C A coh1_ai1.seq
9749 A G G A G C A A A A A A G G C A G G G T G G A C T G A A T A C G C T A G G A T G T T A G A A G T C A cjb111_ai1.seq
9751 A G G A G C A A A A A A G G C A G G G T G G A C T G A A T A C G C T A G G A T G T T A G A A G T C A nem316_ai1.seq
9750 A G G A G C A A A A A A G G C A G G G T G G A C T G A A T A C G C T A G G A T G T T A G A A G T C A a909_ai1.seq
```

FIGURE 18AC

Alignment Report of AI-1_alignment, using J. Hein method with Weighted residue weight table.
Thursday, July 29, 2004 5:46 PM

```
      GAGAGCAGGTTGACCATGTGATGATTCCAAAAATCAATCAGGATTTACCA Majority
              9810      9820      9830      9840      9850
9794  GAGAGCAGGTTGACCATGTGATGATTCCAAAAATCAATCAGGATTTACCA 2603_ai1.seq
9567  GAGAGCAGGTTGACCATGTGATGATTCCAAAAATCAATCAGGATTTACCA 18rs21_ai1.seq
9799  GAGAGCAGGTTGACCATGTGATGATTCCAAAAATCAATCAGGATTTACCA coh1_ai1.seq
9799  GAGAGCAGGTTGACCATGTGATGATTCCAAAAATCAATCAGGATTTACCA cjb111_ai1.seq
9801  GAGAGCAGGTTGACCATGTGATGATTCCAAAAATCAATCAGGATTTACCA nem316_ai1.seq
9800  GAGAGCAGGTTGACCATGTGATGATTCCAAAAATCAATCAGGATTTACCA a909_ai1.seq

      ATCTACGCTGGTTCAGAAGAGGACAATCTGCAACGGGGAGTTGGTCATCT Majority
              9860      9870      9880      9890      9900
9844  ATCTACGCTGGTTCAGAAGAGGACAATCTGCAACGGGGAGTTGGTCATCT 2603_ai1.seq
9617  ATCTACGCTGGTTCAGAAGAGGACAATCTGCAACGGGGAGTTGGTCATCT 18rs21_ai1.seq
9849  ATCTACGCTGGTTCAGAAGAGGACAATCTGCAACGGGGAGTTGGTCATCT coh1_ai1.seq
9849  ATCTACGCTGGTTCAGAAGAGGACAATCTGCAACGGGGAGTTGGTCATCT cjb111_ai1.seq
9851  ATCTACGCTGGTCCAGAAGAGGACAATCTGCAACGGGGAGTTGGTCATCT nem316_ai1.seq
9850  ATCTACGCTGGTTCAGAAGAGGACAATCTGCAACGGGGAGTTGGTCATCT a909_ai1.seq

      AGAAGGGATAAGTTTGCCGATTGGAGGGGCTTCTACACATGCGGTCTTGA Majority
              9910      9920      9930      9940      9950
9894  AGAAGGGATAAGTTTGCCGATTGGAGGGGCTTCTACACATGCGGTCTTGA 2603_ai1.seq
9667  AGAAGGGATAAGTTTGCCGATTGGAGGGGCTTCTACACATGCGGTCTTGA 18rs21_ai1.seq
9899  AGAAGGGATAAGTTTGCCGATTGGAGGGGCTTCTACACATGCGGTCTTGA coh1_ai1.seq
9899  AGAAGGGATAAGTTTGCCGATTGGAGGGGCTTCTACACATGCGGTCTTGA cjb111_ai1.seq
9901  AGAAGGGATAAGTTTGCCGATTGGAGGGGCTTCTACACATGCGGTCTTGA nem316_ai1.seq
9900  AGAAGGGATAAGTTTGCCGATTGGAGGGGCTTCTACACATGCGGTCTTGA a909_ai1.seq

      GCGGTCAAAGAGGTATGCCAGCTGCTCGGTTGTTTGCGGATTTGGATAAG Majority
              9960      9970      9980      9990      10000
9944  GCGGTCAAAGAGGTATGCCAGCTGCTCGGTTGTTTGCGGATTTGGATAAG 2603_ai1.seq
9717  GCGGTCAAAGAGGTATGCCAGCTGCTCGGTTGTTTGCGGATTTGGATAAG 18rs21_ai1.seq
9949  GCGGTCAAAGAGGTATGCCAGCTGCTCGGTTGTTTGCGGATTTGGATAAG coh1_ai1.seq
9949  GCGGTCAAAGAGGTATGTCAGCTGCTCGGTTGTTTGCGGATTTGGATAAG cjb111_ai1.seq
9951  GCGGTCAAAGAGGTATGCCAGCTGCTCGGTTGTTTGCGGATTTGGATAAG nem316_ai1.seq
9950  GCGGTCAAAGAGGTATGTCAGCTGCTCGGTTGTTTGCGGATTTGGATAAG a909_ai1.seq

      ATGAAAAAAGGTGATTATTTTTATGTTACCAATCTGAAAGAAACCTTGGC Majority
              10010     10020     10030     10040     10050
9994  ATGAAAAAAGGTGATTATTTTTATGTTACCAATCTGAAAGAAACCTTGGC 2603_ai1.seq
9767  ATGAAAAAAGGTGATTATTTTTATGTTACCAATCTGAAAGAAACCTTGGC 18rs21_ai1.seq
9999  ATGAAAAAAGGTGATTATTTTTATGTTACCAATCTGAAAGAAACCTTGGC coh1_ai1.seq
9999  ATGAAAAAAGGTGATTATTTTTATGTTACCAATCTGAAAGAAACCTTGGC cjb111_ai1.seq
10001 ATGAAAAAAGGTGATTATTTTTATGTTACCAATCTGAAAGAAACCTTGGC nem316_ai1.seq
10000 ATGAAAAAAGGTGATTATTTTTATGTTACCAATCTGAAAGAAACCTTGGC a909_ai1.seq

      TTATCAAGTGGATCGTATCATGGTGATTGAACCTAGCCAATTGGATGCCG Majority
              10060     10070     10080     10090     10100
10044 TTATCAAGTGGATCGTATCATGGTGATTGAACCTAGCCAATTGGATGCCG 2603_ai1.seq
9817  TTATCAAGTGGATCGTATCATGGTGATTGAACCTAGCCAATTGGATGCCG 18rs21_ai1.seq
10049 TTATCAAGTGGATCGTATCATGGTGATTGAACCTAGCCAATTGGATGCCG coh1_ai1.seq
10049 TTATCAAGTGGATCGTATCATGGTGATTGAACCTAGCCAATTGGATGCCG cjb111_ai1.seq
10051 TTATCAAGTGGATCGTATCATGGTGATTGAACCTAGCCAATTGGATGCCG nem316_ai1.seq
10050 TTATCAAGTGGATCGTATCATGGTGATTGAACCTAGCCAATTGGATGCCG a909_ai1.seq

      TGAGCATTGAAGAGGATAAAGATTATGTTACCCTTCTGACCTGTACACCT Majority
              10110     10120     10130     10140     10150
10094 TGAGCATTGAAGAGGATAAAGATTATGTTACCCTTCTGACCTGTACACCT 2603_ai1.seq
9867  TGAGCATTGAAGAGGATAAAGATTATGTTACCCTTCTGACCTGTACACCT 18rs21_ai1.seq
10099 TGAGCATTGAAGAGGATAAAGATTATGTTACCCTTCTGACCTGTACACCT coh1_ai1.seq
10099 TGAGCATTGAAGAGGATAAAGATTATGTTACCCTTCTGACCTGTACACCT cjb111_ai1.seq
10101 TGAGCATTGAAGAGGATAAAGATTATGTTACCCTTCTGACCTGTACACCT nem316_ai1.seq
10100 TGAGCATTGAAGAGGATAAAGATTATGTTACCCTTCTGACCTGTACACCT a909_ai1.seq
```

FIGURE 18AD

Alignment Report of AI-1_alignment, using J. Hein method with Weighted residue weight table.
Thursday, July 29, 2004 5:46 PM

```
      T A T A T G G G C T C T T T G T C A A C T G T A A T G G G T G A C T T A T C A T T A A C A A C G A G Majority
                10160               10170               10180               10190               10200
10144 T A T A T G G G C T C T T T G T C A A C T G T A A T G G G T G A C T T A T C A T T A A C A A C G A G 2603_ai1.seq
9917  T A T A T G G G C T C T T T G T C A A C T G T A A T G G G T G A C T T A T C A T T A A C A A C G A G 18rs21_ai1.seq
10149 T A T A T G G G C T C T T T G T C A A C T G T A A T G G G T G A C T T A T C A T T A A C A A C G A G coh1_ai1.seq
10149 T A T A T G G G C T C T T T G T C A A C T G T A A T G G G T G A C T T A T C A T T A A C A A C G A G cjb111_ai1.seq
10151 T A T A T G G G C T C T T T G T C A A C T G T A A T G G G T G A C T T A T C A T T A A C A A C G A G nem316_ai1.seq
10150 T A T A T G G G C T C T T T G T C A A C T G T A A T G G G T G A C T T A T C A T T A A C A A C G A G a909_ai1.seq

      A G A G A A T C A G C T T G G T T C T C T C T C T T T T T G G A T G T T C A A A G C G A T G A G A A Majority
                10210               10220               10230               10240               10250
10194 A G A G A A T C A G C T T G G T T C T C T C T C T T T T T G G A T G T T C A A A G C G A T G A G A A 2603_ai1.seq
9967  A G A G A A T C A G C T T G G T T C T C T C T C T T T T T G G A T G T T C A A A G C G A T G A G A A 18rs21_ai1.seq
10199 A G A G A A T C A G C T T G G T T C T C T C T C T T T T T G G A T G T T C A A A G C G A T G A G A A coh1_ai1.seq
10199 A G A G A A T C A G C T T G G T T C T C T C T C T T T T T G G A T G T T C A A A G C G A T G A G A A cjb111_ai1.seq
10201 A G A G A A T C A G C T T G G T T C T C T C T C T T T T T G G A T G T T C A A A G C G A T G A G A A nem316_ai1.seq
10200 A G A G A A T C A G C T T G G T T C T C T C T C T T T T T G G A T G T T C A A A G C G A T G A G A A a909_ai1.seq

      T T T T G C T T T T A A A A T T T T T A A A G T T G C G A A A G C C A A A G G C T T G T C G C T T G Majority
                10260               10270               10280               10290               10300
10244 T T T T G C T T T T A A A A T T T T T A A A G T T G C G A A A G C C A A A G G C T T G T C G C T T G 2603_ai1.seq
10017 T T T T G C T T T T A A A A T T T T T A A A G T T G C G A A A G C C A A A G G C T T G T C G C T T G 18rs21_ai1.seq
10249 T T T T G C T T T T A A A A T T T T T A A A G T T G C G A A A G C C A A A G G C T T G T C G C T T G coh1_ai1.seq
10249 T T T T G C T T T T A A A A T T T T T A A A G T T G C G A A A G C C A A A G G C T T G T C G C T T G cjb111_ai1.seq
10251 T T T T G C T T T T A A A A T T T T T A A A G T T G C G A A A G C C A A A G G C T T G T C G C T T G nem316_ai1.seq
10250 T T T T G C T T T T A A A A T T T T T A A A G T T G C G A A A G C C A A A G G C T T G T C G C T T G a909_ai1.seq

      A T G T C T T T G A T A A G C T T G T T G G T C G C T T C T A A T T T G G C A T T G G A A A G G G A Majority
                10310               10320               10330               10340               10350
10294 A T G T C T T T G A T A A G C T T G T T G G T C G C T T C T A A T T T G G C A T T G G A A A G G G A 2603_ai1.seq
10067 A T G T C T T T G A T A A G C T T G T T G G T C G C T T C T A A T T T G G C A T T G G A A A G G G A 18rs21_ai1.seq
10299 A T G T C T T T G A T A A G C T T G T T G G T C G C T T C T A A T T T G G C A T T G G A A A G G G A coh1_ai1.seq
10299 A T G T C T T T G A T A A G C T T G T T G G T C G C T T C T A A T T T G G C A T T G G A A A G G G A cjb111_ai1.seq
10301 A T G T C T T T G A T A A G C T T G T T G G T C G C T T C T A A T T T G G C A T T G G A A A G G G A nem316_ai1.seq
10300 A T G T C T T T G A T A A G C T T G T T G G T C G C T T C T A A T T T G G C A T T G G A A A G G G A a909_ai1.seq

      T A G C T G A G G G C G T T T G T G A T G T A A G T T T T G T A C T T C A T G A A G G T C C T A A A Majority
                10360               10370               10380               10390               10400
10344 T A G C T G A G G G C G T T T G T G A T G T A A G T T T T G T A C T T C A T G A A G G T C C T A A A 2603_ai1.seq
10117 T A G C T G A G G G C G T T T G T G A T G T A A G T T T T G T A C T T C A T G A A G G T C C T A A A 18rs21_ai1.seq
10349 T A G C T G A G G G C G T T T G T G A T G T A A G T T T T G T A C T T C A T G A A G G T C C T A A A coh1_ai1.seq
10349 T A G C T G A G G G C G T T T G T G A T G T A A G T T T T G T A C T T C A T G A A G G T C C T A A A cjb111_ai1.seq
10351 T A G C T G A G G G C G T T T G T G A T G T A A G T T T T G T A C T T C A T G A A G G T C C T A A A nem316_ai1.seq
10350 T A G C T G A G G G C G T T T G T G A T G T A A G T T T T G T A C T T C A T G A A G G T C C T A A A a909_ai1.seq

      G A C C A T T T T A A A A G C A G A A T T G C C A G T T G T T A C G T T A T C A T C T A T G A A G C Majority
                10410               10420               10430               10440               10450
10394 G A C C A T T T T A A A A G C A G A A T T G C C A G T T G T T A C G T T A T C A T C T A T G A A G C 2603_ai1.seq
10167 G A C C A T T T T A A A A G C A G A A T T G C C A G T T G T T A C G T T A T C A T C T A T G A A G C 18rs21_ai1.seq
10399 G A C C A T T T T A A A A G C A G A A T T G C C A G T T G T T A C G T T A T C A T C T A T G A A G C coh1_ai1.seq
10399 G A C C A T T T T A A A A G C A G A A T T G C C A G T T G T T A C G T T A T C A T C T A T G A A G C cjb111_ai1.seq
10401 G A C C A T T T T A A A A G C A G A A T T G C C A G T T G T T A C G T T A T C A T C T A T G A A G C nem316_ai1.seq
10400 G A C C A T T T T A A A A G C A G A A T T G C C A G T T G T T A C G T T A T C A T C T A T G A A G C a909_ai1.seq

      T A A A G A A T T C A G T T G T T C G C T T T T C T T A G A A A T G A A A G A G T A T G A G C T G A Majority
                10460               10470               10480               10490               10500
10444 T A A A G A A T T C A G T T G T T C G C T T T T C T T A G A A A T G A A A G A G T A T G A G C T G A 2603_ai1.seq
10217 T A A A G A A T T C A G T T G T T C G C T T T T C T T A G A A A T G A A A G A G T A T G A G C T G A 18rs21_ai1.seq
10449 T A A A G A A T T C A G T T G T T C G C T T T T C T T A G A A A T G A A A G A G T A T G A G C T G A coh1_ai1.seq
10449 T A A A G A A T T C A G T T G T T C G C T T T T C T T A G A A A T G A A A G A G T A T G A G C T G A cjb111_ai1.seq
10451 T A A A G A A T T C A G T T G T T C G C T T T T C T T A G A A A T G A A A G A G T A T G A G C T G A nem316_ai1.seq
10450 T A A A G A A T T C A G T T G T T C G C T T T T C T T A G A A A T G A A A G A G T A T G A G C T G A a909_ai1.seq
```

FIGURE 18AE

Alignment Report of AI-1_alignment, using J. Hein method with Weighted residue weight table.
Thursday, July 29, 2004 5:46 PM

```
      T A A A G G T C G T T A T A A T A G C G G A G C T C A T C T G A G A A A A C T T T T A T A C C T C A Majority
                          10510               10520               10530               10540               10550
10494 T A A A G G T C G T T A T A A T A G C G G A G C T C A T C T G A G A A A A C T T T T A T A C C T C A 2603_ai1.seq
10267 T A A A G G T C G T T A T A A T A G C G G A G C T C A T C T G A G A A A A C T T T T A T A C C T C A 18rs21_ai1.seq
10499 T A A A G G T C G T T A T A A T A G C G G A G C T C A T C T G A G A A A A C T T T T A T A C C T C A coh1_ai1.seq
10499 T A A A G G T C G T T A T A A T A G C G G A G C T C A T C T G A G A A A A C T T T T A T A C C T C A cjb111_ai1.seq
10501 T A A A G G T C G T T A T A A T A G C G G A G C T C A T C T G A G A A A A C T T T T A T A C C T C A nem316_ai1.seq
10500 T A A A G G T C G T T A T A A T A G C G G A G C T C A T C T G A G A A A A C T T T T A T A C C T C A a909_ai1.seq

      A A G T C A G T C T A G C T T T G A T A T C A T G A A G C C A T T A G G A G T T A T T C C T T A T C Majority
                          10560               10570               10580               10590               10600
10544 A A G T C A G T C T A G C T T T G A T A T C A T G A A G C C A T T A G G A G T T A T T C C T T A T C 2603_ai1.seq
10317 A A G T C A G T C T A G C T T T G A T A T C A T G A A G C C A T T A G G A G T T A T T C C T T A T C 18rs21_ai1.seq
10549 A A G T C A G T C T A G C T T T G A T A T C A T G A A G C C A T T A G G A G T T A T T C C T T A T C coh1_ai1.seq
10549 A A G T C A G T C T A G C T T T G A T A T C A T G A A G C C A T T A G G A G T T A T T C C T T A T C cjb111_ai1.seq
10551 A A G T C A G T C T A G C T T T G A T A T C A T G A A G C C A T T A G G A G T T A T T C C T T A T C nem316_ai1.seq
10550 A A G T C A G T C T A G C T T T G A T A T C A T G A A G C C A T T A G G A G T T A T T C C T T A T C a909_ai1.seq

      T T T T A G T G G C G C G C G A T C C A T A T A G T G A T A G A T C G A G A T A T T T A G A T C C A Majority
                          10610               10620               10630               10640               10650
10594 T T T T A G T G G C G C G C G A T C C A T A T A G T G A T A G A T C G A G A T A T T T A G A T C C A 2603_ai1.seq
10367 T T T T A G T G G C G C G C G A T C C A T A T A G T G A T A G A T C G A G A T A T T T A G A T C C A 18rs21_ai1.seq
10599 T T T T A G T G G C G C G C G A T C C A T A T A G T G A T A G A T C G A G A T A T T T A G A T C C A coh1_ai1.seq
10599 T T T T A G T G G C G C G C G A T C C A T A T A G T G A T A G A T C G A G A T A T T T A G A T C C A cjb111_ai1.seq
10601 T T T T A G T G G C G C G C G A T C C A T A T A G T G A T A G A T C G A G A T A T T T A G A T C C A nem316_ai1.seq
10600 T T T T A G T G G C G C G C G A T C C A T A T A G T G A T A G A T C G A G A T A T T T A G A T C C A a909_ai1.seq

      A A A G T T C T A T C A T C C T C T T T T G G C G C C T T T T T T C C A G C A G A T A A T A T T A A Majority
                          10660               10670               10680               10690               10700
10644 A A A G T T C T A T C A T C C T C T T T T G G C G C C T T T T T T C C A G C A G A T A A T A T T A A 2603_ai1.seq
10417 A A A G T T C T A T C A T C C T C T T T T G G C G C C T T T T T T C C A G C A G A T A A T A T T A A 18rs21_ai1.seq
10649 A A A G T T C T A T C A T C C T C T T T T G G C G C C T T T T T T C C A G C A G A T A A T A T T A A coh1_ai1.seq
10649 A A A G T T C T A T C A T C C T C T T T T G G C G C C T T T T T T C C A G C A G A T A A T A T T A A cjb111_ai1.seq
10651 A A A G T T C T A T C A T C C T C T T T T G G C G C C T T T T T T C C A G C A G A T A A T A T T A A nem316_ai1.seq
10650 A A A G T T C T A T C A T C C T C T T T T G G C G C C T T T T T T C C A G C A G A T A A T A T T A A a909_ai1.seq

      G G T A G C T T G G T C T A A C A A C T C C A G C A C T T T A T T T A C A C C A C C T A T T A A T G Majority
                          10710               10720               10730               10740               10750
10694 G G T A G C T T G G T C T A A C A A C T C C A G C A C T T T A T T T A C A C C A C C T A T T A A T G 2603_ai1.seq
10467 G G T A G C T T G G T C T A A C A A C T C C A G C A C T T T A T T T A C A C C A C C T A T T A A T G 18rs21_ai1.seq
10699 G G T A G C T T G G T C T A A C A A C T C C A G C A C T T T A T T T A C A C C A C C T A T T A A T G coh1_ai1.seq
10699 G G T A G C T T G G T C T A A C A A C T C C A G C A C T T T A T T T A C A C C A C C T A T T A A T G cjb111_ai1.seq
10701 G G T A G C T T G G T C T A A C A A C T C C A G C A C T T T A T T T A C A C C A C C T A T T A A T G nem316_ai1.seq
10700 G G T A G C T T G G T C T A A C A A C T C C A G C A C T T T A T T T A C A C C A C C T A T T A A T G a909_ai1.seq

      C A A A C T A C A C C A C T C A G A T T C A A G C T A T T G G G A C A A C G A T T A A G T C A C A A Majority
                          10760               10770               10780               10790               10800
10744 C A A A C T A C A C C A C T C A G A T T C A A G C T A T T G G G A C A A C G A T T A A G T C A C A A 2603_ai1.seq
10517 C A A A C T A C A C C A C T C A G A T T C A A G C T A T T G G G A C A A C G A T T A A G T C A C A A 18rs21_ai1.seq
10749 C A A A C T A C A C C A C T C A G A T T C A A G C T A T T G G G A C A A C G A T T A A G T C A C A A coh1_ai1.seq
10749 C A A A C T A C A C C A C T C A G A T T C A A G C T A T T G G G A C A A C G A T T A A G T C A C A A cjb111_ai1.seq
10751 C A A A C T A C A C C A C T C A G A T T C A A G C T A T T G G G A C A A C G A T T A A G T C A C A A nem316_ai1.seq
10750 C A A A C T A C A C C A C T C A G A T T C A A G C T A T T G G G A C A A C G A T T A A G T C A C A A a909_ai1.seq

      A T T C C G G A A T C G A T T T T G A C G G T T A C G G A T A A A A A G A G C A G G A A G T T C A G Majority
                          10810               10820               10830               10840               10850
10794 A T T C C G G A A T C G A T T T T G A C G G T T A C G G A T A A A A A G A G C A G G A A G T T C A G 2603_ai1.seq
10567 A T T C C G G A A T C G A T T T T G A C G G T T A C G G A T A A A A A G A G C A G G A A G T T C A G 18rs21_ai1.seq
10799 A T T C C G G A A T C G A T T T T G A C G G T T A C G G A T A A A A A G A G C A G G A A G T T C A G coh1_ai1.seq
10799 A T T C C G G A A T C G A T T T T G A C G G T T A C G G A T A A A A A G A G C A G G A A G T T C A G cjb111_ai1.seq
10801 A T T C C G G A A T C G A T T T T G A C G A T T A C G G A T A A A A A G A G C A G G A A G T T C A G nem316_ai1.seq
10800 A T T C C G G A A T C G A T T T T G A C G G T T A C G G A T A A A A A G A G C A G G A A G T T C A G a909_ai1.seq
```

FIGURE 18AF

Alignment Report of AI-1_alignment, using J. Hein method with Weighted residue weight table.
Thursday, July 29, 2004 5:46 PM

```
      C A T T A A C A A G A T T G A C G A A G C T A A A G A A G G C T T A G T A G G T G C G A C C T T C A Majority
                10860           10870           10880           10890           10900
10844 C A T T A A C A A G A T T G A C G A A G C T A A A G A A G G C T T A G T A G G T G C G A C C T T C A 2603_ai1.seq
10617 C A T T A A C A A G A T T G A C G A A G C T A A A G A A G G C T T A G T A G G T G C G A C C T T C A 18rs21_ai1.seq
10849 C A T T A A C A A G A T T G A C G A A G C T A A A G A A G G C T T A G T A G G T G C G A C C T T C A coh1_ai1.seq
10849 C A T T A A C A A G A T T G A C G A A G C T A A A G A A G G C T T A G T A G G T G C G A C C T T C A cjb111_ai1.seq
10851 C A T T A A C A A G A T T G A C G A A G C T A A A G A A G G C T T A G T A G G T G C G A C C T T C A nem316_ai1.seq
10850 C A T T A A C A A G A T T G A C G A A G C T A A A G A A G G C T T A G T A G G T G C G A C C T T C A a909_ai1.seq

      C C T T G T C T A A A C G C A C A A C A G T A G C G G C A G A T C A T C A A G T A C A A G G A G A T Majority
                10910           10920           10930           10940           10950
10894 C C T T G T C T A A A C G C A C A A C A G T A G C G G C A G A T C A T C A A G T A C A A G G A G A T 2603_ai1.seq
10667 C C T T G T C T A A A C G C A C A A C A G T A G C G G C A G A T C A T C A A G T A C A A G G A G A T 18rs21_ai1.seq
10899 C C T T G T C T A A A C G C A C A A C A G T A G C G G C A G A T C A T C A A G T A C A A G G A G A T coh1_ai1.seq
10899 C C T T G T C T A A A C G C A C A A C A G T A G C G G C A G A T C A T C A A G T A C A A G G A G A T cjb111_ai1.seq
10901 C C T T G T C T A A A C G C A C A A C A G T A G C G G C A G A T C A T C A A G T A C A A G G A G A T nem316_ai1.seq
10900 C C T T G T C T A A A C G C A C A A C A G T A G C G G C A G A T C A T C A A G T A C A A G G A G A T a909_ai1.seq

      T T C A T T C C T G T C A G C A A A G A G A C G A C A G T C G G T C G G A C A A C C C T T A C C T T Majority
                10960           10970           10980           10990           11000
10944 T T C A T T C C T G T C A G C A A A G A G A C G A C A G T C G G T C G G A C A A C C C T T A C C T T 2603_ai1.seq
10717 T T C A T T C C T G T C A G C A A A G A G A C G A C A G T C G G T C G G A C A A C C C T T A C C T T 18rs21_ai1.seq
10949 T T C A T T C C T G T C A G C A A A G A G A C G A C A G T C G G T C G G A C A A C C C T T A C C T T coh1_ai1.seq
10949 T T C A T T C C T G T C A G C A A A G A G A C G A C A G T C G G T C G G A C A A C T C T T A C C T T cjb111_ai1.seq
10951 T T C A T T C C T G T C A G C A A A G A G A C G A C A G T C G G T C G G A C A A C C C T T A C C T T nem316_ai1.seq
10950 T T C A T T C C T G T C A G C A A A G A G A C G A C A G T C G G T C G G A C A A C T C T T A C C T T a909_ai1.seq

      T G A C A A C C T T A A A C C T G G A T T T T A T G A C C T T A A A G A A A C G A A A G C G C C G A Majority
                11010           11020           11030           11040           11050
10994 T G A C A A C C T T A A A C C T G G A T T T T A T G A C C T T A A A G A A A C G A A A G C G C C G A 2603_ai1.seq
10767 T G A C A A C C T T A A A C C T G G A T T T T A T G A C C T T A A A G A A A C G A A A G C G C C G A 18rs21_ai1.seq
10999 T G A C A A C C T T A A A C C T G G A T T T T A T G A C C T T A A A G A A A C G A A A G C G C C G A coh1_ai1.seq
10999 T G A C A A C C T T A A A C C T G G A T T T T A T G A C C T T A A A G A A A C G A A A G C G C C G A cjb111_ai1.seq
11001 T G A C A A C C T T A A A C C T G G A T T T T A T G A C C T T A A A G A A A C G A A A G C G C C G A nem316_ai1.seq
11000 T G A C A A C C T T A A A C C T G G A T T T T A T G A C C T T A A A G A A A C G A A A G C G C C G A a909_ai1.seq

      A T G C T T A C G T A C T T G A T C C T A A G A C T T A T G T T G T G G T C G T T C A A A A T T C A Majority
                11060           11070           11080           11090           11100
11044 A T G C T T A C G T A C T T G A T C C T A A G A C T T A T G T T G T G G T C G T T C A A A A T T C A 2603_ai1.seq
10817 A T G C T T A C G T A C T T G A T C C T A A G A C T T A T G T T G T G G T C G T T C A A A A T T C A 18rs21_ai1.seq
11049 A T G C T T A C G T A C T T G A T C C T A A G A C T T A T G T T G T G G T C G T T C A A A A T T C A coh1_ai1.seq
11049 A T G C T T A C G T A C T T G A T C C T A A G A C T T A T G T T G T G G T C G T T C A A A A T T C A cjb111_ai1.seq
11051 A T G C T T A C G T A C T T G A T C C T A A G A C T T A T G T T G T G G T C G T T C A A A A T T C A nem316_ai1.seq
11050 A T G C T T A C G T A C T T G A T C C T A A G A C T T A T G T T G T G G T C G T T C A A A A T T C A a909_ai1.seq

      G G A A A A A C G A C A A T T G T G G A T G A A G C T A A C T T C A A A G A G G C T G A T T A C C C Majority
                11110           11120           11130           11140           11150
11094 G G A A A A A C G A C A A T T G T G G A T G A A G C T A A C T T C A A A G A G G C T G A T T A C C C 2603_ai1.seq
10867 G G A A A A A C G A C A A T T G T G G A T G A A G C T A A C T T C A A A G A G G C T G A T T A C C C 18rs21_ai1.seq
11099 G G A A A A A C G A C A A T T G T G G A T G A A G C T A A C T T C A A A G A G G C T G A T T A C C C coh1_ai1.seq
11099 G G A A A A A C G A C A A T T G T G G A T G A A G C T A A C T T C A A A G A G G C T G A T T A C C C cjb111_ai1.seq
11101 G G A A A A A C G A C A A T T G T G G A T G A A G C T A A C T T C A A A G A G G C T G A T T A C C C nem316_ai1.seq
11100 G G A A A A A C G A C A A T T G T G G A T G A A G C T A A C T T C A A A G A G G C T G A T T A C C C a909_ai1.seq

      A A T G G C T G A T A A T A C C A G C C A T G T G G A G T G C G T A G C G T T G C T A C A A C G A A Majority
                11160           11170           11180           11190           11200
11144 A A T G G C T G A T A A T A C C A G C C A T G T G G A G T G C G T A G C G T T G C T A C A A C G A A 2603_ai1.seq
10917 A A T G G C T G A T A A T A C C A G C C A T G T G G A G T G C G T A G C G T T G C T A C A A C G A A 18rs21_ai1.seq
11149 A A T G G C T G A T A A T A C C A G C C A T G T G G A G T G C G T A G C G T T G C T A C A A C G A A coh1_ai1.seq
11149 A A T G G C T G A T A A T A C C A G C C A T G T G G A G T G C G T A G C G T T G C T A C A A C G A A cjb111_ai1.seq
11151 A A T G G C T G A T A A T A C C A G C C A T G T G G A G T G C G T A G C G T T G C T A C A A C G A A nem316_ai1.seq
11150 A A T G G C T G A T A A T A C C A G C C A T G T G G A G T G C G T A G C G T T G C T A C A A C G A A a909_ai1.seq
```

FIGURE 18AG

Alignment Report of AI-1_alignment, using J. Hein method with Weighted residue weight table.
Thursday, July 29, 2004 5:46 PM

```
      G C A A A G G G T A A A A A T C C T T T A T T T T A A G C A C T T T T T C A A G C A T T T T G T C T Majority
                          11210               11220               11230               11240               11250
11194 G C A A A G G G T A A A A A T C C T T T A T T T T A A G C A C T T T T T C A A G C A T T T T G T C T 2603_ai1.seq
10967 G C A A A G G G T A A A A A T C C T T T A T T T T A A G C A C T T T T T C A A G C A T T T T G T C T 18rs21_ai1.seq
11199 G C A A A G G G T A A A A A T C C T T T A T T T T A A G C A C T T T T T C A A G C A T T T T G T C T coh1_ai1.seq
11199 G C A A A G G G T A A A A A T C C T T T A T T T T A A G C A C T T T T T C A A G C A T T T T G T C T cjb111_ai1.seq
11201 G C A A A G G G T A A A A A T C C T T T A T T T T A A G C A C T T T T T C A A G C A T T T T G T C T nem316_ai1.seq
11200 G C A A A G G G T A A A A A T C C T T T A T T T T A A G C A C T T T T T C A A G C A T T T T G T C T a909_ai1.seq

      T T A T T G A A A A G A G T G A T T T T A A C A T A A A A A A G G T A T T A A A A A A C A T A T T G Majority
                          11260               11270               11280               11290               11300
11244 T T A T T G A A A A G A G T G A T T T T A A C A T A A A A A A G G T A T T A A A A A A C A T A T T G 2603_ai1.seq
11017 T T A T T G A A A A G A G T G A T T T T A A C A T A A A A A A G G T A T T A A A A A A C A T A T T G 18rs21_ai1.seq
11249 T T A T T G A A A A G A G T G A T T T T A A C A T A A A A A A G G T A T T A A A A A A C A T A T T G coh1_ai1.seq
11249 T T A T T G A A A A G A G T G A T T T T A A C A T A A A A A A G G T A T T A A A A A A C A T A T T G cjb111_ai1.seq
11251 T T A T T G A A A A G A G T G A T T T T A A C A T A A A A A A G G T A T T A A A A A A C A T A T T G nem316_ai1.seq
11250 T T A T T G A A A A G A G T G A T T T T A A C A T A A A A A A G G T A T T A A A A A A C A T A T T G a909_ai1.seq

      A C G T G A C C G T T T G T T T T G A A G T G G C T T G C G T A G A C A A A A A A A T A G A T A C G Majority
                          11310               11320               11330               11340               11350
11294 A C G T G A C C G T T T G T T T T G A A G T G G C T T G C G T A G A C A A A A A A A T A G A T A C G 2603_ai1.seq
11067 A C G T G A C C G T T T G T T T T G A A G T G G C T T G C G T A G A C A A A A A A A T A G A T A C G 18rs21_ai1.seq
11299 A C G T G A C C G T T T G T T T T G A A G T G G C T T G C G T A G A C A A A A A A A T A G A T A C G coh1_ai1.seq
11299 A C G T G A C C G T T T G T T T T G A A G T G G C T T G C G T A G A C A A A A A A A T A G A T A C G cjb111_ai1.seq
11301 A C G T G A C C G T T T G T T T T G A A G T G G C T T G C G T A G A C A A A A A A A T A G A T A C G nem316_ai1.seq
11300 A C G T G A C C G T T T G T T T T G A A G T G G C T T G C G T A G A C A A A A A A A T A G A T A C G a909_ai1.seq

      T C A G A T A A A T T T C T G G C A T T A C G A G A A C A T T T T T A G A G T G T T C T C T T T T T Majority
                          11360               11370               11380               11390               11400
11344 T C A G A T A A A T T T C T G G C A T T A C G A G A A C A T T T T T A G A G T G T T C T C T T T T T 2603_ai1.seq
11117 T C A G A T A A A T T T C T G G C A T T A C G A G A A C A T T T T T A G A G T G T T C T C T T T T T 18rs21_ai1.seq
11349 T C A G A T A A A T T T C T G G C A T T A C G A G A A C A T T T T T A G A G T G T T C T C T T T T T coh1_ai1.seq
11349 T C A G A T A A A T T T C T G G C A T T A C G A G A A C A T T T C T A G A G T G T T C T C T T T T T cjb111_ai1.seq
11351 T C A G A T A A A T T T C T G G C A T T A C G A G A A C A T T T T T A G A G T G T T C T C T T T T T nem316_ai1.seq
11350 T C A G A T A A A T T T C T G G C A T T A C G A G A A C A T T T C T A G A G T G T T C T C T T T T T a909_ai1.seq

      T T A G T T T A C G G A G G A A A A A T A T A T A T G G A A A A A C A G G A T T C A C G A G T T C T Majority
                          11410               11420               11430               11440               11450
11394 T T A G T T T A C G G A G G A A A A A T A T A T A T G G A A A A A C A G G A T T C A C G A G T T C T 2603_ai1.seq
11167 T T A G T T T A C G G A G G A A A A A T A T A T A T G G A A A A A C A G G A T T C A C G A G T T C T 18rs21_ai1.seq
11399 T T A G T T T A C G G A G G A A A A A T A T A T A T G G A A A A A C A G G A T T C A C G A G T T C T coh1_ai1.seq
11399 T T A G T T T A C G G A G G A A A A A T A T A T A T G G A A A A A C A G G A T T C A C G A G T T C T cjb111_ai1.seq
11401 T T A G T T T A C G G A G G A A A A A T A T A T A T G G A A A A A C A G G A T T C A C G A G T T C T nem316_ai1.seq
11400 T T A G T T T A C G G A G G A A A A A T A T A T A T G G A A A A A C A G G A T T C A C G A G T T C T a909_ai1.seq

      C A T C C A T T G G G A G G G G A A T T C T G G G G A C A A G C T C A T T G A A C A C C A A A C C A Majority
                          11460               11470               11480               11490               11500
11444 C A T C C A T T G G G A G G G G A A T T C T G G G G A C A A G C T C A T T G A A C A C C A A A C C A 2603_ai1.seq
11217 C A T C C A T T G G G A G G G G A A T T C T G G G G A C A A G C T C A T T G A A C A C C A A A C C A 18rs21_ai1.seq
11449 C A T C C A T T G G G A G G G G A A T T C T G G G G A C A A G C T C A T T G A A C A C C A A A C C A coh1_ai1.seq
11449 C A T C C A T T G G G A G G G G A A T T C T G G G G A C A A G C T C A T T G A A C A C C A A A C C A cjb111_ai1.seq
11451 C A T C C A T T G G G A G G G G A A T T C T G G G G A C A A G C T C A T T G A A C A C C A A A C C A nem316_ai1.seq
11450 C A T C C A T T G G G A G G G G A A T T C T G G G G A C A A G C T C A T T G A A C A C C A A A C C A a909_ai1.seq

      G C G C A A C G G G G T G G T A C T A C C A A G T C G A T C G T A G C T T T A G T C A A C C A A A A Majority
                          11510               11520               11530               11540               11550
11494 G C G C A A C G G G G T G G T A C T A C C A A G T C G A T C G T A G C T T T A G T C A A C C A A A A 2603_ai1.seq
11267 G C G C A A C G G G G T G G T A C T A C C A A G T C G A T C G T A G C T T T A G T C A A C C A A A A 18rs21_ai1.seq
11499 G C G C A A T G G G G T G G T A C T A C C A A G T C G A T C G T A G C T T T A G T C A A C C A A A A coh1_ai1.seq
11499 G C G C A A C G G G G T G G T A C T A C C A A G T C G A T C G T A G C T T T A G T C A A C C A A A A cjb111_ai1.seq
11501 G C G C A A C G G G G T G G T A C T A C C A A G T C G A T C G T A G C T T T A G T C A A C C A A A A nem316_ai1.seq
11500 G C G C A A C G G G G T G G T A C T A C C A A G T C G A T C G T A G C T T T A G T C A A C C A A A A a909_ai1.seq
```

FIGURE 18AH

Alignment Report of AI-1_alignment, using J. Hein method with Weighted residue weight table.
Thursday, July 29, 2004 5:46 PM

```
      G G G G A A C C G C C C A G A A T G A T C C A A A G G C A C T A G A A A G T G T C C G T A A T G A T Majority
                11560          11570          11580          11590          11600
11544 G G G G A A C C G C C C A G A A T G A T C C A A A G G C A C T A G A A A G T G T C C G T A A T G A T 2603_ai1.seq
11317 G G G G A A C C G C C C A G A A T G A T C C A A A G G C A C T A G A A A G T G T C C G T A A T G A T 18rs21_ai1.seq
11549 G G G G A A C C G C C C A G A A T G A T C C A A A G G C A C T A G A A A G T G T C C G T A A T G A T coh1_ai1.seq
11549 G G G G A A C C G C C C A G A A T G A T C C A A A G G C A C T A G A A A G T G T C C G T A A T G A T cjb111_ai1.seq
11551 G G G G A A C C G C C C A G A A T G A T C C A A A G G C A C T A G A A A G T G T C C G T A A T G A T nem316_ai1.seq
11550 G G G G A A C C G C C C A G A A T G A T C C A A A G G C A C T A G A A A G T G T C C G T A A T G A T a909_ai1.seq

      T C G A T T T C G G G C G G T G A T G A T G T C A T G G G T T A T G C T T A T A G C A A A T G T A C Majority
                11610          11620          11630          11640          11650
11594 T C G A T T T C G G G C G G T G A T G A T G T C A T G G G T T A T G C T T A T A G C A A A T G T A C 2603_ai1.seq
11367 T C G A T T T C G G G C G G T G A T G A T G T C A T G G G T T A T G C T T A T A G C A A A T G T A C 18rs21_ai1.seq
11599 T C G A T T T C G G G C G G T G A T G A T G T C A T G G G T T A T G C T T A T A G C A A A T G T A C coh1_ai1.seq
11599 T C G A T T T C G G G C G G T G A T G A T G T C A T G G G T T A T G C T T A T A G C A A A T G T A C cjb111_ai1.seq
11601 T C G A T T T C G G G C G G T G A T G A T G T C A T G G G T T A T G C T T A T A G C A A A T G T A C nem316_ai1.seq
11600 T C G A T T T C G G G C G G T G A T G A T G T C A T G G G T T A T G C T T A T A G C A A A T G T A C a909_ai1.seq

      T T G G G G A G T T G C G G C A C G A A T T A A T C A G T G G G A C T G A A A C T C A A A G G T T G Majority
                11660          11670          11680          11690          11700
11644 T T G G G G A G T T G C G G C A C G A A T T A A T C A G T G G G A C T G A A A C T C A A A G G T T G 2603_ai1.seq
11417 T T G G G G A G T T G C G G C A C G A A T T A A T C A G T G G G A C T G A A A C T C A A A G G T T G 18rs21_ai1.seq
11649 T T G G G G A G T T G C G G C A C G A A T T A A T C A G T G G G A C T G A A A C T C A A A G G T T G coh1_ai1.seq
11649 T T G G G G A G T T G C G G C A C G A A T T A A T C A G T G G G A C T G A A A C T C A A A G G T T G cjb111_ai1.seq
11651 T T G G G G A G T T G C G G C A C G A A T T A A T C A G T G G G A C T G A A A C T C A A A G G T T G nem316_ai1.seq
11650 T T G G G G A G T T G C G G C A C G A A T T A A T C A G T G G G A C T G A A A C T C A A A G G T T G a909_ai1.seq

      A A A T G G T G A G A A G A T T A C C A T T A C C A G T T C A A T G G G A A A T G G T C A G G A T T Majority
                11710          11720          11730          11740          11750
11694 A A A T G G T G A G A A G A T T A C C A T T A C C A G T T C A A T G G G A A A T G G T C A G G A T T 2603_ai1.seq
11467 A A A T G G T G A G A A G A T T A C C A T T A C C A G T T C A A T G G G A A A T G G T C A G G A T T 18rs21_ai1.seq
11699 A A A T G G T G A G A A G A T T A C C A T T A C C A G T T C A A T G G G A A A T G G T C A G G A T T coh1_ai1.seq
11699 A A A T G G T G A G A A G A T T A C C A T T A C C A G T T C A A T G G G A A A T G G T C A G G A T T cjb111_ai1.seq
11701 A A A T G G T G A G A A G A T T A C C A T T A C C A G T T C A A T G G G A A A T G G T C A G G A T T nem316_ai1.seq
11700 A A A T G G T G A G A A G A T T A C C A T T A C C A G T T C A A T G G G A A A T G G T C A G G A T T a909_ai1.seq

      G G G T T G G A A C A G C C G A A A G A C T A G A T G G T G A A A C T G A T A C A G T T C C A A A A Majority
                11760          11770          11780          11790          11800
11744 G G G T T G G A A C A G C C G A A A G A C T A G A T G G T G A A A C T G A T A C A G T T C C A A A A 2603_ai1.seq
11517 G G G T T G G A A C A G C C G A A A G A C T A G A T G G T G A A A C T G A T A C A G T T C C A A A A 18rs21_ai1.seq
11749 G G G T T G G A A C A G C C G A A A G A C T A G A T G G T G A A A C T G A T A C A G T T C C A A A A coh1_ai1.seq
11749 G G G T T G G A A C A G C C G A A A G A C T A G A T G G T G A A A C T G A T A C A G T T C C A A A A cjb111_ai1.seq
11751 G G G T T G G A A C A G C C G A A A G A C T A G A T G G T G A A A C T G A T A C A G T T C C A A A A nem316_ai1.seq
11750 G G G T T G G A A C A G C C G A A A G A C T A G A T G G T G A A A C T G A T A C A G T T C C A A A A a909_ai1.seq

      G A A G G T A C T A T T C T C T C T T T T T A G G A A A G T A G T T A T G G T T C G T A T A T A G G Majority
                11810          11820          11830          11840          11850
11794 G A A G G T A C T A T T C T C T C T T T T T A G G A A A G T A G T T A T G G T T C G T A T A T A G G 2603_ai1.seq
11567 G A A G G T A C T A T T C T C T C T T T T T A G G A A A G T A G T T A T G G T T C G T A T A T A G G 18rs21_ai1.seq
11799 G A A G G T A C T A T T C T C T C T T T T T A G G A A A G T A G T T A T G G T T C G T A T A T A G G coh1_ai1.seq
11799 G A A G G T A C T A T T C T C T C T T T T T A G G A A A G T A G T T A T G G T T C G T A T A T A G G cjb111_ai1.seq
11801 G A A G G T A C T A T T C T C T C T T T T T A G G A A A G T A G T T A T G G T T C G T A T A T A G G nem316_ai1.seq
11800 G A A G G T A C T A T T C T C T C T T T T T A G G A A A G T A G T T A T G G T T C G T A T A T A G G a909_ai1.seq

      C T A C G G A A C T A T A T C T T T C G T C A C A T T A C A T C T A C A G A T A G T A C C A T G A A Majority
                11860          11870          11880          11890          11900
11844 C T A C G G A A C T A T A T C T T T C G T C A C A T T A C A T C T A C A G A T A G T A C C A T G A A 2603_ai1.seq
11617 C T A C G G A A C T A T A T C T T T C G T C A C A T T A C A T C T A C A G A T A G T A C C A T G A A 18rs21_ai1.seq
11849 C T A C G G A A C T A T A T C T T T C G T C A C A T T A C A T C T A C A G A T A G T A C C A T G A A coh1_ai1.seq
11849 C T A C G G A A C T A T A T C T T T C G T C A C A T T A C A T C T A C A G A T A G T A C C A T G A A cjb111_ai1.seq
11851 C T A C G G A A C T A T A T C T T T C G T C A C A T T A C A T C T A C A G A T A G T A C C A T G A A nem316_ai1.seq
11850 C T A C G G A A C T A T A T C T T T C G T C A C A T T A C A T C T A C A G A T A G T A C C A T G A A a909_ai1.seq
```

FIGURE 18AI

Alignment Report of AI-1_alignment, using J. Hein method with Weighted residue weight table.
Thursday, July 29, 2004 5:46 PM

```
      T T T T G C T T A T A T G A C C A A G T A A A G T G A G G A T A T A C T A A C A A A T G A A A T A T  Majority
                          11910               11920               11930               11940               11950
11894 T T T T G C T T A T A T G A C C A A G T A A A G T G A G G A T A T A C T A A C A A A T G A A A T A T  2603_ai1.seq
11667 T T T T G C T T A T A T G A C C A A G T A A A G T G A G G A T A T A C T A A C A A A T G A A A T A T  18rs21_ai1.seq
11899 T T T T G C T T A T A T G A C C A A G T A A A G T G A G G A T A T A C T A A C A A A T G A A A T A T  coh1_ai1.seq
11899 T T T T G C T T A T A T G A C C A A G T A A A G T G A G G A T A T A C T A A C A A A T G A A A T A T  cjb111_ai1.seq
11901 T T T T G C T T A T A T G A C C A A G T A A A G T G A G G A T A T A C T A A C A A A T G A A A T A T  nem316_ai1.seq
11900 T T T T G C T T A T A T G A C C A A G T A A A G T G A G G A T A T A C T A A C A A A T G A A A T A T  a909_ai1.seq

      T T A T T A T C G T A T T T G T C C A T T T T A T C G A A A A G T T T G C A T A T T A T C A T T A T  Majority
                          11960               11970               11980               11990               12000
11944 T T A T T A T C G T A T T T G T C C A T T T T A T C G A A A A G T T T G C A T A T T A T C A T T A T  2603_ai1.seq
11717 T T A T T A T C G T A T T T G T C C A T T T T A T C G A A A A G T T T G C A T A T T A T C A T T A T  18rs21_ai1.seq
11949 T T A T T A T C G T A T T T G T C C A T T T T A T C G A A A A G T T T G C A T A T T A T C A T T A T  coh1_ai1.seq
11949 T T A T T A T C G T A T T T G T C C A T T T T A T C G A A A A G T T T G C A T A T T A T C A T T A T  cjb111_ai1.seq
11951 T T A T T A T C G T A T T T G T C C A T T T T A T C G A A A A G T T T G C A T A T T A T C A T T A T  nem316_ai1.seq
11950 T T A T T A T C G T A T T T G T C C A T T T T A T C G A A A A G T T T G C A T A T T A T C A T T A T  a909_ai1.seq

      G T T T G A T A A G A T G C A A A T A T A A T G A T A G T A G G A G C T A A A T A T G G A T A T T T  Majority
                          12010               12020               12030               12040               12050
11994 G T T T G A T A A G A T G C A A A T A T A A T G A T A G T A G G A G C T A A A T A T G G A T A T T T  2603_ai1.seq
11767 G T T T G A T A A G A T G C A A A T A T A A T G A T A G T A G G A G C T A A A T A T G G A T A T T T  18rs21_ai1.seq
11999 G T T T G A T A A G A T G C A A A T A T A A T G A T A G T A G G A G C T A A A T A T G G A T A T T T  coh1_ai1.seq
11999 G T T T G A T A A G A T G C A A A T A T A A T G A T A G T A G G A G C T A A A T A T G G A T A T T T  cjb111_ai1.seq
12001 G T T T G A T A A G A T G C A A A T A T A A T G A T A G T A G G A G C T A A A T A T G G A T A T T T  nem316_ai1.seq
12000 G T T T G A T A A G A T G C A A A T A T A A T G A T A G T A G G A G C T A A A T A T G G A T A T T T  a909_ai1.seq

      A A A A A A T C A A G A G T A T C C T A A G T G C T T T C C A T T T T G A A A T T C A A A T A T A G  Majority
                          12060               12070               12080               12090               12100
12044 A A A A A A T C A A G A G T A T C C T A A G T G C T T T C C A T T T T G A A A T T C A A A T A T A G  2603_ai1.seq
11817 A A A A A A T C A A G A G T A T C C T A A G T G C T T T C C A T T T T G A A A T T C A A A T A T A G  18rs21_ai1.seq
12049 A A A A A A T C A A G A G T A T C C T A A G T G C T T T C C A T T T T G A A A T T C A A A T A T A G  coh1_ai1.seq
12049 A A A A A A T C A A G A G T A T C C T A A G T G C T T T C C A T T T T G A A A T T C A A A T A T A G  cjb111_ai1.seq
12051 A A A A A A T C A A G A G T A T C C T A A G T G C T T T C C A T T T T G A A A T T C A A A T A T A G  nem316_ai1.seq
12050 A A A A A A T C A A G A G T A T C C T A A G T G C T T T C C A T T T T G A A A T T C A A A T A T A G  a909_ai1.seq

      C T A A T A G T T C T A G A A C T T C T A A T T G T T T T T C G T C G A C G A T A T G A A T T T T C  Majority
                          12110               12120               12130               12140               12150
12094 C T A A T A G T T C T A G A A C T T C T A A T T G T T T T T C G T C G A C G A T A T G A A T T T T C  2603_ai1.seq
11867 C T A A T A G T T C T A G A A C T T C T A A T T G T T T T T C G T C G A C G A T A T G A A T T T T C  18rs21_ai1.seq
12099 C T A A T A G T T C T A G A A C T T C T A A T T G T T T T T C G T C G A C G A T A T G A A T T T T C  coh1_ai1.seq
12099 C T A A T A G T T C T A G A A C T T C T A A T T G T T T T T C G T C G A C G A T A T G A A T T T T C  cjb111_ai1.seq
12101 C T A A T A G T T C T A G A A C T T C T A A T T G T T T T T C G T C G A C G A T A T G A A T T T T C  nem316_ai1.seq
12100 C T A A T A G T T C T A G A A C T T C T A A T T G T T T T T C G T C G A C G A T A T G A A T T T T C  a909_ai1.seq

      A A T C T T A A C T G T T A G G A T T C C A C C T C C C T T T G G T T A A A G A A A A A A G G T C A  Majority
                          12160               12170               12180               12190               12200
12144 A A T C T T A A C T G T T A G G A T T C C A C C T C C C T T T G G T T A A A G A A A A A A G G T C A  2603_ai1.seq
11917 A A T C T T A A C T G T T A G G A T T C C A C C T C C C T T T G G T T A A A G A A A A A A G G T C A  18rs21_ai1.seq
12149 A A T C T T A A C T G T T A G G A T T C C A C C T C C C T T T G G T T A A A G A A A A A A G G T C A  coh1_ai1.seq
12149 A A T C T T A A C T G T T A G G A T T C C A C C T C C C T T T G G T T A A A G A A A A A A G G T C A  cjb111_ai1.seq
12151 A A T C T T A A C T G T T A G A A T T C C A C C T C C C T T T G G T T A A A G A A A A A A G G T C A  nem316_ai1.seq
12150 A A T C T T A A C T G T T A G G A T T C C A C C T C C C T T T G G T T A A A G A A A A A A G G T C A  a909_ai1.seq

      G G T C G T T T A G A T A A C T T T G T C A A A C A A G C T C A A G C T A T C T A A A A A T A G T T  Majority
                          12210               12220               12230               12240               12250
12194 G G T C G T T T A G A T A A C T T T G T C A A A C A A G C T C A A G C T A T C T A A A A A T A G T T  2603_ai1.seq
11967 G G T C G T T T A G A T A A C T T T G T C A A A C A A G C T C A A G C T A T C T A A A A A T A G T T  18rs21_ai1.seq
12199 G G T C G T T T A G A T A A C T T T G T C A A A C A A G C T C A A G C T A T C T A A A A A T A G T T  coh1_ai1.seq
12199 G G T C G T T T A G A T A A C T T T G T C A A A C A A G C T C A A G C T A T C T A A A A A T A G T T  cjb111_ai1.seq
12201 G G T C G T T T A G A T A A C T T T G T C A A A C A A G C T C A A G C T A T C T A A A A A T A G T T  nem316_ai1.seq
12200 G G T C G T T T A G A T A A C T T T G T C A A A C A A G C T C A A G C T A T C T A A A A A T A G T T  a909_ai1.seq
```

FIGURE 18AJ

Alignment Report of AI-1_alignment, using J. Hein method with Weighted residue weight table.
Thursday, July 29, 2004 5:46 PM

```
         T G A A A T G G G C A T T A C T C T A G T T T T T A A T A A G C T A T C T G A T G A G C A G A A G G  Majority
                  12260          12270          12280          12290          12300
12244    T G A A A T G G G C A T T A C T C T A G T T T T T A A T A A G C T A T C T G A T G A G C A G A A G G  2603_ai1.seq
12017    T G A A A T G G G C A T T A C T C T A G T T T T T A A T A A G C T A T C T G A T G A G C A G A A G G  18rs21_ai1.seq
12249    T G A A A T G G G C A T T A C T C T A G T T T T T A A T A A G C T A T C T G A T G A G C A G A A G G  coh1_ai1.seq
12249    T G A A A T G G G C A T T A C T C T A G T T T T T A A T A A G C T A T C T G A T G A G C A G A A G G  cjb111_ai1.seq
12251    T G A A A T G G G C A T T A C T C T A G T T T T T A A T A A G C T A T C T G A T G A G C A G A A G G  nem316_ai1.seq
12250    T G A A A T G G G C A T T A C T C T A G T T T T T A A T A A G C T A T C T G A T G A G C A G A A G G  a909_ai1.seq

         A G A A G T T A A T G C A T G T T G G G A A G T C T T A T T T T G A C T A T C A A G A A A A T G C T  Majority
                  12310          12320          12330          12340          12350
12294    A G A A G T T A A T G C A T G T T G G G A A G T C T T A T T T T G A C T A T C A A G A A A A T G C T  2603_ai1.seq
12067    A G A A G T T A A T G C A T G T T G G G A A G T C T T A T T T T G A C T A T C A A G A A A A T G C T  18rs21_ai1.seq
12299    A G A A G T T A A T G C A T G T T G G G A A G T C T T A T T T T G A C T A T C A A G A A A A T G C T  coh1_ai1.seq
12299    A G A A G T T A A T G C A T G T T G G G A A G T C T T A T T T T G A C T A T C A A G A A A A T G C T  cjb111_ai1.seq
12301    A G A A G T T A A T G C A T G T T G G G A A G T C T T A T T T T G A C T A T C A A G A A A A T G C T  nem316_ai1.seq
12300    A G A A G T T A A T G C A T G T T G G G A A G T C T T A T T T T G A C T A T C A A G A A A A T G C T  a909_ai1.seq

         C T T A T C C C A C A A T T A G G T T T T C T A T A T T C T A A A T T A A C T A A A A A A A T T G A  Majority
                  12360          12370          12380          12390          12400
12344    C T T A T C C C A C A A T T A G G T T T T C T A T A T T C T A A A T T A A C T A A A A A A A T T G A  2603_ai1.seq
12117    C T T A T C C C A C A A T T A G G T T T T C T A T A T T C T A A A T T A A C T A A A A A A A T T G A  18rs21_ai1.seq
12349    C T T A T C C C A C A A T T A G G T T T T C T A T A T T C T A A A T T A A C T A A A A A A A T T G A  coh1_ai1.seq
12349    C T T A T C C C A C A A T T A G G T T T T C T A T A T T C T A A A T T A A C T A A A A A A A T T G A  cjb111_ai1.seq
12351    C T T A T C C C A C A A T T A G G T T T T C T A T A T T C T A A A T T A A C T A A A A A A A T T G A  nem316_ai1.seq
12350    C T T A T C C C A C A A T T A G G T T T T C T A T A T T C T A A A T T A A C T A A A A A A A T T G A  a909_ai1.seq

         A C T T G A T A A T C G G T T G T C T C C G A C T G A A C A A A A G T T A T T G A T T A C C T T A T  Majority
                  12410          12420          12430          12440          12450
12394    A C T T G A T A A T C G G T T G T C T C C G A C T G A A A A A A A G T T A T T G A T T A C C T T A T  2603_ai1.seq
12167    A C T T G A T A A T C G G T T G T C T C C G A C T G A A C A A A A G T T A T T G A T T A C C T T A T  18rs21_ai1.seq
12399    A C T T G A T A A T C G G T T G T C T C C G A C T G A A C A A A A G T T A T T G A T T A C C T T A T  coh1_ai1.seq
12399    A C T T G A T A A T C G G T T G T C T C C G A C T G A A C A A A A G T T A T T G A T T A C C T T A T  cjb111_ai1.seq
12401    A C T T G A T A A T C G G T T G T C T C C G A C T G A A C A A A A G T T A T T G A T T A C C T T A T  nem316_ai1.seq
12400    A C T T G A T A A T C G G T T G T C T C C G A C T G A A C A A A A G T T A T T G A T T A C C T T A T  a909_ai1.seq

         T A T T A C A T A C T A A A G G T T T A A T C A T T G A T A T G T A A G A A G T A A G T C A G C T A  Majority
                  12460          12470          12480          12490          12500
12444    T A T T A C A T A C T A A A G G T T T A A T C A T T G A T A T G T A A G A A G T A A G T C A G C T A  2603_ai1.seq
12217    T A T T A C A T A C T A A A G G T T T A A T C A T T G A T A T G T A A G A A G T A A G T C A G C T A  18rs21_ai1.seq
12449    T A T T A C A T A C T A A A G G T T T A A T C A T T G A T A T G T A A G A A G T A A G T C A G C T A  coh1_ai1.seq
12449    T A T T A C A T A C T A A A G G T T T A A T C A T T G A T A T G T A A G A A G T A A G T C A G C T A  cjb111_ai1.seq
12451    T A T T A C A T A C T A A A G G T T T A A T C A T T G A T A T G T A A G A A G T A A G T C A G C T A  nem316_ai1.seq
12450    T A T T A C A T A C T A A A G G T T T A A T C A T T G A T A T G T A A G A A G T A A G T C A G C T A  a909_ai1.seq

         A C C G A T C T T T C T A T T C T A A A A C T T A T A T T G T T G C T T T A G A A A T T T T A A A G  Majority
                  12510          12520          12530          12540          12550
12494    A C C G A T C T T T C T A T T C T A A A A C T T A T A T T G T T G C T T T A G A A A T T T T A A A G  2603_ai1.seq
12267    A C C G A T C T T T C T A T T C T A A A A C T T A T A T T G T T G C T T T A G A A A T T T T A A A G  18rs21_ai1.seq
12499    A C C G A T C T T T C T A T T C T A A A A C T T A T A T T G T T G C T T T A G A A A T T T T A A A G  coh1_ai1.seq
12499    A C C G A T C T T T C T A T T C T A A A A C T T A T A T T G T T G C T T T A G A A A T T T T A A A G  cjb111_ai1.seq
12501    A C C G A T C T T T C T A T T C T A A A A C T T A T A T T G T T G C T T T A G A A A T T T T A A A G  nem316_ai1.seq
12500    A C C G A T C T T T C T A T T C T A A A A C T T A T A T T G T T G C T T T A G A A A T T T T A A A G  a909_ai1.seq

         A G C G T G G A T G G C T T C A T A A T A A A C A G A A A T C T T A C C A A T T T G C G A A G C C A  Majority
                  12560          12570          12580          12590          12600
12544    A G C G T G G A T G G C T T C A T A A T A A A C A G A A A T C T T A C C A A T T T G C G A A G C C A  2603_ai1.seq
12317    A G C G T G G A T G G C T T C A T A A T A A A C A G A A A T C T T A C C A A T T T G C G A A G C C A  18rs21_ai1.seq
12549    A G C G T G G A T G G C T T C A T A A T A A A C A G A A A T C T T A C C A A T T T G C G A A G C C A  coh1_ai1.seq
12549    A G C G T G G A T G G C T T C A T A A T A A A C A G A A A T C T T A C C A A T T T G C G A A G C C A  cjb111_ai1.seq
12551    A G C G T G G A T G G C T T C A T A A T A A A C A G A A A T C T T A C C A A T T T G C G A A G C C A  nem316_ai1.seq
12550    A G C G T G G A T G G C T T C A T A A T A A A C A G A A A T C T T A C C A A T T T G C G A A G C C A  a909_ai1.seq
```

FIGURE 18AK

Alignment Report of Al-1_alignment, using J. Hein method with Weighted residue weight table.
Thursday, July 29, 2004 5:46 PM

```
      A A A A A T A T G A T A T T T G A A G A G T C C A A A G A T C T A A T A G A T A G T C C A G T T A G Majority
                          12610           12620           12630           12640           12650
12594 A A A A A T A T G A T A T T T G A A G A G T C C A A A G A T C T A A T A G A T A G T C C A G T T A G 2603_ai1.seq
12367 A A A A A T A T G A T A T T T G A A G A G T C C A A A G A T C T A A T A G A T A G T C C A G T T A G 18rs21_ai1.seq
12599 A A A A A T A T G A T A T T T G A A G A G T C C A A A G A T C T A A T A G A T A G T C C A G T T A G coh1_ai1.seq
12599 A A A A A T A T G A T A T T T G A A G A G T C C A A A G A T C T A A T A G A T A G T C C A G T T A G cjb111_ai1.seq
12601 A A A A A T A T G A T A T T T G A A G A G T C C A A A G A T C T A A T A G A T A G T C C A G T T A G nem316_ai1.seq
12600 A A A A A T A T G A T A T T T G A A G A G T C C A A A G A T C T A A T A G A T A G T C C A G T T A G a909_ai1.seq

      A G A A G C G T T G A T T A T A A G T G A T A A G G A T T T T C A A A A A T T A A A A C A A G A G C Majority
                          12660           12670           12680           12690           12700
12644 A G A A G C G T T G A T T A T A A G T G A T A A G G A T T T T C A A A A A T T A A A A C A A G A G C 2603_ai1.seq
12417 A G A A G C G T T G A T T A T A A G T G A T A A G G A T T T T C A A A A A T T A A A A C A A G A G C 18rs21_ai1.seq
12649 A G A A G C G T T G A T T A T A A G T G A T A A G G A T T T T C A A A A A T T A A A A C A A G A G C coh1_ai1.seq
12649 A G A A G C G T T G A T T A T A A G T G A T A A G G A T T T T C A A A A A T T A A A A C A A G A G C cjb111_ai1.seq
12651 A G A A G C G T T G A T T A T A A G T G A T A A G G A T T T T C A A A A A T T A A A A C A A G A G C nem316_ai1.seq
12650 A G A A G C G T T G A T T A T A A G T G A T A A G G A T T T T C A A A A A T T A A A A C A A G A G C a909_ai1.seq

      T A T T A T T T T A A C C G A C T T A T T T T A A A G A C T T A T C A T A T C T A G G C T T G C T T Majority
                          12710           12720           12730           12740           12750
12694 T A T T A T T T T A A C C G A C T T A T T T T A A A G A C T T A T C A T A T C T A G G C T T G C T T 2603_ai1.seq
12467 T A T T A T T T T A A C C G A C T T A T T T T A A A G A C T T A T C A T A T C T A G G C T T G C T T 18rs21_ai1.seq
12699 T A T T A T T T T A A C C G A C T T A T T T T A A A G A C T T A T C A T A T C T A G G C T T G C T T coh1_ai1.seq
12699 T A T T A T T T T A A C C G A C T T A T T T T A A A G A C T T A T C A T A T C T A G G C T T G C T T cjb111_ai1.seq
12701 T A T T A T T T T A A C C G A C T T A T T T T A A A G A C T T A T C A T A T C T A G G C T T G C T T nem316_ai1.seq
12700 T A T T A T T T T A A C C G A C T T A T T T T A A A G A C T T A T C A T A T C T A G G C T T G C T T a909_ai1.seq

      G A T G A T T C G G A A A A A T A C G G A G A C T A T A C T A T T T C A A G G A A A A G A T A C A A Majority
                          12760           12770           12780           12790           12800
12744 G A T G A T T C G G A A A A A T A C G G A G A C T A T A C T A T T T C A A G G A A A A G A T A C A A 2603_ai1.seq
12517 G A T G A T T C G G A A A A A T A C G G A G A C T A T A C T A T T T C A A G G A A A A G A T A C A A 18rs21_ai1.seq
12749 G A T G A T T C G G A A A A A T A C G G A G A C T A T A C T A T T T C A A G G A A A A G A T A C A A coh1_ai1.seq
12749 G A T G A T T C G G A A A A A T A C G G A G A C T A T A C T A T T T C A A G G A A A A G A T A C A A cjb111_ai1.seq
12751 G A T G A T T C G G A A A A A T A C G G A G A C T A T A C T A T T T C A A G G A A A A G A T A C A A nem316_ai1.seq
12750 G A T G A T T C G G A A A A A T A C G G A G A C T A T A C T A T T T C A A G G A A A A G A T A C A A a909_ai1.seq

      A A G T T T C G A A T C A A G T C T T C A A C T A T A C A T C C T T C A A A G T C A T C G G C T A G Majority
                          12810           12820           12830           12840           12850
12794 A A G T T T C G A A T C A A G T C T T C A A C T A T A C A T C C T T C A A A G T C A T C G G C T A G 2603_ai1.seq
12567 A A G T T T C G A A T C A A G T C T T C A A C T A T A C A T C C T T C A A A G T C A T C G G C T A G 18rs21_ai1.seq
12799 A A G T T T C G A A T C A A G T C T T C A A C T A T A C A T C C T T C A A A G T C A T C G G C T A G coh1_ai1.seq
12799 A A G T T T C G A A T C A A G T C T T C A A C T A T A C A T C C T T C A A A G T C A T C G G C T A G cjb111_ai1.seq
12801 A A G T T T C G A A T C A A G T C T T C A A C T A T A C A T C C T T C A A A G T C A T C G G C T A G nem316_ai1.seq
12800 A A G T T T C G A A T C A A G T C T T C A A C T A T A C A T C C T T C A A A G T C A T C G G C T A G a909_ai1.seq

      A G A T T T G G A A T T A T G A A C C A A T C C C T T T G A T T A C T A G A A A A A T A A A T A G C Majority
                          12860           12870           12880           12890           12900
12844 A G A T T T G G A A T T A T G A A C C A A T C C C T T T G A T T A C T A G A A A A A T A A A T A G C 2603_ai1.seq
12617 A G A T T T G G A A T T A T G A A C C A A T C C C T T T G A T T A C T A G A A A A A T A A A T A G C 18rs21_ai1.seq
12849 A G A T T T G G A A T T A T G A A C C A A T C C C T T T G A T T A C T A G A A A A A T A A A T A G C coh1_ai1.seq
12849 A G A T T T G G A A T T A T G A A C C A A T C C C T T T G A T T A C T A G A A A A A T A A A T A G C cjb111_ai1.seq
12851 A G A T T T G G A A T T A T G A A C C A A T C C C T T T G A T T A C T A G A A A A A T A A A T A G C nem316_ai1.seq
12850 A G A T T T G G A A T T A T G A A C C A A T C C C T T T G A T T A C T A G A A A A A T A A A T A G C a909_ai1.seq

      T T G G A G A G G C T A A C G T G A C A C T G G T T G A T C C A A T C T C G C T T T A T T T A A C A Majority
                          12910           12920           12930           12940           12950
12894 T T G G A G A G G C T A A C G T G A C A C T G G T T G A T C C A A T C T C G C T T T A T T T A A C A 2603_ai1.seq
12667 T T G G A G A G G C T A A C G T G A C A C T G G T T G A T C C A A T C T C G C T T T A T T T A A C A 18rs21_ai1.seq
12899 T T G G A G A G G C T A A C G T G A C A C T G G T T G A T C C A A T C T C G C T T T A T T T A A C A coh1_ai1.seq
12899 T T G G A G A G G C T A A C G T G A C A C T G G T T G A T C C A A T C T C G C T T T A T T T A A C A cjb111_ai1.seq
12901 T T G G A G A G G C T A A C G T G A C A C T G G T T G A T C C A A T C T C G C T T T A T T T A A C A nem316_ai1.seq
12900 T T G G A G A G G C T A A C G T G A C A C T G G T T G A T C C A A T C T C G C T T T A T T T A A C A a909_ai1.seq
```

FIGURE 18AL

Alignment Report of AI-1_alignment, using J. Hein method with Weighted residue weight table.
Thursday, July 29, 2004 5:46 PM

```
      C T A A G A A T G A T G A A G A C C C T C G T A T T G A A G A A G A A G T T G A G C A G C T A G A A Majority

                     12960                     12970                     12980                     12990                     13000

12944 C T A A G A A T G A T G A A G A C C C T C G T A T T G A A G A A G A A G T T G A G C A G C T A G A A 2603_ai1.seq
12717 C T A A G A A T G A T G A A G A C C C T C G T A T T G A A G A A G A A G T T G A G C A G C T A G A A 18rs21_ai1.seq
12949 C T A A G A A T G A T G A A G A C C C T C G T A T T G A A G A A G A A G T T G A G C A G C T A G A A coh1_ai1.seq
12949 C T A A G A A T G A T G A A G A C C C T C G T A T T G A A G A A G A A G T T G A G C A G C T A G A A cjb111_ai1.seq
12951 C T A A G A A T G A T G A A G A C C C T C G T A T T G A A G A A G A A G T T G A G C A G C T A G A - nem316_ai1.seq
12950 C T A A G A A T G A T G A A G A C C C T C G T A T T G A A G A A G A A G T T G A G C A G C T A G A A a909_ai1.seq

      G A T A A G A T                                                                                  Majority


12994 G A T A A G A T                                                                                  2603_ai1.seq
12767 G A T A A G A T                                                                                  18rs21_ai1.seq
12999 G A T A A G A T                                                                                  coh1_ai1.seq
12999 G A                                                                                              cjb111_ai1.seq
13000 - A                                                                                              nem316_ai1.seq
13000 G A T A A G A T                                                                                  a909_ai1.seq
```

Decoration 'Decoration #1': Shade (with solid black) residues that differ from the Consensus.

FIGURE 19A

Alignment Report of AI-2_alignment, using J. Hein method with Weighted residue weight table.
Thursday, July 29, 2004 6:32 PM

```
    GGCCTTGTTCCGATGTTGATCCCGATAACTCCTGGCTCATTAATAGCCTG Majority
             10        20        30        40        50
1   GGCCTTGTTCCGATGTTGATTCCGATAACTCCTGGCTCATTAATAGCCTG 2603_ai2.seq
1   GGCCTTGTTCCGATGTTGATTCCGATAACTCCTGGCTCATTAATAGCCTG 18rs21_ai2.seq
1   GGCCTTGTTCCGATGTTGATCCCGATAACTCCTGGCTCATTAATAGCCTG 515_ai2.seq
1   GGCCTTGTTCCGATGTTGATCCCGATAACTCCTGGCTCATTAATAGCCTG cjb111_ai2.seq
1   GGCCTTGTTCCGATGTTGATCCCGATAACTCCTGGCTCATTAATAGCCTG h36b_ai2.seq

    TTCGTAACGCTCTTTAATTATCTCTAACTTAGCATGGGTATTGGTAAAAT Majority
             60        70        80        90       100
51  TTCGTAACGCTCTTTAATTATCTCTAACTTAGCATGGGTATTGGTAAAAT 2603_ai2.seq
51  TTCGTAACGCTCTTTAATTATCTCTAACTTAGCATGGGTATTGGTAAAAT 18rs21_ai2.seq
51  TTCGTAACGCTCTTTAATTATCTCTAACTTAGCATGGGTATTGGTAAAAT 515_ai2.seq
51  TTCGTAACGCTCTTTAATTATCTCTAACTTAGCATGGGTATTGGTAAAAT cjb111_ai2.seq
51  TTCGTAACGCTCTTTAATTATCTCTAACTTAGCATGGGTATTGGTAAAAT h36b_ai2.seq

    TTTGAAAATAGACTAAGTATTTATTAACCTCAGGCCACTTTCTATGCATG Majority
            110       120       130       140       150
101 TTTGAAAATAGACTAAGTATTTATTAACCTCAGGCCACTTTCTATGCATG 2603_ai2.seq
101 TTTGAAAATAGACTAAGTATTTATTAACCTCAGGCCACTTTCTATGCATG 18rs21_ai2.seq
101 TTTGAAAATAGACTAAGTATTTATTAACTTCAGGCCACTTTCTATGCATG 515_ai2.seq
101 TTTGAAAATAGACTAAGTATTTATTAACCTCAGGCCACTTTCTATGCATG cjb111_ai2.seq
101 TTTGAAAATAGACTAAGTATTTATTAACCTCAGGCCACTTTCTATGCATG h36b_ai2.seq

    AAATCAATTTCTTTATAGAATTGTTCACGAATAGGAGCTTCTGGAGCAAC Majority
            160       170       180       190       200
151 AAATCAATTTCTTTATAGAATTGTTCACGAATAGGAGCTTCTGGAGCAAC 2603_ai2.seq
151 AAATCAATTTCTTTATAGAATTGTTCACGAATAGGAGCTTCTGGAGCAAC 18rs21_ai2.seq
151 AAATCAATTTCTTTATAGAATTGTTCACGAATAGGAGCTTCTGGAGCAAC 515_ai2.seq
151 AAATCAATTTCTTTATAGAATTGTTCACGAATAGGAGCTTCTGGAGCAAC cjb111_ai2.seq
151 AAATCAATTTCTTTATAGAATTGTTCACGAATAGGAGCTTCTGGAGCAAC h36b_ai2.seq

    TATAGCATCCCCTGAACCAGAAACTGTGCAAAAAGTGCACCCTCCTCTAG Majority
            210       220       230       240       250
201 TATAGCATCCCCTGAACCAGAAACTGTGCAAAAAGTGCACCCTCCTCTAG 2603_ai2.seq
201 TATAGCATCCCCTGAACCAGAAACTGTGCAAAAAGTGCACCCTCCTCTAG 18rs21_ai2.seq
201 TATAGCATCCCCTGAACCAGAAACTGTGCAAAAAGTGCACCCTCCTCTAG 515_ai2.seq
201 TATAGCATCCCCTGAACCAGAAACTGTGCAAAAAGTGCACCCTCCTCTAG cjb111_ai2.seq
201 TATAGCATCCCCTGAACCAGAAACTGTGCAAAAAGTGCACCCTCCTCTAG h36b_ai2.seq

    CAACTGTTCCGTCTCTGTTAGGACAGTCAAAACCAGCATCTATAGGTAAT Majority
            260       270       280       290       300
251 CAACTGTTCCGTCTCTGTTAGGACAGTCAAAACCAGCATCTATAGGTAAT 2603_ai2.seq
251 CAACTGTTCCGTCTCTGTTAGGACAGTCAAAACCAGCATCTATAGGTAAT 18rs21_ai2.seq
251 CAACTGTTCCGTCTCTGTTAGGACAGTCAAAACCAGCATCTATAGGTAAT 515_ai2.seq
251 CAACTGTTCCATCTCTGTTAGGACAGTCAAAACCAGCATCTATAGGTAAT cjb111_ai2.seq
251 CAACTGTTCCGTCTCTGTTAGGACAGTCAAAACCAGCATCTATAGGTAAT h36b_ai2.seq

    TTAAATATTTTTTCTCCAAAGAGTTCTCGATAATAATCATTAATCGCACG Majority
            310       320       330       340       350
301 TTAAATATTTTTTCTCCAAAGAGTTCTCGATAATAATCATTAATCGCACG 2603_ai2.seq
301 TTAAATATTTTTTCTCCAAAGAGTTCTCGATAATAATCATTAATCGCACG 18rs21_ai2.seq
301 TTAAATATTTTTTCTCCAAAGAGTTCTCGATAATAATCATTAATCGCACG 515_ai2.seq
301 TTAAATATTTTTTCTCCAAAGAGTTCTCGATAATAATCATTAATCGCACG cjb111_ai2.seq
301 TTAAATATTTTTTCTCCAAAGAGTTCTCGATAATAATCATTAATCGCACG h36b_ai2.seq

    ATAACGTTTTTTCATAGGATAATTGTATCACAATTTTAACTAAAATAACC Majority
            360       370       380       390       400
351 ATAACGTTTTTTCATAGGATAATTGTATCACAATTTTAACTAAAATAACC 2603_ai2.seq
351 ATAACGTTTTTTCATAGGATAATTGTATCACAATTTTAACTAAAATAACC 18rs21_ai2.seq
351 ATAACGTTTTTTCATAGGATAATTGTATCACAATTTTAACTAAAATAACC 515_ai2.seq
351 ATAACGTTTTTTCATAGGATAATTGTATCACAATTTTAACTAAAATAACC cjb111_ai2.seq
351 ATAACGTTTTTTCATAGGATAATTGTATCACAATTTTAACTAAAATAACC h36b_ai2.seq

    TCACTACTACAATAAAACTAAAAAAGATTGGAACGTCAGTTAGTCCCAAT Majority
            410       420       430       440       450
401 TCACTACTACAATAAAACTAAAAAAGATTGGAACGTCAGTTAGTCCCAAT 2603_ai2.seq
401 TCACTACTACAATAAAACTAAAAAAGATTGGAACGTCAGTTAGTCCCAAT 18rs21_ai2.seq
401 TCACTACTACAATAAAACTAAAAAAGATTGGAACATCAGTTAGTCCCAAT 515_ai2.seq
401 TCACTACTACAATAAAACTAAAAAAGATTGGAACTAACTGACGTTCCAAT cjb111_ai2.seq
401 TCACTACTACAATAAAACTAAAAAAGATTGGAACGTCAGTTAGTCCCAAT h36b_ai2.seq
```

FIGURE 19B

Alignment Report of Ai-2_alignment, using J. Hein method with Weighted residue weight table.
Thursday, July 29, 2004 6:32 PM

```
              C T T T T A T T T A C T T C A C T T T C T T T A A C C A A T C C T T G G C T A A A A A G A T A T A C  Majority
                          460                 470                 480                 490                 500
      451     C T T T T A T T T A C T T C A C T T T C T T T A A C C A A T C C T T G G C T A A A A A G A T A T A C  2603_ai2.seq
      451     C T T T T A T T T A C T T C A C T T T C T T T A A C C A A T C C T T G G C T A A A A A G A T A T A C  18rs21_ai2.seq
      451     C T T T T A T T T A C T T C A C T T T C T T T A A C C A A T C C T T G G C T A A A A A G A T A T A C  515_ai2.seq
      451     C T T T T A T T T A C T T C A C T T T C T T T A A C C A A T C C T T G G C T A A A A A G A T A T A C  cjb111_ai2.seq
      451     C T T T T A T T T A C T T C A C T T T C T T T A A C C A A T C C T T G G C T A A A A A G A T A T A C  h36b_ai2.seq

              G C A G T T A G A T T C A A A A T A C C A T A A G C A A G T A T A A A A C C A G C T A A A A C A T C  Majority
                          510                 520                 530                 540                 550
      501     G C A G T T A G A T T C A A A A T A C C A T A A G C A A G T A T A A A A C C A G C T A A A A C A T C  2603_ai2.seq
      501     G C A G T T A G A T T C A A A A T A C C A T A A G C A A G T A T A A A A C C A G C T A A A A C A T C  18rs21_ai2.seq
      501     G C A G T T A G A T T C A A A A T A C C A T A A G C A A G T A T A A A A C C A G C T A A A A C A T C  515_ai2.seq
      501     G C A G T T A G A T T C A A A A T A C C A T A A G C A A G T A T A A A A C C A G C T A A A A C A T C  cjb111_ai2.seq
      501     G C A G T T A G A T T C A A A A T A C C A T A A G C A A G T A T A A A A C C A G C T A A A A C A T C  h36b_ai2.seq

              T G T C G G A A A A T G A A C C C C T A G G T A A A T A C G A G A T A A C C C A A T T A A A A A A A  Majority
                          560                 570                 580                 590                 600
      551     T G T C G G A A A A T G A A C C C C T A G G T A A A T A C G A G A T A A C C C A A T T A A A A A A A  2603_ai2.seq
      551     T G T C G G A A A A T G A A C C C C T A G G T A A A T A C G A G A T A A C C C A A T T A A A A A A A  18rs21_ai2.seq
      551     T G T C G G A A A A T G A A C C C C T A G G T A A A T A C G A G A T A A C C C A A T T A A A A A A A  515_ai2.seq
      551     T G T C G G A A A A T G A A C C C C T A G G T A A A T A C G A G A T A A C C C A A T T A A A A A A A  cjb111_ai2.seq
      551     T G T C G G A A A A T G A A C C C C T A G G T A A A T A C G A G A T A A C C C A A T T A A A A A A A  h36b_ai2.seq

              T G A G C A A A C C C A A A G T A C C T T G G C A C A A C A G T T T C C A T A T A C T C T T A G G C  Majority
                          610                 620                 630                 640                 650
      601     T G A G C A A A C C C A A A G T A C C T T G G C A C A A C A G T T T C C A T A T A C T C T T A G G C  2603_ai2.seq
      601     T G A G C A A A C C C A A A G T A C C T T G G C A C A A C A G T T T C C A T A T A C T C T T A G G C  18rs21_ai2.seq
      601     T G A G C A A A C C C A A A A T A C C T T G G C A C A A C A G T T T C C A T A T A C T A T T A G G C  515_ai2.seq
      601     T G A G C A A A C C C A A A A T A C C T T G G T A C A A C A G T T T C C A T A T A C T C T T A G G C  cjb111_ai2.seq
      601     T G A G C A A A C C C A A A G T A C C T T G G C A C A A C A G T T T C C A T A T A C T C T T A G G C  h36b_ai2.seq

              A T A T A G T A C T G C A A T A A A A T A A T A A T A C T C C C A A A T A T C A T A A A T G T T C C  Majority
                          660                 670                 680                 690                 700
      651     A T A T A G T A C T G C A A T A A A A T A A T A A T A C T C C C A A A T A T C A T A A A T G T T C C  2603_ai2.seq
      651     A T A T A G T A C T G C A A T A A A A T A A T A A T A C T C C C A A A T A T C A T A A A T G T T C C  18rs21_ai2.seq
      651     A T A T A G T A C T G C A A T A A A A T A A T A A T A C T C C C A A A T A T C A T A A A T G T T C C  515_ai2.seq
      651     A T A T A G T A C T G C A A T A A G A T A A T A A T A C T C C C A A A T A T C A T A A A T G T T C C  cjb111_ai2.seq
      651     A T A T A G T A C T G C A A T A A A A T A A T A A T A C T C C C A A A T A T C A T A A A T G T T C C  h36b_ai2.seq

              C A T C G A G T G C C C A C T G G G A A A C G A A T A G C C A C C T G C A A A T A C T A A A T G G G  Majority
                          710                 720                 730                 740                 750
      701     C A T C G A G T G C C C A C T G G G A A A C G A A T A G C C A C C T G C A A A T A C T A A A T G G G  2603_ai2.seq
      701     C A T C G A G T G C C C A C T G G G A A A C G A A T A G C C A C C T G C A A A T A C T A A A T G G G  18rs21_ai2.seq
      701     C A T C G A G T G C C C A C T G G G A A A C G A A T A G C C A C C T G C A A A T A C T A A A T G G G  515_ai2.seq
      701     C A T C G A G T G C C C A C T G G G A A A C G A A T A G C C A C C T G C A A A T A C T A A A T G G G  cjb111_ai2.seq
      701     C A T C G A G T G C C C A C T G G G A A A C G A A T A G C C A C C T G C A A A T A C T A A A T G G G  h36b_ai2.seq

              T T A A A G T T G G T C T T A C T C T T T G A A A A A T A A G T T T T A A A G A A A G T A T A C A T  Majority
                          760                 770                 780                 790                 800
      751     T T A A A G T T G G T C T T A C T C T T T G A A A A A T A A G T T T T A A A G A A A G T A T A C A T  2603_ai2.seq
      751     T T A A A G T T G G T C T T A C T C T T T G A A A A A T A A G T T T T A A A G A A A G T A T A C A T  18rs21_ai2.seq
      751     G T A A A G T T G G T C T T A C T C T T T G A A A A A T A A G T T T T A A A G A A A G T A T A C A T  515_ai2.seq
      751     T T A A A G T T G G T C T T A C T C T T T G A A A A A T A A G T T T T A A A G A A A G T A T A C A T  cjb111_ai2.seq
      751     T T A A A G T T G G T C T T A C T C T T T G A A A A A T A A G T T T T A A A G A A A G T A T A C A T  h36b_ai2.seq

              A T A C C A G A G A T A A T A G C A T T T A C T G C G A T A A A T C T A G C T T G A G G A T A C C A  Majority
                          810                 820                 830                 840                 850
      801     A T A C C A G A G A T A A T A G C A T T T A C T G C G A T A A A T C T A G C T T G A G G A T A C C A  2603_ai2.seq
      801     A T A C C A G A G A T A A T A G C A T T T A C T G C G A T A A A T C T A G C T T G A G G A T A C C A  18rs21_ai2.seq
      801     A T A C C A G A G A T A A T A G C A T T T A C T G C G A T A A A T C T A G C T T G A G G A T A C C A  515_ai2.seq
      801     A T A C C A G A G A T A A T A G C A T T T A C T G C G A T A A A T C T A G C T T G A G G A T A C C A  cjb111_ai2.seq
      801     A T A C C A G A G A T A A T A G C A T T T A C T G C G A T A A A T C T A G C T T G A G G A T A C C A  h36b_ai2.seq

              C T T C T T A A G G T A A C A G A A A G T G A C G C T C A T A A T C G C A A T A G C T A T C T G G C  Majority
                          860                 870                 880                 890                 900
      851     C T T C T T A A G G T A A C A G A A A G T G A C G C T C A T A A T C G C A A T A G C T A T C T G G C  2603_ai2.seq
      851     C T T C T T A A G G T A A C A G A A A G T G A C G C T C A T A A T C G C A A T A G C T A T C T G G C  18rs21_ai2.seq
      851     C T T C T T A A G G T A A C A G A A A G T G A C G C T C A T A A T C G C A A T A G C T A T C T G G C  515_ai2.seq
      851     C T T C T T A A G G T A A C A G A A A G T G A C G C T C A T A A T C G C A A T A G C T A T C T G G C  cjb111_ai2.seq
      851     C T T C T T A A G G T A A C A G A A A G T G A C G C T C A T A A T C G C A A T A G C T A T C T G G C  h36b_ai2.seq
```

FIGURE 19C

Alignment Report of Ai-2_alignment, using J. Hein method with Weighted residue weight table.
Thursday, July 29, 2004 6:32 PM

```
     TTACAGTATTACCAATCACAGTGATTAACTTGAAAAATCTTGTAGAAAGA Majority
               910       920       930       940       950
901  TTACAGTATTACCAATCACAGTGATTAACTTGAAAAATCTTGTAGAAAGA 2603_ai2.seq
901  TTACAGTATTACCAATCACAGTGATTAACTTGAAAAATCTTGTAGAAAGA 18rs21_ai2.seq
901  TTACAGTATTACCAATCACAGTGATTAACTTGAAAAATCTTGTAGAAAGA 515_ai2.seq
901  TTACAGTATTACCAATCACAGTGATTAACTTGAAAAATCTTGTAGAAAGA cjb111_ai2.seq
901  TTACAGTATTACCAATCACAGTGATTAACTTGAAAAATCTTGTAGAAAGA h36b_ai2.seq

     TTTGGCAACTGTCCTCTAACACTTTCTTGAATAGTTTGGTCAAATGAAAT Majority
               960       970       980       990      1000
951  TTTGGCAACTGTCCTCTAACACTTTCTTGAATAGTTTGGTCAAATGAAAT 2603_ai2.seq
951  TTTGGCAACTGTCCTCTAACACTTTCTTGAATAGTTTGGTCAAATGAAAT 18rs21_ai2.seq
951  TTTGGCAACTGTCCTCTAACACTTTCTTGAATAGTTTGGTCAAATGCAAT 515_ai2.seq
951  TTTGGCAACTGTCCTCTAACACTTTCTTGAATAGTTTGGTCAAATGAAAT cjb111_ai2.seq
951  TTTGGCAACTGTCCTCTAACACTTTCTTGAATAGTTTGGTCAAATGAAAT h36b_ai2.seq

     TACAGTGTCGGGCCAATATTTGATGACCAATCCTAAACTGAAAAATAAGA Majority
              1010      1020      1030      1040      1050
1001 TACAGTGTCGGGCCAATATTTGATGACCAATCCTAAACTGAAAAATAAGA 2603_ai2.seq
1001 TACAGTGTCGGGCCAATATTTGATGACCAATCCTAAACTGAAAAATAAGA 18rs21_ai2.seq
1001 TACAGTGTCGGGCCAATATTTGATGACCAATCCTAAACTGAAAAATAAGA 515_ai2.seq
1001 TACAGTGTCGGGCCAATATTTGATGACCAATCCTAAACTGAAAAATAAGA cjb111_ai2.seq
1001 TACAGTGTCGGGCCAATATTTGATGACCAATCCTAAACTGAAAAATAAGA h36b_ai2.seq

     TAATAGCAATAAATGCTTGAATAAGTTTACTATTTTGACGAGATAACATT Majority
              1060      1070      1080      1090      1100
1051 TAATAGCAATAAATGCTTGAATAAGTTTACTATTTTGACGAGATAACATT 2603_ai2.seq
1051 TAATAGCAATAAATGCTTGAATAAGTTTACTATTTTGACGAGATAACATT 18rs21_ai2.seq
1051 TAATAGCAATAAATGCTTGAATAAGTTTACTATTTTGACGAGATAACATT 515_ai2.seq
1051 TAATAGCAATAAATGCTTGAATAAGTTTACTATTTTGACGAGATAACATT cjb111_ai2.seq
1051 TAATAGCAATAAATGCTTGAATAAGTTTACTATTTTGACGAGATAACATT h36b_ai2.seq

     AGTCTTTTTATATCTTTCTAATATTGGCAAACAAGCCACGTAAGTTAGAT Majority
              1110      1120      1130      1140      1150
1101 AGTCTTTTTATATCTTTCTAATATTGGCAAACAAGCCACGTAAGTTAGAT 2603_ai2.seq
1101 AGTCTTTTTATATCTTTCTAATATTGGCAAACAAGCCACGTAAGTTAGAT 18rs21_ai2.seq
1101 AGTCTTTTTATATCTTTCTAATATTGGCAAACAAGCCACGTAAGTTAGAT 515_ai2.seq
1101 AGTCTTTTTATATCTTTCTAATATTGGCAAACAAGCCACGTAAGTTAGAT cjb111_ai2.seq
1101 AGTCTTTTTATATCTTTCTAATATTGGCAAACAAGCCACGTAAGTTAGAT h36b_ai2.seq

     AGAAAACAATCGAAATTAAAATTCCCTCAACGATATTAAATGGAATAACC Majority
              1160      1170      1180      1190      1200
1151 AGAAAACAATCGAAATTAAAATTCCCTCAACGATATTAAATGGAATAACC 2603_ai2.seq
1151 AGAAAACAATCGAAATTAAAATTCCCTCAACGATATTAAATGGAATAACC 18rs21_ai2.seq
1151 AGAAAACAATCGAAATTAAAATTCCCTCAACGATATTAAATGGAATAACC 515_ai2.seq
1151 AGAAAACAATCGAAATTAAAATTCCCTCAACGATATTAAATGGAATAACC cjb111_ai2.seq
1151 AGAAAACAATCGAAATTAAAATTCCCTCAACGATATTAAATGGAATAACC h36b_ai2.seq

     ATTGTTAAAAGGTAATTGCCTACACCAATAAATGTTCTGATATCAAAGTT Majority
              1210      1220      1230      1240      1250
1201 ATTGTTAAAAGGTAATTGCCTACACCAATAAATGTTCTGATATCAAAGTT 2603_ai2.seq
1201 ATTGTTAAAAGGTAATTGCCTACACCAATAAATGTTCTGATATCAAAGTT 18rs21_ai2.seq
1201 ATTGTTAAAAGGTAATTGCCTACACCAATAAATGTTCTGATATCAAAGTT 515_ai2.seq
1201 ATTGTTAAAAGGTAATTGCCTACACCAATAAATGTTCTGATATCAAAGTT cjb111_ai2.seq
1201 ATTGTTAAAAGGTAATTGCCTACACCAATAAATGTTCTGATATCAAAGTT h36b_ai2.seq

     AGCAAATATAGCATACAAAGGAATCGCAAAGACATAGTTGAGAGCTACCA Majority
              1260      1270      1280      1290      1300
1251 AGCAAATATAGCATACAAAGGAATCGCAAAGACATAGTTGAGAGCTACCA 2603_ai2.seq
1251 AGCAAATATAGCATACAAAGGAATCGCAAAGACATAGTTGAGAGCTACCA 18rs21_ai2.seq
1251 AGCAAATATAGCATACAAAGGAATCGCAAAGACATAGTTGAGAGCTACCA 515_ai2.seq
1251 AGCAAATATAGCATACAAAGGAATCGCAAAGACATAGTTGAGAGCTACCA cjb111_ai2.seq
1251 AGCAAATATAGCATACAAAGGAATCGCAAAGACATAGTTGAGAGCTACCA h36b_ai2.seq

     TAGATACGGTCAAGCTAACTGTACCAAATAGACTAGCTTTAATAAAATCT Majority
              1310      1320      1330      1340      1350
1301 TAGATACGGTCAAGCTAACTGTACCAAATAGACTAGCTTTAATAAAATCT 2603_ai2.seq
1301 TAGATACGGTCAAGCTAACTGTACCAAATAGACTAGCTTTAATAAAATCT 18rs21_ai2.seq
1301 TAGATACAGTCAAGCTAACTGTACCAAATAGACTAGCTTTAATAAAATCT 515_ai2.seq
1301 TAGATACGGTCAAGCTAACTGTACCAAATAGACTAGCTTTAATAAAATCT cjb111_ai2.seq
1301 TAGATACGGTCAAGCTAACTGTACCAAATAGACTAGCTTTAATAAAATCT h36b_ai2.seq
```

FIGURE 19D

Alignment Report of Ai-2_alignment, using J. Hein method with Weighted residue weight table.
Thursday, July 29, 2004 6:32 PM

```
           T T T G C A C T C T C T C T A T T T T T C C A G A A A A T A G C G A A A C T T G C T A A A A A T A A  Majority
                       1360                1370                1380                1390                1400
1351       T T T G C A C T C T C T C T A T T T T T C C A G A A A A T A G C G A A A C T T G C T A A A A A T A A  2603_ai2.seq
1351       T T T G C A C T C T C T C T A T T T T T C C A G A A A A T A G C G A A A C T T G C T A A A A A T A A  18rs21_ai2.seq
1351       T T T G C A C T C T C T C T A T T T T T C C A G A A A A T A G C G A A A C T T G C T A A A A A T A A  515_ai2.seq
1351       T T T G C A C T C T C T C T A T T T T T C C A G A A A A T A G C G A A A C T T G C T A A A A A T A A  cjb111_ai2.seq
1351       T T T G C A C T C T C T C T A T T T T T C C A G A A A A T A G C G A A A C T T G C T A A A A A T A A  h36b_ai2.seq

           A G C T A G A G C A A C C A T A T T C A T C G G T A A A C C A A T A A A C G T T T C T G G A C C A C  Majority
                       1410                1420                1430                1440                1450
1401       A G C T A G A G C A A C C A T A T T C A T C G G T A A A C C A A T A A A C G T T T C T G G A C C A C  2603_ai2.seq
1401       A G C T A G A G C A A C C A T A T T C A T C G G T A A A C C A A T A A A C G T T T C T G G A C C A C  18rs21_ai2.seq
1401       A G C T A G A G C A A C C A T A T T C A T C G G T A A A C C G A T A A A G G T T T C T G G A C C A C  515_ai2.seq
1401       A G C T A G A G C A A C C A T A T T C A T C G G T A A A C C A A T A A A C G T T T C T G G A C C A C  cjb111_ai2.seq
1401       A G C T A G A G C A A C C A T A T T C A T C G G T A A A C C A A T A A A C G T T T C T G G A C C A C  h36b_ai2.seq

           G A T T A G C A A G T A T A A C T T T T A A A A G T G A T C T T A A T A A G A G T A C A C C A T A A  Majority
                       1460                1470                1480                1490                1500
1451       G A T T A G C A A G T A T A A C T T T T A A A A G T G A T C T T A A T A A G A G T A C A C C A T A A  2603_ai2.seq
1451       G A T T A G C A A G T A T A A C T T T T A A A A G T G A T C T T A A T A A G A G T A C A C C A T A A  18rs21_ai2.seq
1451       G A T T A G C A A G T A T A A C T T T T A A A A G T G A T C T T A A T A A G A G T A C A C C A T A A  515_ai2.seq
1451       G A T T A G C A A G T A T A A C T T T T A A A A G T G A T C T T A A T A A G A G T A C A C C A T A A  cjb111_ai2.seq
1451       G A T T A'G C A A G T A T A A C T T T T A A A A G T G A T C T T A A T A A G A G T A C A C C A T A A  h36b_ai2.seq

           C T T G A T T T C A A A T C A A A T A A A A T A A A A G C A A C T A A C A T C G G A A G G A T T G A  Majority
                       1510                1520                1530                1540                1550
1501       C T T G A T T T C A A A T C A A A T A A A A T A A A A G C A A C T A A C A T C G G A A G G A T T G A  2603_ai2.seq
1501       C T T G A T T T C A A A T C A A A T A A A A T A A A A G C A A C T A A C A T C G G A A G G A T T G A  18rs21_ai2.seq
1501       C T T G A T T T C A A A T C A A A T A A A A T A A A A G T A A C T A A C A T C G G A A G G A T T G A  515_ai2.seq
1501       C T T G A T T T C A A A T C A A A T A A A A T A A A A G C A A C T A A C A T C G G A A G G A T T G A  cjb111_ai2.seq
1501       C T T G A T T T C A A A T C A A A T A A A A T A A A A G C A A C T A A C A T C G G A A G G A T T G A  h36b_ai2.seq

           A A A A T C A A C C T T T A A A A A T T C T G C T C C T G G T A T T A A T G G A A A T G A A A C C A  Majority
                       1560                1570                1580                1590                1600
1551       A A A A T C A A C C T T T A A A A A T T C T G C T C C T G G T A T T A A T G G A A A T G A A A C C A  2603_ai2.seq
1551       A A A A T C A A C C T T T A A A A A T T C T G C T C C T G G T A T T A A T G G A A A T G A A A C C A  18rs21_ai2.seq
1551       A A A A T C A A C C T T T A A A A A T T C T G C T C C T G G T A T T A A T G G A A A T G A A A C C A  515_ai2.seq
1551       A A A A T C A A C C T T T A A A A A T T C T G C T C C T G G T A T T A A T G G A A A T G A A A C C A  cjb111_ai2.seq
1551       A A A A T C A A C C T T T A A A A A T T C T G C T C C T G G T A T T A A T G G A A A T G A A A C C A  h36b_ai2.seq

           T C A T C A A T A C A A A A G A T A A G G C A G A A A G A A T G G C G A T T G T C A C C A T T T T A  Majority
                       1610                1620                1630                1640                1650
1601       T C A T C A A T A C A A A A G A T A A G G C A G A A A G A A T G G C G A T T G T C A C C A T T T T A  2603_ai2.seq
1601       T C A T C A A T A C A A A A G A T A A G G C A G A A A G A A T G G C G A T T G T C A C C A T T T T A  18rs21_ai2.seq
1601       T C A T C A A T A C A A A A G A T A A G G C A G A A A G A A T G G C G A T T G T C A C C A T T T T A  515_ai2.seq
1601       T C A T C A A T A C A A A A G A T A A G G C A G A A A G A A T G G C G A T T G T C A C C A T T T T A  cjb111_ai2.seq
1601       T C A T C A A T A C A A A A G A T A A G G C A G A A A G A A T G G C G A T T G T C A C C A T T T T A  h36b_ai2.seq

           C G T G T A T T T G T C A T A A A A A A A T T C C T C C A A T T T A A A T A A A T T G A A A G A A G  Majority
                       1660                1670                1680                1690                1700
1651       C G T G T A T T T G T C A T A A A A A A A T T C C T C C A A T T T A A A T A A A T T G A A A G A A G  2603_ai2.seq
1651       C G T G T A T T T G T C A T A A A A A A A T T C C T C C A A T T T A A A T A A A T T G A A A G A A G  18rs21_ai2.seq
1651       C G T G T A T T T G T C A T A A A A A A A T T C C T C C A A T T T A A A T A A A T T G A A A G A A G  515_ai2.seq
1651       C G T G T A T T T G T C A T A A A A A A A T T C C T C C A A T T T A A A T A A A T T G A A A G A A G  cjb111_ai2.seq
1651       C G T G T A T T T G T C A T A A A A A A A T T C C T C C A A T T T A A A T A A A T T G A A A G A A G  h36b_ai2.seq

           C T C C A A A G G T A A G C G T A T G T A C G C G A A A A A A - C C T T T G T C T T C T C C C A T C  Majority
                       1710                1720                1730                1740                1750
1701       C T C C A A A G G T A A G C G T A T G T A C G C G A A A A A A - C C T T T G T C T T C T C C C A T C  2603_ai2.seq
1701       C T C C A A A G G T A A G C G T A T G T A C G C G A A A A A A - C C T T T G T C T T C T C C C A T C  18rs21_ai2.seq
1701       C T C C A A A G G T A A G C G T A G G T A C G C G A A A A A A A C C T T T G T C T T C T C C C A T C  515_ai2.seq
1701       C T C C A A A G G T A A G C G T A T G T A C G C G A A A A A A - C C T T T G T C T T C T C C C A T C  cjb111_ai2.seq
1701       C T C C A A A G G T A A G C G T A T G T A C G C G A A A A A A - C C T T T G T C T T C T C C C A T C  h36b_ai2.seq

           C A G A C T T T A C T G T C G G T T G T G G A A T C T C A C C A C A T C A G C T T T C G C T C G C G  Majority
                       1760                1770                1780                1790                1800
1750       C A G A C T T T A C T G T C G G T T G T G G A A T C T C A C C A C A T C A G C T T T C G C T C G C G  2603_ai2.seq
1750       C A G A C T T T A C T G T C G G T T G T G G A A T C T C A C C A C A T C A G C T T T C G C T C G C G  18rs21_ai2.seq
1751       C A G A C T T T A C T G T C G G T T G T G G A A T C T C A C C A C A T C A G C T T T C G C T C G C G  515_ai2.seq
1750       C A G A C T T T A C T G T C G G T T G T G G A A T C T C A C C A C A T C A G C T T T C G C T C G C G  cjb111_ai2.seq
1750       C A G A C T T T A C T G T C G G T T G T G G A A T C T C A C C A C A T C A G C T T T C G C T C G C G  h36b_ai2.seq
```

FIGURE 19E

Alignment Report of Ai-2_alignment, using J. Hein method with Weighted residue weight table.
Thursday, July 29, 2004 6:32 PM

```
     G A C T G A T G C T T C A C A A C T G A C A A A T A A G T T G G A A G C G A T T A C C G C C G G T C Majority
                         1810                1820                1830                1840                1850
1800 G A C T G A T G C T T C A C A A C T G A C A A A T A A G T T G G A A G C G A T T A C C G C C G G T C 2603_ai2.seq
1800 G A C T G A T G C T T C A C A A C T G A C A A A T A A G T T G G A A G C G A T T A C C G C C G G T C 18rs21_ai2.seq
1801 G A C T G A T G C T T C A C A A C T G A C A A A T A A G T T G G A A G C G A T T A C C G C C G G T C 515_ai2.seq
1800 G A C T G A T G C T T C A C A A C T G A C A A A T A A G T T G G A A G C G A T T A C C G C C G G T C cjb111_ai2.seq
1800 G A C T G A T G C T T C A C A A C T G A C A A A T A A G T T G G A A G C G A T T A C C G C C G G T C h36b_ai2.seq

     G G G A A T T A C A C C C T G C C C T G A A G A C A C C T A T A G C A T A A C A A A A A A A A C T T Majority
                         1860                1870                1880                1890                1900
1850 G G G A A T T A C A C C C T G C C C T G A A G A C A C C T A T A G C A T A A C A A A A A A A A C T T 2603_ai2.seq
1850 G G G A A T T A C A C C C T G C C C T G A A G A C A C C T A T A G C A T A A C A A A A A A A A C T T 18rs21_ai2.seq
1851 G G G A A T T A C A C C C T G C C C T G A A G A C A C C T A T A G C A T A A C A A A A A A A A C T T 515_ai2.seq
1850 G G G A A T T A C A C C C T G C C C T G A A G A C A C C T A T A G C A T A A C A A A A A A A A C T T cjb111_ai2.seq
1850 G G G A A T T A C A C C C T G C C C T G A A G A C A C C T A T A G C A T A A C A A A A A A A A C T T h36b_ai2.seq

     G C A A T T G C A A G T T T T T T A A T T A C T A A T T A G T A G T A G T G A T T A A A A A T C A T Majority
                         1910                1920                1930                1940                1950
1900 G C A A T T G C A A G T T T T T T A A T T A C T A A T T A G T A G T A G T G A T T A A A A A T C A T 2603_ai2.seq
1900 G C A A T T G C A A G T T T T T T A A T T A C T A A T T A G T A G T A G T G A T T A A A A A T C A T 18rs21_ai2.seq
1901 G C A A T T G C A A G T T T T T T A A T T A C T A A T T A G T A G T A G T G A T T A A A A A T C A T 515_ai2.seq
1900 G C A A T T G C A A G T T T T T T A A T T A C T A A T T A G T A G T A G T G A T T A A A A A T C A T cjb111_ai2.seq
1900 G C A A T T G C A A G T T T T T T A A T T A C T A A T T A G T A G T A G T G A T T A A A A A T C A T h36b_ai2.seq

     A T T A A T A C C A A A T T A C T A T A C T G T A T C G T T T C T T T C A G A T T T G C T A T T T T Majority
                         1960                1970                1980                1990                2000
1950 A T T A A T A C C A A A T T A C T A T A C T G T A T C G T T T C T T T C A G A T T T G C T A T T T T 2603_ai2.seq
1950 A T T A A T A C C A A A T T A C T A T A C T G T A T C G T T T C T T T C A G A T T T G C T A T T T T 18rs21_ai2.seq
1951 A T T A A T A C C A A A T T A C T A T A C T G T A T C G T T T C T T T C A G A T T T G C T A T T T T 515_ai2.seq
1950 A T T A A T A C C A A A T T A C T A T A C T G T A T C G T T T C T T T C A G A T T T G C T A T T T T cjb111_ai2.seq
1950 A T T A A T A C C A A A T T A C T A T A C T G T A T C G T T T C T T T C A G A T T T G C T A T T T T h36b_ai2.seq

     T A G T T T T T C T T A A A A A G A T A A A C A A A A T T C C C A A A A T A A T A C A A C C A A G A Majority
                         2010                2020                2030                2040                2050
2000 T A G T T T T T C T T A A A A A G A T A A A C A A A A T T C C C A A A A T A A T A C A A C C A A G A 2603_ai2.seq
2000 T A G T T T T T C T T A A A A A G A T A A A C A A A A T T C C C A A A A T A A T A C A A C C A A G A 18rs21_ai2.seq
2001 T A G T T T T T C T T A A A A A G A T A A A C A A A A T T C C C A A A A T A A T A C A A C C A A G A 515_ai2.seq
2000 T A G T T T T T C T T A A A A A G A T A A A C A A A A T T C C C A A A A T A A T A C A A C C A A G A cjb111_ai2.seq
2000 T A G T T T T T C T T A A A A A G A T A A A C A A A A T T C C C A A A A T A A T A C A A C C A A G A h36b_ai2.seq

     A T T G T C A G T C C T C C A C C A A T A A T C A T T C C T G T T T T A G G A A G A A A T G A T T G Majority
                         2060                2070                2080                2090                2100
2050 A T T G T C A G T C C T C C A C C A A T A A T C A T T C C T G T T T T A G G A A G A A A T G A T T G 2603_ai2.seq
2050 A T T G T C A G T C C T C C A C C A A T A A T C A T T C C T G T T T T A G G A A G A A A T G A T T G 18rs21_ai2.seq
2051 A T T G T C A G T C C T C C A C C A A T A A T C A T T C C T G T T T T A G G A A G A A A T G A T T G 515_ai2.seq
2050 A T T G T C A G T C C T C C A C C A A T A A T C A T T C C T G T T T T A G G A A G A A A T G A T T G cjb111_ai2.seq
2050 A T T G T C A G T C C T C C G C C A A T A A T C A T T C C T G T T T T A G G A A G A A A T G A T T G h36b_ai2.seq

     T G G A A A A A G C G G T T G T G A T G G T T T A G G A T T T G T T G G T G G A G G A G T T T C T T Majority
                         2110                2120                2130                2140                2150
2100 T G G A A A A A G C G G T T G T G A T G G T T T A G G A T T T G T T G G T G G A G G A G T T T C T T 2603_ai2.seq
2100 T G G A A A A A G C G G T T G T G A T G G T T T A G G A T T T G T T G G T G G A G G A G T T T C T T 18rs21_ai2.seq
2101 T G G A A A A A G C G G T T G T G A T G G T T T A G G A T T T G T T G G T G G A G G A G T T T C T T 515_ai2.seq
2100 T G G A A A A A G C G G T T G T G A T G G T T T A G G A T T T G T T G G T G G A G G A G T T T C T T cjb111_ai2.seq
2100 T G G A A A A A G C G G T T G T G A T G G T T T A G G A T T T G T T G G T G G A G G A G T T T C T T h36b_ai2.seq

     T T T C G T T T T C T A C C T C T A C T T C C T G T G T T T T A T T A G C A A C T A C A G C A A C T Majority
                         2160                2170                2180                2190                2200
2150 T T T C G T T T T C T A C C T C T A C T T C C T G T G T T T T A T T A G C A A C T A C A G C A A C T 2603_ai2.seq
2150 T T T C G T T T T C T A C C T C T A C T T C C T G T G T T T T A T T A G C A A C T A C A G C A A C T 18rs21_ai2.seq
2151 T T T C G T T T T C T A C C T C T A C T T C C T G T G T T T T A T T A G C A A C T A C A G C A A C T 515_ai2.seq
2150 T T T C G T T T T C T A C C T C T A C T T C C T G T G T T T T A T T A G C A A C T A C A G C A A C T cjb111_ai2.seq
2150 T T T C G T T T T C T A C C T C T A C T T C C T G T G T T T T A T T A G C A A C T A C A G C A A C T h36b_ai2.seq

     A C A G C A T C C T T C A T A G A T A T A C G G T A A C C A G T T A G T G C T T T T G C T T C T C G Majority
                         2210                2220                2230                2240                2250
2200 A C A G C A T C C T T C A T A G A T A T A C G G T A A C C A G T T A G T G C T T T T G C T T C T C G 2603_ai2.seq
2200 A C A G C A T C C T T C A T A G A T A T A C G G T A A C C A G T T A G T G C T T T T G C T T C T C G 18rs21_ai2.seq
2201 A C A G C A T C C T T C A T A G A T A T A C G G T A A C C A G T T A G T G C T T T T A C T T C T C G 515_ai2.seq
2200 A C A G C A T C C T T C A T A G A T A T A C G G T A A C C A G T T A G T G C T T T T G C T T C T C G cjb111_ai2.seq
2200 A C A G C A T C C T T C A T A G A T A T A C G G T A A C C A G T T A G T G C T T T T G C T T C T C G h36b_ai2.seq
```

FIGURE 19F

Alignment Report of Ai-2_alignment, using J. Hein method with Weighted residue weight table.
Thursday, July 29, 2004 6:32 PM

```
     A A A A A T A T A C T T A C C A G G T A A T A A A C C T T C A A C C T C A A T T T C T C C C T T A T Majority
                         2260                2270                2280                2290                2300
2250 A A A A A T A T A C T T A C C A G G T A A T A A A C C T T C A A C C T C A A T T T C T C C C T T A T 2603_ai2.seq
2250 A A A A A T A T A C T T A C C A G G T A A T A A A C C T T C A A C C T C A A T T T C T C C C T T A T 18rs21_ai2.seq
2251 A A A A A T A T A C T T A C C A G G T A A T A A A C C T T C A A C C T C A A T T T C T C C C T T A T 515_ai2.seq
2250 A A A A A T A T A C T T A C C A G G T A A T A A A C C T T C A A C C T C A A T T T C T C C C T T A T cjb111_ai2.seq
2250 A A A A A T A T A C T T A C C A G G T A A T A A A C C T T C A A C C T C A A T T T C T C C C T T A T h36b_ai2.seq

     C A T C A G T T A C T A A T G A A G T A A T C C C A T C T T G A T C G G T C G T A A A T C G T C C A Majority
                         2310                2320                2330                2340                2350
2300 C A T C A G T T A C T A A T G A A G T A A T C C C A T C T T G A T C G G T C G T A A A T C G T C C A 2603_ai2.seq
2300 C A T C A G T T A C T A A T G A A G T A A T C C C A T C T T G A T C G G T C G T A A A T C G T C C A 18rs21_ai2.seq
2301 C A T C A G T T A C T A A T G A A G T A A T C C C A T C T T G A T C G G T C G T A A A T C G T C C A 515_ai2.seq
2300 C A T C A G T T A C T A A T G A A G T A A T C C C A T C T T G A T C G G T C G T A A A T C G T C C A cjb111_ai2.seq
2300 C A T C A G T T A C T A A T G A A G T A A T C C C A T C T T G A T C G G T C G T A A A T C G T C C A h36b_ai2.seq

     T T T T T A A A G C G A A C T G G C T G A T T C T G G T T A T C G T A T A A T A C A A A T A T T A C Majority
                         2360                2370                2380                2390                2400
2350 T T T T T A A A G C G A A C T G G C T G A T T C T G G T T A T C G T A T A A T A C A A A T A T T A C 2603_ai2.seq
2350 T T T T T A A A G C G A A C T G G C T G A T T C T G G T T A T C G T A T A A T A C A A A T A T T A C 18rs21_ai2.seq
2351 T T T T T A A A G C G A A C T G G C T G A T T C T G G T T A T C G T A T A A T A C A A A T A T T A C 515_ai2.seq
2350 T T T T T A A A G C G A A C T G G C T G A T T C T G G T T A T C G T A T A A T A C A A A T A T T A C cjb111_ai2.seq
2350 T T T T T A A A G C G A A C T G G C T G A T T C T G G T T A T C G T A T A A T A C A A A T A T T A C h36b_ai2.seq

     T C C G G A T A G C C T T T T C T T T A T C T T T C C T T C T T T T G T A T A T T T A A T A A G T T Majority
                         2410                2420                2430                2440                2450
2400 T C C G G A T A G C C T T T T C T T T A T C T T T C C T T C T T T T G T A T A T T T A A T A A G T T 2603_ai2.seq
2400 T C C G G A T A G C C T T T T C T T T A T C T T T C C T T C T T T T G T A T A T T T A A T A A G T T 18rs21_ai2.seq
2401 T C C T G A T A G C C T T T T C T T T A T C T T T C C T T C T T T T G T A T A T T T A A T A A G T T 515_ai2.seq
2400 T C C G G A T A G C C T T T T C T T T A T C T T T C C T T C T T T T G T A T A T T T A A T A A G T T cjb111_ai2.seq
2400 T C C G G A T A G C C Y T T T C T T T A T C T T T C C T T C T T T T G K A T A T T T A A T A A G T T h36b_ai2.seq

     T T A A T C G G C C T G T T T C A A C T T T T C G C T T A G G A T T T A T C T G T A A T T G A T T T Majority
                         2460                2470                2480                2490                2500
2450 T T A A T C G G C C T G T T T C A A C T T T T C G C T T A G G A T T T A T C T G T A A T T G A T T T 2603_ai2.seq
2450 T T A A T C G G C C T G T T T C A A C T T T T C G C T T A G G A T T T A T C T G T A A T T G A T T T 18rs21_ai2.seq
2451 T T A A T C G G C C T G T T T C A A C T T T T C G C T T A G G A T T T A T C T G T A A T T G A T T T 515_ai2.seq
2450 T T A A T C G G C C T G T T T C A A C T T T T C G C T T A G G A T T T A T C T G T A A T T G A T T T cjb111_ai2.seq
2450 T T A A T C G G C C T G T T T C A A C T T T T C G C T T A G G A T T T A T C T G T A A T T G A T T T h36b_ai2.seq

     G A T A A C T T A T C A T C T G G T A A T T C A A T A T A A A A A G G T A C T A T T G T T G A A A C Majority
                         2510                2520                2530                2540                2550
2500 G A T A A C T T A T C A T C T G G T A A T T C A A T A T A A A A A G G T A C T A T T G T T G A A A C 2603_ai2.seq
2500 G A T A A C T T A T C A T C T G G T A A T T C A A T A T A A A A A G G T A C T A T T G T T G A A A C 18rs21_ai2.seq
2501 G A T A A C T T A T C A T C T G G T A A T T C A A T A T A A A A A G G T A C T A T T G T T G A A A C 515_ai2.seq
2500 G A T A A C T T A T C A T C T G G T A A T T C A A T A T A A A A A G G T A C T A T T G T T G A A A C cjb111_ai2.seq
2500 G A T A A C T T A T C A T C T G G T A A T T C A A T A T A A A A A G G T A C T A T T G T T G A A A C h36b_ai2.seq

     G C T T T G A T C A G C T T T A T A A G C A C G A C C A A A G T A C G A A C C A T T T G G G A G T G Majority
                         2560                2570                2580                2590                2600
2550 G C T T T G A T C A G C T T T A T A A G C A C G A C C A A A G T A C G A A C C A T T T G G G A G T G 2603_ai2.seq
2550 G C T T T G A T C A G C T T T A T A A G C A C G A C C A A A G T A C G A A C C A T T T G G G A G T G 18rs21_ai2.seq
2551 G C T T T G A T C A G C T T T A T A A G C A C G A C C A A A G T A C G A A C C A T T T G G G A G T G 515_ai2.seq
2550 G C T T T G A T C A G C T T T A T A A G C A C G A C C A A A G T A C G A A C C A T T T G G G A G T G cjb111_ai2.seq
2550 G C T T T G A T C A G C T T T A T A A G C A C G A C C A A A G T A C G A A C C A T T T G G G A G T G h36b_ai2.seq

     C T A T C T T T G T C T G A C C A T T A G T A T C A G T A G G A G A A G T C A A G A T A C T C T T A Majority
                         2610                2620                2630                2640                2650
2600 C T A T C T T T G T C T G A C C A T T A G T A T C A G T A G G A G A A G T C A A G A T A C T C T T A 2603_ai2.seq
2600 C T A T C T T T G T C T G A C C A T T A G T A T C A G T A G G A G A A G T C A A G A T A C T C T T A 18rs21_ai2.seq
2601 C T A T C T T T G T C T G A C C A T T A G T A T C A G T A G G A G A A G T C A A G A T A C T C T T A 515_ai2.seq
2600 C T A T C T T T G T C T G A C C A T T A G T A T C A G T A G G A G A A G T C A A G A T A C T C T T A cjb111_ai2.seq
2600 C T A T C T T T G T C T G A C C A T T A G T A T C A G T A G G A G A A G T C A A G A T A C T C T T A h36b_ai2.seq

     T A C T T C T G G T T C A A T T C G C T A T C T G T C A T T T G G C T C A A T A A A T C A A C T T T Majority
                         2660                2670                2680                2690                2700
2650 T A C T T C T G G T T C A A T T C G C T A T C T G T C A T T T G G C T C A A T A A A T C A A C T T T 2603_ai2.seq
2650 T A C T T C T G G T T C A A T T C G C T A T C T G T C A T T T G G C T C A A T A A A T C A A C T T T 18rs21_ai2.seq
2651 T A C T T C T G G T T C A A T T C G C T A T C T G T C A T T T G G C T C A A T A A A T C A A C T T T 515_ai2.seq
2650 T A C T T C T G G T T C A A T T C G C T A T C T G T C A T T T G G C T C A A T A A A T C A A C T T T cjb111_ai2.seq
2650 T A C T T C T G G T T C A A T T C G C T A T C T G T C A T T T G G C T C A A T A A A T C A A C T T T h36b_ai2.seq
```

FIGURE 19G

Alignment Report of Ai-2_alignment, using J. Hein method with Weighted residue weight table.
Thursday, July 29, 2004 6:32 PM

```
     TAAGTTGTCAGTCACAGTCCATAAACGATAAGAAATCCCCTCCTCTGTAG Majority
              2710      2720      2730      2740      2750
2700 TAAGTTGTCAGTCACAGTCCATAAACGATAAGAAATCCCCTCCTCTGTAG 2603_ai2.seq
2700 TAAGTTGTCAGTCACAGTCCATAAACGATAAGAAATCCCCTCCTCTGTAG 18rs21_ai2.seq
2701 TAAGTTGTCAGTCACAGTCCATAAACGATAAGAAATCCCCTCCTCTGTAG 515_ai2.seq
2700 TAAGTTGTCAGTCACAGTCCATAAACGATAAGAAATCCCCTCCTCTGTAG cjb111_ai2.seq
2700 TAAGTTGTCAGTCACAGTCCATAAACGATAAGAAATCCCCTCCTCTGTAG h36b_ai2.seq

     TATTTGGCTGAAGTCCTATCTGTGTGATTGTTAGTTGATTAGGGGTATCA Majority
              2760      2770      2780      2790      2800
2750 TATTTGGCTGAAGTCCTATCTGTGTGATTGTTAGTTGATTAGGGGTATCA 2603_ai2.seq
2750 TATTTGGCTGAAGTCCTATCTGTGTGATTGTTAGTTGATTAGGGGTATCA 18rs21_ai2.seq
2751 TATTTGGCTGAAGTCCTATCTGTGTGATTGTTAGTTGATTAGGGGTATCA 515_ai2.seq
2750 TATTTGGCTGAAGTCCTATCTGTGTGATTGTTAGTTGATTAGGGGTATCA cjb111_ai2.seq
2750 TATTTGGCTGAAGTCCTATCTGTGTGATTGTTAGTTGATTAGGGGTATCA h36b_ai2.seq

     GCATTTACACTGGCTACCGAAAAAAACGCTAATTGTACCAATCCTAAAAA Majority
              2810      2820      2830      2840      2850
2800 GCATTTACACTGGCTACCGAAAAAAACGCTAATTGTACCAATCCTAAAAA 2603_ai2.seq
2800 GCATTTACACTGGCTACCGAAAAAAACGCTAATTGTACCAATCCTAAAAA 18rs21_ai2.seq
2801 GCATTTACACTGGCTACCGAAAAAAACGCTAATTGTACCAATCCTAAAAA 515_ai2.seq
2800 GCATTTACACTGGCTACCGAAAAAAACGCTAATTGTACCAATCCTAAAAA cjb111_ai2.seq
2800 GCATTTACACTGGCTACCGAAAAAAACGCTAATTGTACCAATCCTAAAAA h36b_ai2.seq

     GCAACATAGTAGAAGTCCTAAACTTTTTCTAATCTTTTTCATTTTTGATT Majority
              2860      2870      2880      2890      2900
2850 GCAACATAGTAGAAGTCCTAAACTTTTTCTAATCTTTTTCATTTTTGATT 2603_ai2.seq
2850 GCAACATAGTAGAAGTCCTAAACTTTTTCTAATCTTTTTCATTTTTGATT 18rs21_ai2.seq
2851 GCAACATAGTAGAAGTCCTAAACTTTTTCTAATCTTTTTCATTTTTGATT 515_ai2.seq
2850 GCAACATAGTAGAAGTCCTAAACTTTTTCTAATCTTTTTCATTTTTGATT cjb111_ai2.seq
2850 GCAACATAGTAGAAGTCCTAAACTTTTTCTAATCTTTTTCATTTTTGATT h36b_ai2.seq

     TCCCTTTCTCTTTCTCTCTTTAAATTTTCGTTTTAAATATAATAGTAAAG Majority
              2910      2920      2930      2940      2950
2900 TCCCTTTCTCTTTCTCTCTTTAAATTTTCGTTTTAAATATAATAGTAAAG 2603_ai2.seq
2900 TCCCTTTCTCTTTCTCTCTTTAAATTTTCGTTTTAAATATAATAGTAAAG 18rs21_ai2.seq
2901 TCCCTTTCTCTTTCTCTCTTTAAATTTTCGTTTTAAATATAATAGTAAAG 515_ai2.seq
2900 TCCCTTTCTCTTTCTCTCTTTAAATTTTCGTTTTAAATATAATAGTAAAG cjb111_ai2.seq
2900 TCCCTTTCTTTTTCTCTCTTTAAATTTTCGTTTTAAATATAATAGTAAAG h36b_ai2.seq

     CGACTAATATAAGAATAACTAGGATTGATAAGAGGAAATAAAGTTTATAG Majority
              2960      2970      2980      2990      3000
2950 CGACTAATATAAGAATAACTAGGATTGATAAGAGGAAATAAAGTTTATAG 2603_ai2.seq
2950 CGACTAATATAAGAATAACTAGGATTGATAAGAGGAAATAAAGTTTATAG 18rs21_ai2.seq
2951 CGACTAATATAAGAATAACTAGGATTGATAAGAGGAAATAAAGTTTATAG 515_ai2.seq
2950 CGACTAATATAAGAATAACTAGGATTGATAAGAGGAAATAAAGTTTATAG cjb111_ai2.seq
2950 CGACTAATATAAGAATAACTAGGATTGATAAGAGGAAATAAAGTTTATAG h36b_ai2.seq

     TGTGTTTGCAATTCTTTCATTAAATAGTTCTTTTCTTTAACAGGAGGTAC Majority
              3010      3020      3030      3040      3050
3000 TGTGTTTGCAATTCTTTCATTAAATAGTTCTTTTCTTTAACAGGAGGTAC 2603_ai2.seq
3000 TGTGTTTGCAATTCTTTCATTAAATAGTTCTTTTCTTTAACAGGAGGTAC 18rs21_ai2.seq
3001 TGTGTTTGCAATTCTTTCATTAAATAGTTCTTTTCTTTAACAGGAGGTAC 515_ai2.seq
3000 TGTGTTTGCAATTCTTTCATTAAATAGTTCTTTTCTTTAACAGGAGGTAC cjb111_ai2.seq
3000 TGTGTTTGCAATTCTTTCATTAAATAGTTCTTTTCTTTAACAGGAGGTAC h36b_ai2.seq

     ATACTTGATTCGATGCCCTCTAACTAGTAAACGATGTGAATTAATCGAAT Majority
              3060      3070      3080      3090      3100
3050 ATACTTGATTCGATGCCCTCTAACTAGTAAACGATGTGAATTAATCGAAT 2603_ai2.seq
3050 ATACTTGATTCGATGCCCTCTAACTAGTAAACGATGTGAATTAATCGAAT 18rs21_ai2.seq
3051 ATACTTGATTCGATGCCCTCTAACTAGTAAACGATGTGAATTAATCGAAT 515_ai2.seq
3050 ATACTTGATTCGATGCCCTCTAACTAGTAAACGATGTGAATTAATCGAAT cjb111_ai2.seq
3050 ATACTTGATTCGATGCCCTCTAACTAGTAAACGATGTGAATTAATCGAAT h36b_ai2.seq

     AAGGTGTACATGTTAGCAAAGTCGCATAATCCTTACCTTTAACAACCAAT Majority
              3110      3120      3130      3140      3150
3100 AAGGTGTACATGTTAGCAAAGTCGCATAATCCTTACCTTTAACAACCAAT 2603_ai2.seq
3100 AAGGTGTACATGTTAGCAAAGTCGCATAATCCTTACCTTTAACAACCAAT 18rs21_ai2.seq
3101 AAGGTGTACATGTTAGCAAAGTCGCATAATCCTTACCTTTAACAACCAAT 515_ai2.seq
3100 AAGGTGTACATGTTAGCAAAGTCGCATAATCCTTACCTTTAACAACCAAT cjb111_ai2.seq
3100 AAGGTGTACATGTTAGCAAAGTCGCATAATCCTTACCTTTAACAACCAAT h36b_ai2.seq
```

FIGURE 19H

Alignment Report of Ai-2_alignment, using J. Hein method with Weighted residue weight table.
Thursday, July 29, 2004 6:32 PM

```
     AATTTAGAAAAATTATCTGGCTTTACAACACTTATTTGATCAACCTTATA Majority
               3160      3170      3180      3190      3200
3150 AATTTAGAAAAATTATCTGGCTTTACAACACTTATTTGATCAACCTTATA 2603_ai2.seq
3150 AATTTAGAAAAATTATCTGGCTTTACAACACTTATTTGATCAACCTTATA 18rs21_ai2.seq
3151 AATTTAGAAAAATTATCTGGCTTTACAACACTTATTTGATCAACCTTATA 515_ai2.seq
3150 AATTTAGAAAAATTATCTGGCTTTACAACACTTATTTGATCAACCTTATA cjb111_ai2.seq
3150 AATTTAGAAAAATTATCTGGCTTTACAACACTTATTTGATCAACCTTATA h36b_ai2.seq

     GGCTAAAACTTCTTTGATATTATGAATATAAAAAATTTTTCCTTTTTTAA Majority
               3210      3220      3230      3240      3250
3200 GGCTAAAACTTCTTTGATATTATGAATATAAAAAATTTTTCCTTTTTTAA 2603_ai2.seq
3200 GGCTAAAACTTCTTTGATATTATGAATATAAAAAATTTTTCCTTTTTTAA 18rs21_ai2.seq
3201 GGCTAAAACTTCTTTGATATTATGAATATAAAAAATTTTTCCTTTTTTAA 515_ai2.seq
3200 GGCTAAAACTTCTTTGATATTATGAATATAAAAAATTTTTCCTTTTTTAA cjb111_ai2.seq
3200 GGCTAAAACTTCTTTGATATTATGAATATAAAAAATTTTTCCTTTTTTAA h36b_ai2.seq

     GTTTATCTAAATCTGTAAATAACTTAGCTTTAGGTAAGCCGCGATGAGCT Majority
               3260      3270      3280      3290      3300
3250 GTTTATCTAAATCTGTAAATAACTTAGCTTTAGGTAAGCCGCGATGAGCT 2603_ai2.seq
3250 GTTTATCTAAATCTGTAAATAACTTAGCTTTAGGTAAGCCGCGATGAGCT 18rs21_ai2.seq
3251 GTTTATCTAAATCTGTAAATAACTTAGCTTTAGGTAAGCCGCGATGAGCT 515_ai2.seq
3250 GTTTATCTAAATCTGTAAATAACTTAGCTTTAGGTAAGCCGCGATGAGCT cjb111_ai2.seq
3250 GTTTATCTAAATCTGTAAATAACTTAGCTTTAGGTAAGCCGCGATGAGCT h36b_ai2.seq

     GTGATAACAGTATGTGAACTTTTTCCACCAATTGGCAAGGAGGTTCCTTC Majority
               3310      3320      3330      3340      3350
3300 GTGATAACAGTATGTGAACTTTTTCCACCAATTGGCAAGGAGGTTCCTTC 2603_ai2.seq
3300 GTGATAACAGTATGTGAACTTTTTCCACCAATTGGCAAGGAGGTTCCTTC 18rs21_ai2.seq
3301 GTGATAACAGTATGTGAACTTTTTCCACCAATTGGCAAAGAAGTTCCTTC 515_ai2.seq
3300 GTGATAACAGTATGTGAACTTTTTCCACCAATTGGCAAGGAGGTTCCTTC cjb111_ai2.seq
3300 GTGATAACAGTATGTGAACTTTTTCCACCAATTGGCAAAGAAGTTCCTTC h36b_ai2.seq

     AAGGTGTCCTGCTCCTTTTTCAAGAACACTACTGGTAGTCCCCGCATAGA Majority
               3360      3370      3380      3390      3400
3350 AAGGTGTCCTGCTCCTTTTTCAAGAACACTACTGGTAGTCCCCGCATAGA 2603_ai2.seq
3350 AAGGTGTCCTGCTCCTTTTTCAAGAACACTACTGGTAGTCCCCGCATAGA 18rs21_ai2.seq
3351 AAGGTGTCCTGATCCTTTTTCAAGAACACTACTGGTAGTCCCCGCATAGA 515_ai2.seq
3350 AAGGTGTCCTGCTCCTTTTTCAAGAACACTACTGGTAGTCCCCGCATAGA cjb111_ai2.seq
3350 AAGGTGTCCTGCTCCTTTTTCAAGAACACTACTGGTAGTCCCCGCATAGA h36b_ai2.seq

     TAGGTAATTTTTGCTTGATAGACGGTATATCAATATATCCAATCATTTCA Majority
               3410      3420      3430      3440      3450
3400 TAGGTAATTTTTGCTTGATAGACGGTATATCAATATATCCAATCATTTCA 2603_ai2.seq
3400 TAGGTAATTTTTGCTTGATAGACGGTATATCAATATATCCAATCATTTCA 18rs21_ai2.seq
3401 TAGGTAATTTTTGCTTGATAGACGGTATATCAATATATCCAATCATTTCA 515_ai2.seq
3400 TAGGTAATTTTTGCTTGATAGACGGTATATCAATATATCCAATCATTTCA cjb111_ai2.seq
3400 TAGGTAATTTTTGCTTGATAGACGGTATATCAATATATCCAATCATTTCA h36b_ai2.seq

     GCAATCTCAAGCATGTGGGCGTATTCAGCAATACCTTTTTTTTCTTTTTC Majority
               3460      3470      3480      3490      3500
3450 GCAATCTCAAGCATGTGGGCGTATTCAGCAATACCTTTTTTTTCTTTTTC 2603_ai2.seq
3450 GCAATCTCAAGCATGTGGGCGTATTCAGCAATACCTTTTTTTTCTTTTTC 18rs21_ai2.seq
3451 GTAATCTCAAGCATATGGGCGTATTCAGCAATACCTTTTTTTTCTTTTTC 515_ai2.seq
3450 GCAATCTCAAGCATGTGGGCGTATTCAGCAATACCTTTTTTTTCTTTTTC cjb111_ai2.seq
3450 GCAATCTCAAGCATGTGGGCGTATTCAGCAATACCTTTTTTTTCTTTTTC h36b_ai2.seq

     AGTATAGGGATCTGATAGGCGGCTTGGGTCCAGTGTTCTATTATAAGCTT Majority
               3510      3520      3530      3540      3550
3500 AGTATAGGGATCTGATAGGCGGCTTGGGTCCAGTGTTCTATTATAAGCTT 2603_ai2.seq
3500 AGTATAGGGATCTGATAGGCGGCTTGGGTCCAGTGTTCTATTATAAGCTT 18rs21_ai2.seq
3501 AGTATAGGGATCTGATAGGCGGCTTGGGTCCAGTGTTCTATTATAAGCTT 515_ai2.seq
3500 AGTATAGGGATCTGATAGGCGGCTTGGGTCCAGTGTTCTATTATAAGCTT cjb111_ai2.seq
3500 AGTATAGGGATCTGATAGGCGGCTTGGGTCCAGTGTTCTATTATAAGCTT h36b_ai2.seq

     TTGCTAACTCAAATCGTCTATTAATCTCTTTAGTATTTAATTTTTGGGTT Majority
               3560      3570      3580      3590      3600
3550 TTGCTAACTCAAATCGTCTATTAATCTCTTTAGTATTTAATTTTTGGGTT 2603_ai2.seq
3550 TTGCTAACTCAAATCGTCTATTAATCTCTTTAGTATTTAATTTTTGGGTT 18rs21_ai2.seq
3551 TTGCTAACTCAAATCGTCTATTAATCTCTTTAGCATTTAATTTTTGGGTT 515_ai2.seq
3550 TTGCTAACTCAAATCGTCTATTAATCTCTTTAGTATTTAATTTTTGGGTT cjb111_ai2.seq
3550 TTGCTAACTCAAATCGTCTATTAATCTCTTTAGCATTTAATTTTTGGGTT h36b_ai2.seq
```

FIGURE 19I

Alignment Report of Ai-2_alignment, using J. Hein method with Weighted residue weight table.
Thursday, July 29, 2004 6:32 PM

```
            T G A T T A T C A A A G T T A G T T A C T T G A T T A T T A G C T T T A A T A T T A T A G T A C C A  Majority
                      3610              3620              3630              3640              3650
3600        T G A T T A T C A A A G T T A G T T A C T T G A T T A T T A G C T T T A A T A T T A T A G T A C C A  2603_ai2.seq
3600        T G A T T A T C A A A G T T A G T T A C T T G A T T A T T A G C T T T A A T A T T A T A G T A C C A  18rs21_ai2.seq
3601        T G A T T A T C A A A G T T A G T T A C T T G A T T A T T A G C T T T A A T A T T A T A G T A C C A  515_ai2.seq
3600        T G A T T A T C A A A G T T A G T T A C T T G A T T A T T A G C T T T A A T A T T A T A G T A C C A  cjb111_ai2.seq
3600        T G A T T A T C A A A G T T A G T T A C T T G A T T A T T A G C T T T A A T A T T A T A G T A C C A  h36b_ai2.seq

            A T T T G A A A T A A A A G G A T A T G A G G T T A T C A A A A G A C C A A C T A A G A A C A A T A  Majority
                      3660              3670              3680              3690              3700
3650        A T T T G A A A T A A A A G G A T A T G A G G T T A T C A A A A G A C C A A C T A A G A A C A A T A  2603_ai2.seq
3650        A T T T G A A A T A A A A G G A T A T G A G G T T A T C A A A A G A C C A A C T A A G A A C A A T A  18rs21_ai2.seq
3651        A T T T G A A A T A A A A G G A T A T G A G G T T A T C A A A A G A C C T A C T A A G A A T A A T A  515_ai2.seq
3650        A T T T G A A A T A A A A G G A T A T G A G G T T A T C A A A A G A C C A A C T A A G A A C A A T A  cjb111_ai2.seq
3650        A T T T G A A A T A A A A G G A T A T G A G G T T A T C A A A A G A C C A A C T A A G A A C A A T A  h36b_ai2.seq

            G T A T C A A G C C T A C A T T C A T C C A T C G A T T T A A A A C G A C C G A T T T C T T A A G G  Majority
                      3710              3720              3730              3740              3750
3700        G T A T C A A G C C T A C A T T C A T C C A T C G A T T T A A A A C G A C C G A T T T C T T A A G G  2603_ai2.seq
3700        G T A T C A A G C C T A C A T T C A T C C A T C G A T T T A A A A C G A C C G A T T T C T T A A G G  18rs21_ai2.seq
3701        A T A T C A A C C T A T T A T T C A T C C A T C G A T T T A A A A C G A C C G A T T T C T T A A G G  515_ai2.seq
3700        G T A T C A G G C C T A C A T T C A T C C A T C G A T T T A A A A C G A C C G A T T T C T T A A G G  cjb111_ai2.seq
3700        G T A T C A A G C C T A C A T T C A T C C A T C G A T T T A A A A C G A C C G A T T T C T T A A G G  h36b_ai2.seq

            T T T T T C T G A A A T T T T C C T C C C A T T A T G A T T C A A T T C C T T T T C T A A C A C T T  Majority
                      3760              3770              3780              3790              3800
3750        T T T T T C T G A A A T T T T C C T C C C A T T A T G A T T C A A T T C C T T T T C T A A C A C T T  2603_ai2.seq
3750        T T T T T C T G A A A T T T T C C T C C C A T T A T G A T T C A A T T C C T T T T C T A A C A C T T  18rs21_ai2.seq
3751        T T T T T C T G A A A T T T T C C T C G C A T T A T G A T T C A A T T C C T T T T C T A A C A C T T  515_ai2.seq
3750        T T T T T C T G A A A T T T T C C T C C C A T T A T G A T T C A A T T C C T T T T C T A A C A C T T  cjb111_ai2.seq
3750        T T T T T C T G A A A T C T T C C T C C C A T T A T G A T T C A A T T C C T T T T C T A A C A C T T  h36b_ai2.seq

            G C T A A A C G A T T T T T T T G A C G T T G A C G T T T T A T T A A C C A A A G T A A C C A A G C  Majority
                      3810              3820              3830              3840              3850
3800        G C T A A A C G A T T T T T T T G A C G T T G A C G T T T T A T T A A C C A A A G T A A C C A A G C  2603_ai2.seq
3800        G C T A A A C G A T T T T T T T G A C G T T G A C G T T T T A T T A A C C A A A G T A A C C A A G C  18rs21_ai2.seq
3801        G A T A A A C G A T T T T T T T G A C G T T G A C G T T T T A T T A A C C A A A G T A A C C A A G C  515_ai2.seq
3800        G C T A A A C G A T T T T T T T G A C G T T G A C G T T T T A T T A A C C A A A G T A A C C A A G C  cjb111_ai2.seq
3800        G C T A A A C G A T T T T T T T G A C G T T G A C G T T T T A T T A A C C A A A G T A A C C A A G C  h36b_ai2.seq

            A A T A A T A A C T A A A G A T A T A T A G A A A A G A T A T C T A T A A A T C G T G T T T A A A T  Majority
                      3860              3870              3880              3890              3900
3850        A A T A A T A A C T A A A G A T A T A T A G A A T A G A T A T C T A T A A A T C G T G T T T A A A T  2603_ai2.seq
3850        A A T A A T A A C T A A A G A T A T A T A G A A T A G A T A T C T A T A A A T C G T G T T T A A A T  18rs21_ai2.seq
3851        A A T A A T A A C T A A A G A T A T A T A G A A A A G A T A T C T A T A A A T C G T G T T T A A A T  515_ai2.seq
3850        A A T A A T A A C T A A A G A T A T A T A G A A A A G A T A T C T A T A A A T C G T G T T T A A A T  cjb111_ai2.seq
3850        A A T A A T A A C T A A A G A T A T A T A G A A A A G A T A T C T A T A A A T C G T G T T T A A A T  h36b_ai2.seq

            G A C C G T C T T T T A T T A A T T T T T C A T C A A T A G G A C C T T T A T A A G G G A T A C G A  Majority
                      3910              3920              3930              3940              3950
3900        G A C C G T C T T T T A T T A A T T T T T C A T C A A T A G G A C C T T T A T A A G G G A T A C G A  2603_ai2.seq
3900        G A C C G T C T T T T A T T A A T T T T T C A T C A A T A G G A C C T T T A T A A G G G A T A C G A  18rs21_ai2.seq
3901        G A C C G T C T T T T A T T A A T T T T T C A T C A A T A G G A C C T T T A T A A G G G A T A C G A  515_ai2.seq
3900        G A C C T T C T T T C A T T A A T T T T T C A T C A A T A A G A C C T T T A T A A G G A A T A C G A  cjb111_ai2.seq
3900        G A C C T T C T T T C A T T A A T T T T T C A T C A A T A G G A C C T T T A T A A G G A A T A C G A  h36b_ai2.seq

            T G T C C C C T T A C T A A A A G T C T G T G T G T A T T G A C C A T A A T C G G G G T G C A A G T  Majority
                      3960              3970              3980              3990              4000
3950        T G T C C C C T T A C T A A A A G T C T G T G T G T A T T G A T C A T A A T C G G G G T G C A A G T  2603_ai2.seq
3950        T G T C C C C T T A C T A A A A G T C T G T G T G T A T T G A T C A T A A T C G G G G T G C A A G T  18rs21_ai2.seq
3951        T G A C C C C T T A C T A A A A G T C T G T G T G T A T T G A C C A T A A T C G G G G T G C A A G T  515_ai2.seq
3950        T G T C C C C T T A C T A A A A G T C T G T G T G T A T T G A C C A T A A T C G G G G T G C A A G T  cjb111_ai2.seq
3950        T G T C C C C T T A C T A A A A G T C T G T G T G T A T T G A C C A T A A T C G G G G T G C A A G T  h36b_ai2.seq

            C A A T A A G G T T G C A T A A T C A T G T C C A G G A A C A A C C A A C A A A T C T G A A A A G T  Majority
                      4010              4020              4030              4040              4050
4000        C A A T A A G G T T G C A T A A T C A T G T C C A G G A A C A A C C A A C A A A T C T G A A A A G T  2603_ai2.seq
4000        C A A T A A G G T T G C A T A A T C A T G T C C A G G A A C A A C C A A C A A A T C T G A A A A G T  18rs21_ai2.seq
4001        C A A T A A G G T T G C A T A A T C A T G T C C A G G A A C A A C C A A C A A A T C T G A A A A G T  515_ai2.seq
4000        T A A T A A G G T T G C A T A A T C A T G T C C A G G A A C A A C C A A C A A A T C T G A A A A G T  cjb111_ai2.seq
4000        C A A T A A G G T T G C A T A A T C A T G T C C A G G A A C A A C C A A T A A A T C T G A A A A G T  h36b_ai2.seq
```

FIGURE 19J

Alignment Report of Ai-2_alignment, using J. Hein method with Weighted residue weight table.
Thursday, July 29, 2004 6:32 PM

```
     TATCGGGTGTAACGACTTTTATCTGATCTACTTGATATGCTATCGTTTCT Majority
               4060      4070      4080      4090      4100
4050 TATCGGGTGTAACGACTTTTATCTGATCTACTTGATATGCTATCGTTTCT 2603_ai2.seq
4050 TATCGGGTGTAACGACTTTTATCTGATCTACTTGATATGCTATCGTTTCT 18rs21_ai2.seq
4051 TATCGGGTGTAACGACTTTTATCTGATCTACTTGATATGCTATCGTTTCT 515_ai2.seq
4050 TATCGGGTGTAACGACTTTTATCTGATCTACTTGATATGCTATCGTTTCT cjb111_ai2.seq
4050 TATCGGGTGTAACGACTTTTATCTGATCTACTTGATATGCTATCGTTTCT h36b_ai2.seq

     TTTATGTTTTGAATATAAAACTTATCTCCTTTTTTTAACTTTTTAAGGTT Majority
               4110      4120      4130      4140      4150
4100 TTTATGTTTTGAATATAAAACTTATCTCCTTTTTTTAACTTTTTAAGGTT 2603_ai2.seq
4100 TTTATGTTTTGAATATAAAACTTATCTCCTTTTTTTAACTTTTTAAGGTT 18rs21_ai2.seq
4101 TTTATGTTTTGAATATAAAACTTATCTCCTTTTTTTAACTTTTTAAGGTT 515_ai2.seq
4100 TTTATGTTTTGAATATAAAACTTATCTCCTTTTTTTAACTTTTTAAGGTT cjb111_ai2.seq
4100 TTTATGTTTTGAATATAAAACTTATCTCCTTTTTTTAACTTTTTAAGGTT h36b_ai2.seq

     AGAAAAGAGTTCTTTATCTGGAATTCCTGAATGCGCTGTTATAACAGTAT Majority
               4160      4170      4180      4190      4200
4150 AGAAAAGAGTTCTTTATCTGGAATTCCTGAATGCGCTGTTATAACAGTAT 2603_ai2.seq
4150 AGAAAAGAGTTCTTTATCTGGAATTCCTGAATGCGCTGTTATAACAGTAT 18rs21_ai2.seq
4151 AGAAAAGAGCTCTTTATCTGGAATTCCTGAGTGCGCTGTTATAACGGTAT 515_ai2.seq
4150 AGAAAAGAGTTCTTTATCTGGAATTCCTGAGTGCGCTGTTATAACGGTAT cjb111_ai2.seq
4150 AGAAAAGAGTTCTTTATCTGGAATTCCTGAATGTGCTGTTATAACAGTAT h36b_ai2.seq

     GTGTACTATTGCCTCCAATTGGAAGAGAGGTACCTTCTAAATGCCCTGCT Majority
               4210      4220      4230      4240      4250
4200 GTGTACTATTGCCCCCAATTGGAAGAGAGGTACCTTCTAAATGCCCTGCT 2603_ai2.seq
4200 GTGTACTATTGCCCCCAATTGGAAGAGAGGTACCTTCTAAATGCCCTGCT 18rs21_ai2.seq
4201 GGGTGCTATTGCCTCCAATTGGAAGAGAGGTACCTTCTAAATGACCTGCT 515_ai2.seq
4200 GTGTGCTATTTCCTCCAATTGGAAGAGAAGTACCTTCTAAATGCCCTGCT cjb111_ai2.seq
4200 GTGTACTATTGCCTCCAATTGGAAGAGAGGTGCCTTCTAAATGCCCTGCT h36b_ai2.seq

     CCTTTAGATAGAACTTCTTGACTTGAACCTGCAAATATAGGGAGTTTTTG Majority
               4260      4270      4280      4290      4300
4250 CCTTTAGATAGAACTTCTTGACTTGAACCTGCAAATATAGGGAGTTTTTG 2603_ai2.seq
4250 CCTTTAGATAGAACTTCTTGACTTGAACCTGCAAATATAGGGAGTTTTTG 18rs21_ai2.seq
4251 CCTTTAGATAGAACTTCTTGACTTGAACCTGCAAATATAGGGAGTTTTTG 515_ai2.seq
4250 CCTTTAGATAGAACTTTTTGACTTGAACCTGCAAATATAGGGAGTTTTTG cjb111_ai2.seq
4250 CCTTTAGATAGAACTTCTTGACTTGAACCTGCAAATATAGGGAGTTTTTG h36b_ai2.seq

     ACCTATCTTAGGAACTGAAATTGTGCCGATTTTTTCACTTACCTCTAACA Majority
               4310      4320      4330      4340      4350
4300 ACCTATCTTAGGAACTGAAATTGTTCCGATTTTTTCACTTACCTCTAACA 2603_ai2.seq
4300 ACCTATCTTAGGAACTGAAATTGTTCCGATTTTTTCACTTACCTCTAACA 18rs21_ai2.seq
4301 ACCTATCTTAGGAACTGAAATTATGCCGATTTTTTCACTTACCTCTAACA 515_ai2.seq
4300 ACCTATCTTAGGAACTGAAATTGTGCCGATTTTTTCACTTACCTCTAACA cjb111_ai2.seq
4300 ACCTATCTTAGGAACTGAAATTGTGCCGATTTTTTCACTTACCTCTAACA h36b_ai2.seq

     TACGGGCGTACTCTGCTACCCCCTTTTGAATTCGTTTTTTCTCATAAGGA Majority
               4360      4370      4380      4390      4400
4350 TACGGGCGTACTCTGCTACCCCCTTTTGAATTCGTTTTTTCTCATAAGGA 2603_ai2.seq
4350 TACGGGCGTACTCTGCTACCCCCTTTTGAATTCGTTTTTTCTCATAAGGA 18rs21_ai2.seq
4351 TACGGGCGTACTCTGCTATCCCCTTTTGAATTCGTTTTTTCTCATAAGGA 515_ai2.seq
4350 TACGGGCGTACTCTGCTACCCCCTTTTGAATTCGTTTCTTCTCATAAGGA cjb111_ai2.seq
4350 TACGGGCGTACTCTGCTACCCCTTTTTGAATTCGTTTTTTCTCATAAGGA h36b_ai2.seq

     TCTTCAAGATGGACATTATTTAAAGAATCATTATAAGCTTGTGCTAGAGC Majority
               4410      4420      4430      4440      4450
4400 TCTTCAAGATGGACATTATTTAAAGAATCATTATAAGCTTGTGCTAGAGC 2603_ai2.seq
4400 TCTTCAAGATGGACATTATTTAAAGAATCATTATAAGCTTGTGCTAGAGC 18rs21_ai2.seq
4401 TCTTCAAGATGGACATTATTTAAAGAATCATTATATGCTTGTGCTAGAGC 515_ai2.seq
4400 TCTTCAAGATGGACATTATTTAAAGAATCATTATAAGCTTGTGCTAGAGT cjb111_ai2.seq
4400 TCTTCAAAATGGACATTATTTAAAGAATCATTATAAGCTTGTGCTAGAGC h36b_ai2.seq

     CATACGTCGATTGATTTCTTTCTGACTAAGTTTTTTAGCAGCTCTCTCAA Majority
               4460      4470      4480      4490      4500
4450 CATACGTCGATTGATTTCTTTCTGACTAAGTTTTTTAGCAGCTCTCTCAA 2603_ai2.seq
4450 CATACGTCGATTGATTTCTTTCTGACTAAGTTTTTTAGCAGCTCTCTCAA 18rs21_ai2.seq
4451 CATACGCCGATTGATTTCTTTCTGACTAAGTTTTTTAGCAGCTCTCTCAA 515_ai2.seq
4450 CATACGACGATTGATTTCTTTCTGACTAAGTTTTTTAGCAGCTCTCTCAA cjb111_ai2.seq
4450 CATACGTCGATTGATTTCTTTCTGACTAAGTTTTTTAGCAGCTCTCTCAA h36b_ai2.seq
```

FIGURE 19K

Alignment Report of Ai-2_alignment, using J. Hein method with Weighted residue weight table.
Thursday, July 29, 2004 6:32 PM

```
     AATCCTGTGTTTGATTATTAGATTCTATCGTATAGTAAAAACGTGATACC Majority
               4510      4520      4530      4540      4550
4500 AATCCTGTGTTTGATTATTAGATTCTATCGTATAGTAAAAACGTGATACC 2603_ai2.seq
4500 AATCCTGTGTTTGATTATTAGATTCTATCGTATAGTAAAAACGTGATACC 18rs21_ai2.seq
4501 AATCTTGTGTTTGGTTATTAGATTCTATCGTATAGTAAAATCGTGATACC 515_ai2.seq
4500 AATCCTGTGTTTGATTATTAGATTCTATCGTATAGTAAAAACGTGATACC cjb111_ai2.seq
4500 AATCCTGTGTTTGATTATTGGATTCTATCGTATAGTAAAAACGTGATACC h36b_ai2.seq

     ACTGGATACAATAAAATAGATAGACCTATTAGAAAAAGAATGATAAAAGG Majority
               4560      4570      4580      4590      4600
4550 ACTGGATACAATAAAATAGATAGACCTATTAGAAAAAGAATGATAAAAGG 2603_ai2.seq
4550 ACTGGATACAATAAAATAGATAGACCTATTAGAAAAAGAATGATAAAAGG 18rs21_ai2.seq
4551 ACTGGATACAATAAGATAGATAGACCTATTAGAAAAAGAATGATAAAAGG 515_ai2.seq
4550 ACTGGATACAATAAAATAGATAGACCTATTAGAAAAAGAATGATAAAAGG cjb111_ai2.seq
4550 ACTGGATACAATAAAATAGATAGACCTATTAGAAAAAGAATGATAAAAGG h36b_ai2.seq

     AAGATTTGACTTCTTCTTTTT---TGTTTTTTTGATGATTTTTTTAGTCT Majority
               4610      4620      4630      4640      4650
4600 AAGATTTGACTTCTTCTTTTTTTTTGTTTTTTTGATGATTTTTTTAGTCT 2603_ai2.seq
4600 AAGATTTGACTTCTTCTTTTTTTTTGTTTTTTTGATGATTTTTTTAGTCT 18rs21_ai2.seq
4601 CAGATTTGATTTCTTTTTTTT---TGTTTTTTTGATAATTTTTTTAGTCT 515_ai2.seq
4600 AAGATTTGACTTCTTCTTTTT---AGTTTTTTTGTTGATATTTTTAGTCT cjb111_ai2.seq
4600 AAGATTTGACTTCTTCTTTTT---AGTTTTTTTGATGATATTTTTAGTCT h36b_ai2.seq

     TCACGTCATCTCCTAAATAATGGCTCTTGCTTATGATCTAAGAGTACTTC Majority
               4660      4670      4680      4690      4700
4650 TCACGTCATCTCCTAGATAATGGCTCTTGCTTATGATCTAAGAGTACTTC 2603_ai2.seq
4650 TCACGTCATCTCCTAGATAATGGCTCTTGCTTATGATCTAAGAGTACTTC 18rs21_ai2.seq
4648 TCACGTCATCTCCTAAATAATGGCTCTTGCTTATGATCTAAGAGTACTTC 515_ai2.seq
4647 TCACGTCATCTCCTAAATAATGGCTCTTGCTTATGATCTAAGAGTACTTC cjb111_ai2.seq
4647 TCACGTCATCTCCTAAATAATGGCTCTTGCTTATGATCTAAGAGTACTTC h36b_ai2.seq

     TACTGAAATACCCTTAGATCATAAGCACAGCTTTAACTGTGCTTATACAT Majority
               4710      4720      4730      4740      4750
4700 TACTGAAATACCCTTAGATCATAAGCACAGCTTTAACTGCGCTTATACAT 2603_ai2.seq
4700 TACTGAAATACCCTTAGATCATAAGCACAGCTTTAACTGCGCTTATACAT 18rs21_ai2.seq
4698 TACTGAAATACCCTTAGATCATAAGCACAGCTTTAACTGTGCTTACACAT 515_ai2.seq
4697 TACTGAAATACCCTTAGATCATAAGCACAGCTTTAACTGTGCTTATACAT cjb111_ai2.seq
4697 TACTGAAATACCCTTAGATCATAAGCACAGCTTTAACTGTGCTTATACAT h36b_ai2.seq

     CATCAAAGACTAGCCTTAAGCTTCCTCTGATTGACGTCTTTTCATGATAA Majority
               4760      4770      4780      4790      4800
4750 CATCAAAGACTAGCCTTAAGCTTCCTTTGATTGGCGTCTTTTCATGATAA 2603_ai2.seq
4750 CATCAAAGACTAGCCTTAAGCTTCCTTTGATTGGCGTCTTTTCATGATAA 18rs21_ai2.seq
4748 CATCAAAAGCTAATCTTAAACTTCCTCTGATTGACGTCTTTTCATGATAA 515_ai2.seq
4747 CATCAAAGACTAGCCTTAAGCTTCCTCTGATTGACGTTTTTTCATGATAA cjb111_ai2.seq
4747 CATCAAAGACTAGCCTTAAGCTTCCTCTGATTGACGTCTTTTCATGATAA h36b_ai2.seq

     CTACTGCTCCAAGCATAATGCTTAAACCAATAATTGTGAAAAGAATTGTA Majority
               4810      4820      4830      4840      4850
4800 CTACTGCTCCAAGCATAATGCTTAAACCAATAATTGTGAAAAGAATTGTA 2603_ai2.seq
4800 CTACTGCTCCAAGCATAATGCTTAAACCAATAATTGTGAAAAGAATTGTA 18rs21_ai2.seq
4798 CTACCGCTCCAAGCATAATACTTAATCCAATAATTGTGAAAAAAATTGTA 515_ai2.seq
4797 CTACTGCTCCAAGCATAATGCTTAAACCAATAATTGTGAAAAGAATTGTA cjb111_ai2.seq
4797 TTACCGCTCCAAGCATAATGCTTAAACCAATAATTGTGAAAAGAATTGTA h36b_ai2.seq

     CCAATACCACCTGTTTGTGGGATTGTTACCTTTTTATTTTCTACTCGTTG Majority
               4860      4870      4880      4890      4900
4850 CCAATACCACCTGTTTGTGGGATTGTTACCTTTTTATTTTCTACACGTGT 2603_ai2.seq
4850 CCAATACCACCTGTTTGTGGGATTGTTACCTTTTTATTTTCTACACGTGT 18rs21_ai2.seq
4848 CCAATACCACCTGTTTGTGGAATAGTAACCTTCTTATTGATAACTTGTTG 515_ai2.seq
4847 CCAATACCACCTGTTTGTGGGATGGTTACTTTTTTGTTTTGAACTTGTTG cjb111_ai2.seq
4847 CCAATACCACCTGTTTGTGGAATAGTCACTTTTTTGTTTTCTATGCGTTG h36b_ai2.seq

     CGCATCTTTTTTTTTGCTGCTAGCAGCGTAGTCAATGTTACCTG---AAC Majority
               4910      4920      4930      4940      4950
4900 CGCATCTTTTTGCTTGCTGTTAGCAACGTAGTCAATGTTACCTT----TAC 2603_ai2.seq
4900 CGCATCTTTTTGCTTGCTGTTAGCAACGTAGTCAATGTTACCTT----TAC 18rs21_ai2.seq
4898 TGCATCTTTAGTTTTAGAACCTTGGGTATACTCAATAATCTTGAGCAGAAC 515_ai2.seq
4897 GGCATCTTTTTTTACAGAGCCTTTATCATATGCGATGTGAGTTGTAGCCC cjb111_ai2.seq
4897 AGCGTCTTTTTTAATTGCTGCTAGCAGTGTAATCAATGTTACCTG---AGT h36b_ai2.seq
```

FIGURE 19L

Alignment Report of Ai-2_alignment, using J. Hein method with Weighted residue weight table.
Thursday, July 29, 2004 6:32 PM

```
     CTTTTCTGTATGACCTTTGATTAACTTCAAACTTAACATCACCTGCCAAT Majority
               4960      4970      4980      4990      5000
4944 CTGTTATGTATGACCCTTGATTAACTACAAACTTAATATTACCTGCCAAC 2603_ai2.seq
4944 CTGTTATGTATGACCCTTGATTAACTACAAACTTAATATTACCTGCCAAC 18rs21_ai2.seq
4948 CTTTACTGTATGAAGTAGCATTAACATTAAACGAAACATCACCTGATAAT 515_ai2.seq
4947 CTTTGCTATATGATGTGGCAGTTACTTCAAAGTTTACATCACCTGACAAT cjb111_ai2.seq
4944 CGTCTGCTTTTGAGCTGTTTCCAACTTTGAAATCAACATCACCTGCTAAT h36b_ai2.seq

     TTAGCATAACCTGCTGGAGCTTGTGTTTCTTCAAGGTTGTAAGTACCTTC Majority
               5010      5020      5030      5040      5050
4994 TTAGCAAATCCTGCTGGAGCAAGTGTTTCTTCAAGGTTGTAAGTACCGTC 2603_ai2.seq
4994 TTAGCAAATCCTGCTGGAGCAAGTGTTTCTTCAAGGTTGTAAGTACCGTC 18rs21_ai2.seq
4998 TTAGCATAACCAGTTGGTGCTTGTGTTTCTTCCAATGAGTATTGACCTTC 515_ai2.seq
4997 GTCGCATAACCTGCTGGTGCTTGAGTTTCTTCCAAGCCATAAGTGCCTTT cjb111_ai2.seq
4994 TTAGCGTAACCAGCTGGAGCTTGTGTTTCTTCAAGTTTATAATCACCAGT h36b_ai2.seq

     TGCAAGACCTGTAACTTCAAATTGACCTTGATCGTTTGAAGTCAATTTAA Majority
               5060      5070      5080      5090      5100
5044 TGCAAGACCTGTAACTTCAAATTGACCTTGATCGTTTGAAGTGTAGGTAA 2603_ai2.seq
5044 TGCAAGACCTGTAACTTCAAATTGACCTTGATCGTTTGAAGTGTAGGTAA 18rs21_ai2.seq
5048 AGTCAAGCCAGTAATTTCAAATTGACCTTTATCGTTAGAAATCAATTTAA 515_ai2.seq
5047 ATCCAAACCAGTAATTTCAAATTGACCACCGGCGTTAGAGATCAATTTAA cjb111_ai2.seq
5044 TGCAAGACCGCTAACTTCAAATTGACCGTCAGCGTTTGAAGTCACTTTAA h36b_ai2.seq

     CAACTTTAGCAGC-TTTTTATCTGTTACCCACTCATAAGCTGTACGAGCT Majority
               5110      5120      5130      5140      5150
5094 TGGCTCTAGC-------CTTATCTGTTATCCACTCATAAGCTGTACGAGCC 2603_ai2.seq
5094 TGGCTCTAGC-------CTTATCTGTTATCCACTCATAAGCTGTACGAGCC 18rs21_ai2.seq
5098 CAACATTCTTAGCATTTTTATCTTCAACCCATTCGTATGAGTAGTTAGCT 515_ai2.seq
5097 CAACATTATCAGCCTTTTTATCTGCAACCCATTCATATGAGTAGTTAGCT cjb111_ai2.seq
5094 CAACGTTAGCATCTTCTTTATTAGTTACCCACTCGTAAGCTGTACGAGCT h36b_ai2.seq

     TCAATGAAGGCTGCATTGTAAGCTTCTTGTTTAGTTTTGATAGTTGCTTT Majority
               5160      5170      5180      5190      5200
5138 TCAATGAAGGCTGCATCGTAATCTGCTTGTTTAGTTTTGATAAGTTCTTT 2603_ai2.seq
5138 TCAATGAAGGCTGCATCGTAATCTGCTTGTTTAGTTTTGATAAGTTCTTT 18rs21_ai2.seq
5148 TTAACAAAGGCATCATTGTAAGCTTTTTGTTTTTCACTAACGGTAGCCAA 515_ai2.seq
5147 TTAACAAAAGCGTCATTGTAAGCTTTTTGTTTTTGATCAACAGTAGCCAA cjb111_ai2.seq
5144 ACGATGAAGGCTGCATTGTAAGCGTCTTGAGCAGTTTTGATTTCTGCTTT h36b_ai2.seq

     TGCTGTTTTACCTTTTTGACCTTTTTGTTCTTCTGCAGACAACTTGTTAT Majority
               5210      5220      5230      5240      5250
5188 TGCAGTAATTCCTTTTTCACCTTTTTGGTCTGTTGCAGACAACTTGTTAT 2603_ai2.seq
5188 TGCAGTAATTCCTTTTTCACCTTTTTGGTCTGTTGCAGACAACTTGTTAT 18rs21_ai2.seq
5198 TGCTGATTTACCATCTTGACCTTCTTGTTTTTCTTTAGTCAAATCATTGT 515_ai2.seq
5197 TGCTGTTTTACCTTCTTGGCCTTCTTGTTTTTCTTTAGTCAAGTCGTTAT cjb111_ai2.seq
5194 AGCTGTTTCACCTTTAGTACCTTTTTGATCGTCTGCTGAAAGTTTGTTGT h36b_ai2.seq

     AAGCTGCGATAGCTTCATCTAAAGCTATTTTAGTAGTAGCTAAAGCTGTT Majority
               5260      5270      5280      5290      5300
5238 AAGCAGCGATAGCTTCATCTAAAGCTATTTCTTAGCAGCTAAAG----TT 2603_ai2.seq
5238 AAGCAGCGATAGCTTCATCTAAAGCTATTTCTTAGCAGCTAAAG----TT 18rs21_ai2.seq
5248 AAGCTTTAACAGCAGCATCCAATGCTGATTTAGTTGAATCTACAGCAGCT 515_ai2.seq
5247 AAGCTTTAACAGCTTCATCCAATGCTAGTTTAGCAGTTTTTACAGCTGCC cjb111_ai2.seq
5244 AAGCTGCGATTTTAGCGTCAAGAGCAGTTTTAGCATTTGTGTAAGCTGTT h36b_ai2.seq

     TTTTGAGCTGCTTTTGCTTCATCTGCTTTAAGTGCAAGGTATTTACCTGC Majority
               5310      5320      5330      5340      5350
5285 TTTTGACCT---TCTGATTGATCTGCTTTAAGAGCAAGGTATTTACCTGC 2603_ai2.seq
5285 TTTTGACCT---TCTGATTGATCTGCTTTAAGAGCAAGGTATTTACCTGC 18rs21_ai2.seq
5298 TTTTCTGCATCTGTTGCAACACCTGATTTACGTGCCAAGTACTTGCCATC 515_ai2.seq
5297 TTTGCTTCAGCAGTTGCTGCACCTGCTTTACGTGCCAAGTATTTGCCTTC cjb111_ai2.seq
5294 GTTTGAGCTGATATTGTCGCAGATGATTTCAATGCAAGGTATTTACCAGC h36b_ai2.seq

     TGAGTTTTTAACAACGAATTGTGCACCTGCCAAGCGTTCAGTTTCAGGTT Majority
               5360      5370      5380      5390      5400
5332 TGAGTTTTTCACAACGAATTGTGCACCAGCCAAACGGTCACCTT---GTT 2603_ai2.seq
5332 TGAGTTTTTCACAACGAATTGTGCACCAGCCAAACGGTCACCTT---GTT 18rs21_ai2.seq
5348 T---TTCTTAACAAGGAAGGTAGCTCCTGCCAAGCGTTCTTTTCCATCTT 515_ai2.seq
5347 T---TTCTTAACGAGGAAGGTAGCTCCTGCCAAGCGTTCAGTGTTAGCTT cjb111_ai2.seq
5344 TGAATCTTTAACAACGAACTGTGCACCTTGCAAGCGTTCTGTTTCAGTCG h36b_ai2.seq
```

FIGURE 19M

Alignment Report of Ai-2_alignment, using J. Hein method with Weighted residue weight table.
Thursday, July 29, 2004 6:32 PM

```
      CATTTGTTTTGACAAATTTCTTACCATGAGTCACAACTTTTGGTTCAGTT Majority
                5410      5420      5430      5440      5450
5379  CATTAGTTTTGACAAATTTCTTACCATGAGTTTCAACTTTTGGTTCAGTT 2603_ai2.seq
5379  CATTAGTTTTGACAAATTTCTTACCATGAGTTTCAACTTTTGGTTCAGTT 18rs21_ai2.seq
5395  TATTTGTTTTCACAAATTTACGTCCATAAGTCACCACTTTTGGTTCTGAT 515_ai2.seq
5394  GATTTGTTTTCACAAATTTACGTCCATAAGTCACCACTTTTGGTTCTGAT cjb111_ai2.seq
5394  AACTTGTTTTGACGAATTTTTTACCGTGTGTCACAACTTTTGGTTCAGTT h36b_ai2.seq

      GGGTTGATTGGTGTTGGGTTATCTGAATCTTTGGTATTGGTGATGGTTAC Majority
                5460      5470      5480      5490      5500
5429  GGGTTCAATGGTGTTGGGTTATCAGAATCTTTGGTATTGGTAATGGTTAC 2603_ai2.seq
5429  GGGTTCAATGGTGTTGGGTTATCAGAATCTTTGGTATTGGTAATGGTTAC 18rs21_ai2.seq
5445  GGGTTGATTGGAGTTGGCTCATTTGAGTCTTTGTTGTTCTTGATGGTTAC 515_ai2.seq
5444  GGGTTGATTGGAGTTGGATCATTTGAGTTTTTGTTGTTCTTGATAGTCAC cjb111_ai2.seq
5444  GGATTAAGTGGTGTTGGGTTGTCTGAATCTGGAGTATTGGTGATAGCTGC h36b_ai2.seq

      ATTACCATTTTCAAGAGTTAT---TGCAGTACCGTAACCAGTAACACGTT Majority
                5510      5520      5530      5540      5550
5479  TTTACCATTTTCTAGATTTAT---TGCACTTCCGTAACCAGAAACACGTT 2603_ai2.seq
5479  TTTACCATTTTCTAGATTTAT---TGCACTTCCGTAACCAGAAACACGTT 18rs21_ai2.seq
5495  AACGCCATTTACAAATGAGACGTATTCTGGAGCGTAGCCGCTAACACGTT 515_ai2.seq
5494  AACACCATTTTTAAATGATACGTATTCTGGAGTGTAGCCGCTAACACGTT cjb111_ai2.seq
5494  ACTACCAGCACCAGTAGTGAT---TGTATTACCATAACCAGCGATACGTT h36b_ai2.seq

      CTGAGATCATGTATGTTTTATTATCATCCAGACCAGTGAATTTACCTGCG Majority
                5560      5570      5580      5590      5600
5526  CTGAGATCATGTATGATTTGTTTTC---TAGACCAGTGAATTTACCCGAG 2603_ai2.seq
5526  CTGAGATCATGTATGATTTGTTTTC---TAGACCAGTGAATTTACCCGAG 18rs21_ai2.seq
5545  CGATAACGCGGTAAGTTTTAGCATTATCCAAGTTTTCAAAAGTGTGTTTG 515_ai2.seq
5544  CGACAACGCGGTAAGTTTTAGCATTATCCAAACCTGTGAAAGTATGTTCA cjb111_ai2.seq
5541  CTGAGATCATGTATGTTTTACTATCAGTCAGACCACTGAATTTACCAGCA h36b_ai2.seq

      AAGTTACCAGATACTGTAAATTTGATACCATTACCAATGTCGATTGTACC Majority
                5610      5620      5630      5640      5650
5573  AAGTTACCAGATACTTCAAATTTGATACCATTTCCAAGGTCGATTGTACC 2603_ai2.seq
5573  AAGTTACCAGATACTTCAAATTTGATACCATTTCCAAGGTCGATTGTACC 18rs21_ai2.seq
5595  AAGCTAGTTGCAGCTGTTGCTTTAGCTGAATCAACATTCACCCATTTGTC 515_ai2.seq
5594  AAGCGTGATGGTTTTGTTGCTTCGTGTGAAGCAACGTTCACCCATGTACC cjb111_ai2.seq
5591  AACGCTCCAGTAACTGTAAATTTAATACCATTACCTAAGTTGATTTCGCC h36b_ai2.seq

      ATT---AGGT---GTTTTTGTCAATGATACTGAAGCAACAGCTGTATCAT Majority
                5660      5670      5680      5690      5700
5623  TTT---AGAT---GTTTTTGTCAATGATACTGAAGCAACAGTTTTATCTT 2603_ai2.seq
5623  TTT---AGAT---GTTTTTGTCAATGATACTGAAGCAACAGTTTTATCTT 18rs21_ai2.seq
5645  ACC---ATCT---TTAACTTGCAAGGTGAAGACAGCATCAACTGTTTCAT 515_ai2.seq
5644  ATCCGTTTGT---TTTTCTTGCAAGGTAAAGATAGCTTTAACTGCAACAT cjb111_ai2.seq
5641  ATT---TGGTGTTGTTTTTGTCAATGAAACTGAGGCAACAGCTGTTCCAC h36b_ai2.seq

      TATCTTTAAATGTGTAAACAACGTTTACATTATCTGGTTCACTACCTTCT Majority
                5710      5720      5730      5740      5750
5667  TATCTTTCAATGTGTAAACAACGTTTACACCATCAGGTGCAATTCCGTCA 2603_ai2.seq
5667  TATCTTTCAATGTGTAAACAACGTTTACACCATCAGGTGCAATTCCGTCA 18rs21_ai2.seq
5689  CTGCTTTA---------------------TTCACTTCATTGCCATCTACT 515_ai2.seq
5691  TAGCATCA---------------------GTAATTG---TACCATCTACT cjb111_ai2.seq
5688  CATCTTTAAGGGTATAAACAACATTCGCATTCTCTAAATCTGAACCTTTG h36b_ai2.seq

      GCCCAAGTTTTAGTAACTGTTATTTCACCCTTTGATGGTGTAACTGGTAG Majority
                5760      5770      5780      5790      5800
5717  GACCAAGTTTTAGCAACTGTTACTTCACCCTTTGAAGGTGTAACAGGAAG 2603_ai2.seq
5717  GACCAAGTTTTAGCAACTGTTACTTCACCCTTTGAAGGTGTAACAGGAAG 18rs21_ai2.seq
5718  GCCCATGTTTTGTTAACAGTGATTTTCTTATCAACTGGAATACCTTCTTT 515_ai2.seq
5717  GCCCAGTCTTTAATGACTTTAATTTCTTGGTTAGCTGGAGTACCTTCTTG cjb111_ai2.seq
5738  TCCCAAGTTTTGCTAACAGTGATTTCGCCATTTGACGGTGTTACTGGGAT h36b_ai2.seq

      TTCTTTCATTTCTTTACCTGGTTTGTTACCATAGTCCAATTTGATATCAT Majority
                5810      5820      5830      5840      5850
5767  TTCAGTCAAGTCTTTACCTGGTTTGTTACCATACGACAATTTGATATCAT 2603_ai2.seq
5767  TTCAGTCAAGTCTTTACCTGGTTTGTTACCATACGACAATTTGATATCAT 18rs21_ai2.seq
5768  TGGTTCATTTTCAATTGTTGGGTTGTTGCCGTAGTCCAATTTAACATCAT 515_ai2.seq
5767  TGGTTCACTTTCTTCCGTTGGGTTATTACCATAGTCCAATTTAACATCAT cjb111_ai2.seq
5788  TTCTTTTACTTTTTTACCTGGTTTGTTACCGTATTGAAGTTTGATATCAT h36b_ai2.seq
```

FIGURE 19N

Alignment Report of Ai-2_alignment, using J. Hein method with Weighted residue weight table.
Thursday, July 29, 2004 6:32 PM

```
     TGGTTTCTGGATTTTCAACAATAGCTGGACCGTTAACAGTAGCTCTATAA Majority
              5860      5870      5880      5890      5900
5817 TGGATTCTGGATTATCAATAATTGCTTGACCATTAACAGTAGCACTATAA 2603_ai2.seq
5817 TGGATTCTGGATTATCAATAATTGCTTGACCATTAACAGTAGCACTATAA 18rs21_ai2.seq
5818 TGGTTTCTAGAACTTCAACGACAGCAGAACCGTTCAAAGTAGCTGAGTAA 515_ai2.seq
5817 TGGTTTCTGGAATTTCAACAGTAGTGGAGCCGTTCACCGTAGCTGAGTAA cjb111_ai2.seq
5838 TGCTTTCTGGCTTGTCATCAATAGCGGCACCGTTAACTGTTGCGCTATAT h36b_ai2.seq

     GTCAATGTGAATTCAACATCTTTTGTTTTTGCTGCTTTTTCCACTTTTGC Majority
              5910      5920      5930      5940      5950
5867 GTCAATGTAAATTCAATATCAGCTGTTTTAGCTGCTTTTTCCAATTTGGC 2603_ai2.seq
5867 GTCAATGTAAATTCAATATCAGCTGTTTTAGCTGCTTTTTCCAATTTGGC 18rs21_ai2.seq
5868 GTGATCTTGATTTCAACATCTTTTGTTTTTGCGGCTTTTGCCACTGCTTC 515_ai2.seq
5867 GTGATCTTGATTTCAACATCTTTGTCTTTTGCAGCTGCTGCTACTGCTGC cjb111_ai2.seq
5888 GTCAATGTGAATTCAACAGCTTGTGTTTCCGCTTCTTTTTGTAGCTTAGT h36b_ai2.seq

     CAAACCTTTAGCTGTGAATTTTAATGTGAAACCACGGTCATCAGTTCCAA Majority
              5960      5970      5980      5990      6000
5917 CAATCCATCAGCTGTGAATTTTAATGTGAAACCACGGGCATCAATGCTAA 2603_ai2.seq
5917 CAATCCATCAGCTGTGAATTTTAATGTGAAACCACGGGCATCAATGCTAA 18rs21_ai2.seq
5918 AAGACCTTTGTCAGTCAAGACAAGGCGGAAACCTTGGTCATCTGCTACAA 515_ai2.seq
5917 AAGACCTGTTGCATTCAAGGCAAGACGGAAACCTTGGTCATCTGTTACGA cjb111_ai2.seq
5938 CAAACCTGTATCTGTGAATTTCAAAGTGAAACCACGGTCATCACGTTCAA h36b_ai2.seq

     GTTTGTAGTCTGTATCCTTAACAAAAGTTCCTG------CCGATGCTTCA Majority
              6010      6020      6030      6040      6050
5967 GTTCATAGTCTGTATCCTTAGCAAAAGTTTCTGTAGTTCCTGAAGCTTTA 2603_ai2.seq
5967 GTTCATAGTCTGTATCCTTAGCAAAAGTTTCTGTAGTTCCTGAAGCTTTA 18rs21_ai2.seq
5968 GTTTGTAATTTGTAGCATCAAGAGTTGCACCAT------CCAATGTTACA 515_ai2.seq
5967 GTTTGTAGTTTAAAACACGGAAATCTTCACCAT------CCAATGTTACT cjb111_ai2.seq
5988 CATTGTAATCTGTACCTTCTACAAAAGAGCCTG------ACGATGCTTCT h36b_ai2.seq

     AGGTTAACAGTGTTACCCATTGTCAAACCATTTGACATGCTATCTGTCCA Majority
              6060      6070      6080      6090      6100
6017 AGGCTAACAGTTGAACCCATTGTCAAACCATTTGACATTATATCTGTCCA 2603_ai2.seq
6017 AGGCTAACAGTTGAACCCATTGTCAAACCATTTGACATTATATCTGTCCA 18rs21_ai2.seq
6012 ---GCAATATCGTTGTTGAAAGTCAAACCTTTGGTCATGCTATCGGTCCA 515_ai2.seq
6011 ---TTAACGTTGTTGTTGAACGTCAAACCTTTAGTCATGCTATCAGTCCA cjb111_ai2.seq
6032 AAGTTAACAGTGTTACCCATTGTCAAACCATTTGACATGGTATCGACCCA h36b_ai2.seq

     AACCAAGTTTTTGTATTTAGAACCTTTGTGAATTTTTGTTTTAACTTCGT Majority
              6110      6120      6130      6140      6150
6067 AACCAAGTTTTCGTATTTAGAACCTTTGTGAATTTTTGTTTTAACTTCAT 2603_ai2.seq
6067 AACCAAGTTTTCGTATTTAGAACCTTTGTGAATTTTTGTTTTAACTTCAT 18rs21_ai2.seq
6059 GATTAATTTCTTATAGTCTGAACCTTTAAGGATTTTTGTTCCAACATGGT 515_ai2.seq
6058 AACCAGTTTCTTATAGTCTGAGCCTTTAAGAATTTTTGTTCCAACTATGT cjb111_ai2.seq
6082 AGCAAGGTTTTTGTATTTAGACCCTTTTTGGATTTTTGTTTTAACTTCGT h36b_ai2.seq

     AAGGTATAACTTTACCGATTTCAGCAGTAGCAGTTGCTTTGTCTTTTTGA Majority
              6160      6170      6180      6190      6200
6117 AAGGAACAACTTTACCGATTTCAGCAGTAGCAGTTGCTTTGTCACGTGCA 2603_ai2.seq
6117 AAGGAACAACTTTACCGATTTCAGCAGTAGCAGTTGCTTTGTCACGTGCA 18rs21_ai2.seq
6109 ATTTTTTAACATCACCAACAGATGCTGAGACAGTCCCTTTGTCTTTTTTG 515_ai2.seq
6108 ATTCTTTTTTGTCACCAACTGTCGCTGAGACAACACCTTTGTCTTTTCGG cjb111_ai2.seq
6132 AAGGGATTTCTTGACCGATTTCAGCAGTAGCTTTTGCTTTTTCTGCCTGA h36b_ai2.seq

     TAGTTAGCATAATCTGCGCCAGCTGTCAAAAGTCTATTAACA-CTGTCAA Majority
              6210      6220      6230      6240      6250
6167 TAATTACCATAATTTGCGCCAGCTGTCAAAAGTCTATTAACATCTGTCAA 2603_ai2.seq
6167 TAATTACCATAATTTGCGCCAGCTGTCAAAAGTCTATTAACATCTGTCAA 18rs21_ai2.seq
6159 TTGTTCGCATAATC------------------------------------ 515_ai2.seq
6158 TTGTCAGTATAATC------------------------------------ cjb111_ai2.seq
6182 TATTTGTCGTAGTCTGCCCCACCTGCAATAGCTGAATTATCA-CTGTCAT h36b_ai2.seq

     T--TGTCAAGTTGTTTGTTTTAGCAAAGTTTTTATCTATTTGTGGTTTTT Majority
              6260      6270      6280      6290      6300
6217 TGCTGTCAAATCGTTTGTTTTAGCAAAGTTTTTATCAATTTCTGGTTTTT 2603_ai2.seq
6217 TGCTGTCAAATCGTTTGTTTTAGCAAAGTTTTTATCAATTTCTGGTTTTT 18rs21_ai2.seq
6173 -------AAGTTCTTTATCT--GCGAAGTTCTTATCTACTTGTGGTTTTG 515_ai2.seq
6172 -------AAGATCTTTATCT--GCAAAGTTCTTATCTACTTGTGGTTTTG cjb111_ai2.seq
6231 T--CAACAATTTATTTGCTTTAGCAAAGTTTTTGTCGATTTGTGGTGCTT h36b_ai2.seq
```

Alignment Report of AI-2_alignment, using J. Hein method with Weighted residue weight table.
Thursday, July 29, 2004 6:32 PM

FIGURE 19P

Alignment Report of Ai-2_alignment, using J. Hein method with Weighted residue weight table.
Thursday, July 29, 2004 6:32 PM

```
     GTTCCTGGGAAGTTACTTTTGTCAAAATTAGCTTGTGTTTGGACAATCTT Majority
              6760      6770      6780      6790      6800
6713 GTTCCTGGGAAGTTACTTTTGTTAAGATTTGATTCGGTTTGCAAAATCTT 2603_ai2.seq
6713 GTTCCTGGGAAGTTACTTTTGTTAAGATTTGATTCGGTTTGCAAAATCTT 18rs21_ai2.seq
6621 GTACCAGCAG---TAAAACCGTCAAATGCAGTTCGAGGCATGACAATCTT 515_ai2.seq
6620 GTACCTTCAG---TAAAGTTATCAAATGCAGCTTGTGGCATGACAATCTT cjb111_ai2.seq
6668 ATTCCTGGGAAATTTGGCTTAGCCAAATTATCGGATGTTTGAACAATTTT h36b_ai2.seq

     GTGCAAGGTCACTGTATTAGT---TGT------TGCTTCATCCGCAAACG Majority
              6810      6820      6830      6840      6850
6763 GTGCAAAGTCACTGTATTAGT---TGT------TGCTTCATCCGCAAACG 2603_ai2.seq
6763 GTGCAAAGTCACTGTATTAGT---TGT------TGCTTCATCCGCAAACG 18rs21_ai2.seq
6668 GTGCAAGGTCACTGTGTCAGTAGTTTT------TGCTTCTTCCGCAAACA 515_ai2.seq
6667 GTGCAAGGTCACAGTATCAGT---TGT------TGCGTCGTCCGCAAACG cjb111_ai2.seq
6718 GTGTAAGGTTACTGTTTTAGT---GATATTTCCCATCTCAGCAGCAAATA h36b_ai2.seq

     CTGGTGCAACTGAGAACAATGACGTTAAAGTCAGTAACAATGCCGAGAAC Majority
              6860      6870      6880      6890      6900
6804 CTGGTGCAACTGAGAGCAATGACGTTAAAGTCAGTAACAATGCCGAGAAC 2603_ai2.seq
6804 CTGGTGCAACTGAGAGCAATGACGTTAAAGTCAGTAACAATGCCGAGAAC 18rs21_ai2.seq
6712 CTGGTGCAACTGAGAACAATGATGTTACGGTCAGTAGCAATGCCGAGAAG 515_ai2.seq
6708 CTGGTGCAACTGAGAATAGTGACGTTAAGATCAATAGCAGTGTCGAGAAC cjb111_ai2.seq
6765 CCGGAGCTACCGATAACAACGATGTTAAAATTAATAACAATGCCGAGAAC h36b_ai2.seq

     ATTGCAAAATATTTGTTGATTCTTTTCATTTCTATCTCCTTCTTATTTTA Majority
              6910      6920      6930      6940      6950
6854 ATTGCAAAATATTTGTTGATTCTTTTCATTTCTATCTCCTTCTTATTTTA 2603_ai2.seq
6854 ATTGCAAAATATTTGTTGATTCTTTTCATTTCTATCTCCTTCTTATTTTA 18rs21_ai2.seq
6762 ACTGCAAAATATTTGTTGATTTTTTTCATTTCTATCTCCTTCTTATTTTA 515_ai2.seq
6758 ATTGTAAGACATTTGTTGATTTTTTTCATTTCTATCTCCTTCTTATTCTA cjb111_ai2.seq
6815 ATTGCAAAATATTTGTTGATTCTTTTCATTTCTATCTCCTTCTTATTTTA h36b_ai2.seq

     GTTAATCAACATGATTAATAATATGCGGATTTTAATA-C-ACCGCAGCAC Majority
              6960      6970      6980      6990      7000
6904 GTTAATCAACATGATTAATAATATGCGGATTTTAATA-C-ACCGCAGCAC 2603_ai2.seq
6904 GTTAATCAACATGATTAATAATATGCGGATTTTAATA-C-ACCGCAGCAC 18rs21_ai2.seq
6812 GTTAATCAACATGATTAATAATATGCGGATTTTAATA-C-ACCGCAGCAC 515_ai2.seq
6808 GTTAATCAACATAGATAATAATATACGGATTATAATATT-ACCGCAGCAC cjb111_ai2.seq
6865 GTTAATCAACATAAATAATAATATACGGATTATAATA-CTACCGCAGCAC h36b_ai2.seq

     CACTCCCTTCAAGTCATGGAATTTTAGTTAATTAATTAAGAATACTAAAG Majority
              7010      7020      7030      7040      7050
6952 CACTCCCTTCAAGTCATGGAATTTTAGTTAATTAATTAAGAATACTAAAG 2603_ai2.seq
6952 CACTCCCTTCAAGTCATGGAATTTTAGTTAATTAATTAAGAATACTAAAG 18rs21_ai2.seq
6860 CACTCCCTTCAAGTCATGGAATTTTAGTTAATTAATTAAGAATACTAAAG 515_ai2.seq
6857 CACTCCTTTC--------GAATTATATTTAATTAATTAAGAATACTAAAA cjb111_ai2.seq
6914 CACTCCTTTCAAAATAT------------ATTTAATTAATAATGCTAAAG h36b_ai2.seq

     CGCATAATTTTTAATCTTTTTTGATGGACATATCACTAGATTTCTTATAC Majority
              7060      7070      7080      7090      7100
7002 CGCATAATTTTTAATCTTTTTTGATGGACATATCACTAGATTTCTTATAC 2603_ai2.seq
7002 CGCATAATTTTTAATCTTTTTTGATGGACATATCACTAGATTTCTTATAC 18rs21_ai2.seq
6910 CGCATAATTTTTAATCTTTTTTGATGGACATATCACTAGATTTCTTATAC 515_ai2.seq
6899 CACATGATTCTTAATCTTTTTCTCTAGATATATCACTAGATTTCTTATAT cjb111_ai2.seq
6952 CACATAGTTCTTAATCTTTCTCGATTGATGCATCACTAGATTTCTTATGT h36b_ai2.seq

     CTTTTCCAAATATAAATTCCACCTGCAATAGACATCATAGCTCCACCTAT Majority
              7110      7120      7130      7140      7150
7052 CTTTTCCAAATATAAATTCCACCTGCAATAGACATCATAGCTCCACCTAT 2603_ai2.seq
7052 CTTTTCCAAATATAAATTCCACCTGCAATAGACATCATAGCTCCACCTAT 18rs21_ai2.seq
6960 CTTTTCCAAATATAAATTCCACCTGCAATAGACATCATAGCTCCACCTAT 515_ai2.seq
6949 CTTTTCCAAATATAAATTCCACCTGCAATAGACATCATAGATCCACCTAT cjb111_ai2.seq
7002 CTTTTCCAAATATAAATTCCACCTGCAATAGACATCATAGCTCCACCTAT h36b_ai2.seq

     TAAAATGAAAGATAGAATTCCTTTCCCACCTGTCATAGGAATAATTCCTT Majority
              7160      7170      7180      7190      7200
7102 TAAAATGAAAGATAGAATTCCTTTCCCACCTGTCATAGGAATAATTCCTT 2603_ai2.seq
7102 TAAAATGAAAGATAGAATTCCTTTCCCACCTGTCATAGGAATAATTCCTT 18rs21_ai2.seq
7010 TAAAATGAAAGATAGAATTCCTTTCCCACCTGTCTTAGGAATAATTCCTT 515_ai2.seq
6999 TAAAATGAAAGATAGAATTCCTTTCCCACCTGTCATGGGAATAATTCCTT cjb111_ai2.seq
7052 TAAAATGAAAGATAGAATTCCTTTCCCACCTGTCATGGGAATAATTCCTT h36b_ai2.seq
```

FIGURE 19Q

Alignment Report of AI-2_alignment, using J. Hein method with Weighted residue weight table.
Thursday, July 29, 2004 6:32 PM

```
     TTGGTGGAATATGCGTGTTGGTAATTAAATGCTTGTCACCTTCCTCATGA Majority
              7210      7220      7230      7240      7250
7152 TTGGTGGAATATGCGTGTTGGTAATTAAATGCTTGTCACCTTCCTCATGA 2603_ai2.seq
7152 TTGGTGGAATATGCGTGTTGGTAATTAAATGCTTGTCACCTTCCTCATGA 18rs21_ai2.seq
7060 TTGGTGGAATATGCGTGTTGGTAATTAAATGCTTGTCACCTTCCTCATGA 515_ai2.seq
7049 TTGGTGGAATATGCGTGTTGGTAATTAAATGCTTGTCACCTTCCTCATGA cjb111_ai2.seq
7102 TTGGTGGAATATGCGTGTTGGTAATTAAATGCTTGTCACCTTCCTCATGA h36b_ai2.seq

     TATTCAGAAATCTGTTTATTAACAGCTATTATATTTTTTATCGATCCTTT Majority
              7260      7270      7280      7290      7300
7202 TATTCAGAAATCTGTTTATTAACAGCTATTATATTTTTTATCGATCCTTT 2603_ai2.seq
7202 TATTCAGAAATCTGTTTATTAACAGCTATTATATTTTTTATCGATCCTTT 18rs21_ai2.seq
7110 TATTCAGAAATCTGTTTATTAACAGCTATTATATTTTTTATCGATCCTTT 515_ai2.seq
7099 TATTCAGAAATCTGTTTATTAACAGCTATTATATTTTGTATCGATCCTTT cjb111_ai2.seq
7152 TATTCAGAAATCTGTTTATTAACAGCTATTATATTTTGTATCGATCCTTT h36b_ai2.seq

     AACCACTTCAAAAGTTAAAATTGGTTTATTAGTAATTTTTTGATAATCCT Majority
              7310      7320      7330      7340      7350
7252 AACCACTTCAAAAGTTAAAATTGGTTTATTAGTAATTTTTTGATAATCCT 2603_ai2.seq
7252 AACCACTTCAAAAGTTAAAATTGGTTTATTAGTAATTTTTTGATAATCCT 18rs21_ai2.seq
7160 AACCACTTCAAAAGTTAAAATTGGTTTATTAGTAATTTTTTGATAATCCT 515_ai2.seq
7149 AACAACTTCAAAAGTTAAAATTGGTTTATTAGTAATTTTTTGATAATCCT cjb111_ai2.seq
7202 AACAACTTCAAAAGTTAAAATTGGTTTATTAGTAATTTTTTGATAATCCT h36b_ai2.seq

     CCGGCGAAACTGCTTCTATTAACTGATATTTGCCATCTTTCAAATCTTTG Majority
              7360      7370      7380      7390      7400
7302 CCGGCGAAACTGCTTCTATTAACTGATATTTGCCATCTTTCAAATCTTTG 2603_ai2.seq
7302 CCGGCGAAACTGCTTCTATTAACTGATATTTGCCATCTTTCAAATCTTTG 18rs21_ai2.seq
7210 CCGGCGAAACTGCTTCTATTAACTGATATTTGCCATCTTTCAAATCTTTG 515_ai2.seq
7199 TCGGCGAAACTGCTTCTATTAACTGATATTTGCCATCTTTCAAATCTTTG cjb111_ai2.seq
7252 TCGGCGAAACTGCTTCTATTAACTGATATTTGCCATCTTTCAAATCTTTG h36b_ai2.seq

     TAAGAAATTTTGCCGTTTTCTCCCGTCACTACTTTTGAATTATTATTTTT Majority
              7410      7420      7430      7440      7450
7352 TAAGAAATTTTGCCGTTTTCTCCCGTCACTACTTTTGAATTATTATTTTT 2603_ai2.seq
7352 TAAGAAATTTTGCCGTTTTCTCCCGTCACTACTTTTGAATTATTATTTTT 18rs21_ai2.seq
7260 TAAGAAATTTTGCCGTTTTCTCCCGTCACTACTTTTGAATTATTATTTTT 515_ai2.seq
7249 TAAGAAATTTTGCCGTTTTCTCCCGTCACTACTTTTGAATTATTATTTTT cjb111_ai2.seq
7302 TAAGAAATTTTGCCGTTTTCTCCCGTCACTACTTTTGAATTATTATTTTT h36b_ai2.seq

     TATTGGTAAATAAAGTTTATAATCTTCATTAAATTCTTGAAGTTCAAACG Majority
              7460      7470      7480      7490      7500
7402 TATTGGTAAATAAAGTTTATAATCTTCATTAAATTCTTGAAGTTCAAACG 2603_ai2.seq
7402 TATTGGTAAATAAAGTTTATAATCTTCATTAAATTCTTGAAGTTCAAACG 18rs21_ai2.seq
7310 TATTGGTAAATAAAGTTTATAATCTTCATTAAATTCTTGAAGTTCAAACG 515_ai2.seq
7299 TATTGGTAAATAAAGTTTATAATCTTCATTAAATTCTTGAAGTTCAAACG cjb111_ai2.seq
7352 TATTGGTAAATAAAGTTTATAATCTTCATTAAATTCTTGAAGTTCAAATG h36b_ai2.seq

     TAGCTCCTTTGAGAAGCAACTTATTATTATCTTTATCAACTTTTATAAAT Majority
              7510      7520      7530      7540      7550
7452 TAGCTCCTTTGAGAAGCAACTTATTATTATCTTTATCAACTTTTATAAAT 2603_ai2.seq
7452 TAGCTCCTTTGAGAAGCAATTTATTATTATCTTTATCAACTTTTATAAAT 18rs21_ai2.seq
7360 TAGCTCCTTTGAGGAGCAACTTATTATTATCTTTATCAACTTTTATAAAT 515_ai2.seq
7349 TAGCTCCTTTGAGAAGCAACTTATTATTATCTTTATCAACTTTTGTAAAT cjb111_ai2.seq
7402 TAGCTCCTTTGAGAAGCAACTTATTATTATCTTTATCAACTTTTGTAAAT h36b_ai2.seq

     TCAATTTCACCTAACTTCTTCTCGTTTTTAATCGTTATTGTAGGATATTC Majority
              7560      7570      7580      7590      7600
7502 TCAATTTCACCTAACTTCTTCTCGTTTTTAATCGTTATTGTAGGATATTC 2603_ai2.seq
7502 TCAATTTCACCTAACTTCTTCTCGTTTTTAATCGTTATTGTAGGATATTC 18rs21_ai2.seq
7410 TCAATTTCACCTAACTTCTTCTCGTTTTTAATCGTTATTGTAGGATATTC 515_ai2.seq
7399 TCAATTTCACCTAACTTCTTCTCGTTTTTAATCGTTATTGTAGGATATTC cjb111_ai2.seq
7452 TCAATTTCACCTAACTTCTTCTCGTTTTTAATCGTTATTGTAGGATATTC h36b_ai2.seq

     TCTCACATCACGAATTTTAGGGATTGGAAAATCTCTAAGTGTATTAGGAT Majority
              7610      7620      7630      7640      7650
7552 TCTCACATCACGAATTTTAGGGATTGGAAAATCTCTAAGTGTATTAGGAT 2603_ai2.seq
7552 TCTCACATCACGAATTTTAGGGATTGGAAAATCTCTAAGTGTATTAGGAT 18rs21_ai2.seq
7460 TCTCACATCACGAATTTTAGGGATTGGAAAATCTCTAAGTGTATTAGGAT 515_ai2.seq
7449 TCTCACATCACGAATTTTAGGGATTGGAAAATCTCTAAGTGTATTAGGAT cjb111_ai2.seq
7502 TCTCACATCACGAATTTTAGGGATTGGAAAATCTCTAAGTGTATCGGGCT h36b_ai2.seq
```

FIGURE 19R

Alignment Report of Ai-2_alignment, using J. Hein method with Weighted residue weight table.
Thursday, July 29, 2004 6:32 PM

```
     CCTCTGACTTAGGATTCAATGTTGTTCTACCATTAGTGTCATAGAATTTG Majority
              7660      7670      7680      7690      7700
7602 CCTCTGACTTAGGATTCAATGTTGTTCTACCATTAGTGTCATAGAATTTG 2603_ai2.seq
7602 CCTCTGACTTAGGATTCAATGTTGTTCTACCATTAGTGTCATAGAATTTG 18rs21_ai2.seq
7510 CCTCTGACTTAGGATTCAATGTTGTTCTACCATTAGTGTCATAGAATTTG 515_ai2.seq
7499 CCTCTGATTTAGGATTCAATGTTGTTCTACCATTAGTGTCATAGAATTTG cjb111_ai2.seq
7552 CCTCTGATTTAGGATTCAATGTTGTTCTACCATTAGTGTCATAGAATTTG h36b_ai2.seq

     TTACTTATAAAACTGTCATCTAGTTTCACATCATATGTGAGTGTTACTTT Majority
              7710      7720      7730      7740      7750
7652 TTACTTATAAAACTGTCATCTAGTTTCACATCATATGTGAGTGTTACTTT 2603_ai2.seq
7652 TTACTTATAAAACTGTCATCTAGTTTCACATCATATGTGAGTGTTACTTT 18rs21_ai2.seq
7560 TTACTTATAAAACTGTCATCTAGTTTCACATCATATGTGAGTGTTACTTT 515_ai2.seq
7549 TTACTTATAAAACTGTCATCTAGTTTCACATCATATGTGAGTGTTACTTT cjb111_ai2.seq
7602 TTACTAATAAAACTGTCATCTAGTTTCACATCATATGTGAGTGTTACTTT h36b_ai2.seq

     TTGACCTTCTCCTAAATTCAAACCTCTAACATAGAGTTTATTTCCGATGT Majority
              7760      7770      7780      7790      7800
7702 TTGACCTTCTCCTAAATTCAAACCTCTAACATAGAGTTTATTTCCGATGT 2603_ai2.seq
7702 TTGACCTTCTCCTAAATTCAAACCTCTAACATAGAGTTTATTTCCGATGT 18rs21_ai2.seq
7610 TTGACCTTCTCCTAAATTCAAACCTCTAACATAGAGTTTATTTCCGATGT 515_ai2.seq
7599 TTGTCCCTCCCCTAAGTTCAAACCTCTAACGTAGAGTTTATTTTTGATGT cjb111_ai2.seq
7652 TTGCCCCTCCCCTAAGTTCAAACCTCTAACGTAGAGTTTATTTTTGATGT h36b_ai2.seq

     ATTCTAATTTAACCCCCTTAAGTATTCCACCATCATTATTAGGCCCACCA Majority
              7810      7820      7830      7840      7850
7752 ATTCTAATTTAACCCCCTTAAGTATTCCACCATCATTATTAGGCCCACCA 2603_ai2.seq
7752 ATTCTAATTTAACCCCCTTAAGTATTCCACCATCATTATTGGGCCCACCA 18rs21_ai2.seq
7660 ATTCTAATTTAACCCCCTTAAGTATTCCACCATCATTATTAGGCCCACCA 515_ai2.seq
7649 ATTCTAATTTAACCCCTTTAAGTATTCCACCATCATTATTAGGCCCACCA cjb111_ai2.seq
7702 ATTCTAATTTAACCCCTTTAAGTATCCCACCATCATTATTAGGCCCTCCA h36b_ai2.seq

     GTTGCAATACCATCCTTCATTACACTTCCATCATTTCCCTGTAAAGTATA Majority
              7860      7870      7880      7890      7900
7802 GTTGCAATACCATCCTTCATTACACTTCCATCATTTCCCTGTAAAGTATA 2603_ai2.seq
7802 GTTGCAATACCATCCTTCATTACACTTCCATCATTTCCCTGTAAAGTATA 18rs21_ai2.seq
7710 GTTGCAATACCATCCTTCATTACACTTCCATCATTTCCCTGTAAAGTATA 515_ai2.seq
7699 GTTGCAATGCTATCTTTCATTATACTTCCATCATTTCCCTGTAAAGTATA cjb111_ai2.seq
7752 GTTGCAATGCTATCTTTCATTATACTTCCATCATTTCCCTGTAAAGTATA h36b_ai2.seq

     ATCACTTGGCTGTAATGTTTGTCCATTACCAAGCTGTAAATTGATTTTAT Majority
              7910      7920      7930      7940      7950
7852 ATCACTTGGCTGTAATGTTTGTCCATTACCAAGCTGTAAATTGATTTTAT 2603_ai2.seq
7852 ATCACTTGGCTGTAATGTTTGTCCATTACCAAGCTGTAAATTGATTTTAT 18rs21_ai2.seq
7760 ATCACTTGGCTGTAATATTTGTCCATTACCAAGCTGTAAATTGATTTTAT 515_ai2.seq
7749 ATCACTTGGTTGCAATGTTTGTCCGTTGCCAAGCTGTAAATTGATTTTGT cjb111_ai2.seq
7802 ATCACTTGGTTGCAATGTTTGTCCGTTGCCAAGATGTAAATTGATTTTAT h36b_ai2.seq

     CACCCATAGGATCTTCGATAGTTCCATTAACAATTGAGTTTTCTTTTGTT Majority
              7960      7970      7980      7990      8000
7902 CACCCATAGGATCTTCGATAGTTCCATTAACAATTGAGTTTTCTTTTGTT 2603_ai2.seq
7902 CACCCATAGGATCTTCGATAGTTCCATTAACAATTGAGTTTTCTTTTGTT 18rs21_ai2.seq
7810 CACCCATAGGATCTTCGATAGTTCCATTAACAATTGAGTTTTCTTTTGTT 515_ai2.seq
7799 CACCCATAGGATCTTCTATAGTTCCATTAACAATTGAGTTTTCTTTTGTT cjb111_ai2.seq
7852 CACCCATAGGATCTTCTATAGTTCCATTAACAATTGAGTTTTCCTTTGTT h36b_ai2.seq

     AAAATCGTTTCAAATTGTTGCTGAATTTTAGATAAAATTTCATTGTTAGA Majority
              8010      8020      8030      8040      8050
7952 AAAATCGTTTCAAATTGTTGCTGAATTTTAGATAAAATTTCATTGTTAGA 2603_ai2.seq
7952 AAAATCGTTTCAAATTGTTGCTGAATTTTAGATAAAATTTCATTGTTAGA 18rs21_ai2.seq
7860 AAAATCGTTTCAAATTGTTGCTGAATTTTAGATAAAATTTCATTGTTAGA 515_ai2.seq
7849 AAAATCTTTTCAAATTGTTGCTGAATTTTAGATAAAATTTCATTGTTAGA cjb111_ai2.seq
7902 AAAATCTTTTCAAATTGTTGCTGAATTTTAGATAAAATTTCATTATTAGA h36b_ai2.seq

     TGTATCGGCTGAAGTTACGATAGGGGTGTAGTACTCAGGTTTGGAAGAGA Majority
              8060      8070      8080      8090      8100
8002 TGTATCGGCTGAAGTTACGATAGGGGTGTAGTACTCAGGTTTGGAAGAGA 2603_ai2.seq
8002 TGTATCGGCTGAAGTTACGATAGGGGTGTAGTACTCAGGTTTGGAAGAGA 18rs21_ai2.seq
7910 TGTATCGGCTGAAGTTACGATAGGGGTGTAGTACTCAGGTTTGGAAGAGA 515_ai2.seq
7899 TGCATCGGATGAAGTTACTATCGGGGTATAATACTCAGGTTTAGAAGAGA cjb111_ai2.seq
7952 TACATCAGCTGAAGTTACTATCGGGGTATAATACTCAGGTTTAGAAGAGA h36b_ai2.seq
```

FIGURE 19S

Alignment Report of Ai-2_alignment, using J. Hein method with Weighted residue weight table.
Thursday, July 29, 2004 6:32 PM

```
     ACGACCTCATTAGTTCTGTGATTTCTCCATCTGAAAGTTTAAAAGCTTCC Majority
               8110      8120      8130      8140      8150
8052 ACGACCTCATTAGTTCTGTGATTTCTCCATCTGAAAGTTTAAAAGCTTCC 2603_ai2.seq
8052 ACGACCTCATTAGTTCTGTGATTTCTCCATCTGAAAGTTTAAAAGCTTCC 18rs21_ai2.seq
7960 ACGACCTCATTAGTTCTGTGATTTCTCCATCTGAAAGTTTAAAAGCTTCC 515_ai2.seq
7949 ATGACTTCATTAGTTCTGTTATTTCCCCATCTGAAAGTTCAAAAGCTTCC cjb111_ai2.seq
8002 ATGAATTCATTAGTTCTGTTATTTCCCCATCTGAAAGTTCAAAAGCTTCC h36b_ai2.seq

     TCTTTCAATTTTTGAAAAGTACCATCTTGATTTTTCTTATACTCCTCATT Majority
               8160      8170      8180      8190      8200
8102 TCTTTCAATTTTTGAAAAGTACCATCTTGATTTTTCTTATACTCCTCATT 2603_ai2.seq
8102 TCTTTCAATTTTTGAAAAGTACCATCTTGATTTTTCTTATACTCCTCATT 18rs21_ai2.seq
8010 TCTTTCAATTTTTGAAAAGTACCATCTTGATTTTTCTTATACTCCTCATT 515_ai2.seq
7999 TCTTTCAATTTTTGAAAAGTACCATCTTGATTTTTCTTATAATCCTCATT cjb111_ai2.seq
8052 TCCTTCAATTTTTGAAAAGTACCATCTTGATTTTTCTTATAATCCTCATT h36b_ai2.seq

     ATAAACTTGTCTAAAACCAGATATATCGATACCAAAATTAAAAATGTCAT Majority
               8210      8220      8230      8240      8250
8152 ATAAACTTGTCTAAAACCAGATATATCGATACCAAAATTAAAAATGTCAT 2603_ai2.seq
8152 ATAAACTTGTCTAAAACCAGATATATCGATACCAAAATTAAAAATGTCAT 18rs21_ai2.seq
8060 ATAAACTTGTCTAAAACCAGATATATCGATACCAAAATTAAAAATGTCAT 515_ai2.seq
8049 ATAAACTTGTCTAAAACCAGATATATCTATACCAAAATTAAAGATGTCAT cjb111_ai2.seq
8102 ATAAACTTGTCTAAAACCAGATATATCTATACCAAAATTAAAGATGTCAT h36b_ai2.seq

     AATTTTTCTGTTTTAAACTATTTATATAAAGTTTGGTTGGTGTTCCATGT Majority
               8260      8270      8280      8290      8300
8202 AATTTTTCTGTTTTAAACTATTTATATAAAGTTTGGTTGGTGTTCCATGT 2603_ai2.seq
8202 AATTTTTCTGTTTTAAACTATTTATATAAAGTTTGGTTGGTGTTCCATGT 18rs21_ai2.seq
8110 AATTTTTCTGTTTTAAACTATTTATATAAAGTTTGGTTGGTGTTCCATGT 515_ai2.seq
8099 AATTTTTCTGTTTTAAACTATTTATATAAAGTTTGGTTGGTGTTCCATGT cjb111_ai2.seq
8152 AATTTTTCTGTTTTAAACTATTTATATAAAGTTTGGTTGGTGTTCCATGT h36b_ai2.seq

     TCTTTCACTGGTCCATTTCGATAAATTGTACCTTTAGGGTAATTAAGATT Majority
               8310      8320      8330      8340      8350
8252 TCTTTCACTGGTCCATTTCGATAAATTGTACCTTTAGGGTAATTAAGATT 2603_ai2.seq
8252 TCTTTCACTGGTCCATTTCGATAAATTGTACCTTTAGGGTAATTAAGATT 18rs21_ai2.seq
8160 TCTTTCACTGGTCCATTTCGATAAATTGTACCTTTAGGGTAATTAAGATT 515_ai2.seq
8149 TCTCTTACTGGTCCATTTCGATAAAATGTACCTTTAGGGTAATTAAGATT cjb111_ai2.seq
8202 TCTCTTACTGGTCCATTTCTATAAATTGTACCTTTAGGGTAATTAAGATT h36b_ai2.seq

     TAAATCTAAATAATGAAGTTTTTGTAAGTTTCCAGAGATTATCTGTGTTT Majority
               8360      8370      8380      8390      8400
8302 TAAATCTAAATAATGAAGTTTTTGTAAGTTTCCAGAGATTATCTGTGTTT 2603_ai2.seq
8302 TAAATCTAAATAATGAAGTTTTTGTAAGTTTCCAGAGATTATCTGTGTTT 18rs21_ai2.seq
8210 TAAATCTAAATAATGAAGTTTTTGTAAGTTTCCAGAGATTATCTGTGTTT 515_ai2.seq
8199 TAAATCTAAATAATGAAGTTTTTGTAAGTTTCCAGAGATTATCTGTGTTT cjb111_ai2.seq
8252 TAAATCTAAATAATGAAGTTTTTGTAAGTTTCCAGAAATTATCTGTGTTT h36b_ai2.seq

     GATAACTATCTAAGGGAAACAAAAAGTAACTCTCCCCATTTCCTTTTATA Majority
               8410      8420      8430      8440      8450
8352 GATAACTATCTAAGGGAAACAAAAAGTAACTCTCCCCATTTCCTTTTATA 2603_ai2.seq
8352 GATAACTATCTAAGGGAAACAAAAAGTAACTCTCCCCATTTCCTTTTATA 18rs21_ai2.seq
8260 GATAACTATCTAAGGGAAATAAAAAGTAACTCTCCCCATTTCCTTTTATA 515_ai2.seq
8249 GATAACTATCTAAGGGAAACAAAAAGTAACTCTCCCCATTTCCTTTTATA cjb111_ai2.seq
8302 GATAACTATCTAAGGGAAACAAAAAGTAACTCTCCCCATTGCCTTTGATC h36b_ai2.seq

     TCCTCGGGCTTATCAGTAAGTAGAAAATTACTTTTATTTAGATATCCATT Majority
               8460      8470      8480      8490      8500
8402 TCCTCGGGCTTATCAGTAAGTAGAAAATTACTTTTATTTAGATATCCATT 2603_ai2.seq
8402 TCCTCGGGCTTATCAGTAAGTAGAAAATTACTTTTATTTAGATATCCATT 18rs21_ai2.seq
8310 TCATCGGGCTTATCAGTAAGTAGAAAATTACTTTTATTTAGATATCCATT 515_ai2.seq
8299 TCCTCGGGCTTATCAGTAAGTAGAAAATTACTTTTATTTAGATATCCATT cjb111_ai2.seq
8352 TTTTCTGGATCATCAGTTATAAAATAATTATTTTTGTCTAAATAACCTTT h36b_ai2.seq

     TTTTTTCATTTGTTCAAATTGGCTTTCATATGATGCACCCAGTTTAAAAT Majority
               8510      8520      8530      8540      8550
8452 TTTTTTCATTTGTTCAAATTGGCTTTCATATGATGCACCCAGTTTAAAAT 2603_ai2.seq
8452 TTTTTTCATTTGTTCAAATTGGCTTTCATATGATGCACCCAGTTTAAAAT 18rs21_ai2.seq
8360 TTTTTTCATTTGTTCAAATTGGCTTTCATATGATGCACCCAGTTTAAAAT 515_ai2.seq
8349 TTTTTTCATTTGTTCAAATTGGCTTTCATATGATGCACCCAGTTTAAAAT cjb111_ai2.seq
8402 TTCTTTTATTCTCTCAAATTGATTTGCGTATGTTGAACCTTTTACAAAAC h36b_ai2.seq
```

FIGURE 19T

Alignment Report of Ai-2_alignment, using J. Hein method with Weighted residue weight table.
Thursday, July 29, 2004 6:32 PM

```
     T A T T A A T A G C A T A T G A T C T C G T A G G A A C A C C A T C A G T T A C A T G A A C A A T A Majority
                         8560                8570                8580                8590                8600
8502 T A T T A A T A G C A T A T G A T C T C G T A G G A A C A C C A T C A G T T A C A T G A A C A A T A 2603_ai2.seq
8502 T A T T A A T A G C A T A T G A T C T C G T A G G A A C A C C A T C A G T T A C A T G A A C A A T A 18rs21_ai2.seq
8410 T A T T A A T A G C A T A T G A T C T C G T A G G A A C A C C A T C A G T T A C A T G A A C A A T A 515_ai2.seq
8399 T A T T A A T A G C A T A T G A T C T C G T A G G A A C A C C A T C A G T T A C A T G A A C A A T A cjb111_ai2.seq
8452 T A T T A A T G G C A T A T G A T C T T G T T G G A A C A C C G T C A G T T A G A T G A A C A A T A h36b_ai2.seq

     A T T T T T T G A C T A T T T C G A T T T A C T T G A C T C A A A A T A T C A T C T G C C T C C A T Majority
                         8610                8620                8630                8640                8650
8552 A T T T T T T G A C T A T T T C G A T T T A C T T G A C T C A A A A T A T C A T C T G C C T C C A T 2603_ai2.seq
8552 A T T T T T T G A C T A T T T C G A T T T A C T T G A C T C A A A A T A T C A T C T G C C T C C A T 18rs21_ai2.seq
8460 A T T T T T T G A C T A T T T C G A T T T A C T T G A C T C A A A A T A T C A T C T G C C T C C A T 515_ai2.seq
8449 A T T T T T T G A C T A T T T C G A T T T A C T T G A C T C A A A A T A T C A T C T G C C T C C A T cjb111_ai2.seq
8502 A T C T T T C T A C T C T T A C G C T G T A T A C T A C T T A A C A A G G T A T C T G C C T C C A T h36b_ai2.seq

     G A A G G C T T T C A T A G T A A A T G T T T C T C C T A C T T T A C T A A G A T A G T A C T C C T Majority
                         8660                8670                8680                8690                8700
8602 G A A G G C T T T C A T A G T A A A T G T T T C T C C T A C T T T A C T A A G A T A G T A C T C C T 2603_ai2.seq
8602 G A A G G C T T T C A T A G T A A A T G T T T C T C C T A C T T T A C T A A G A T A G T A C T C C T 18rs21_ai2.seq
8510 G A A G G C T T T C A T A G T A A A T G T T T C T C C T A C T T T A C T A A G A T A G T A C T C C T 515_ai2.seq
8499 G A A G G C T T T C A T A G T A A A T G T T T C T C C T A C T T T A C T A A G A T A G T A C T C C T cjb111_ai2.seq
8552 A A A A G C T T T C A T T G T A A A G G T C T C A C C T A C T T T A C T T A A A T C A T A T T C C G h36b_ai2.seq

     T T T G T T G C T C T G G A G T T A A T C C A T T G G T A G T A G A T C C C C A C T T A G C T T T A Majority
                         8710                8720                8730                8740                8750
8652 T T T G T T G C T C T G G A G T T A A T C C A T T G G T A G T A G A T C C C C A C T T A G C T T T A 2603_ai2.seq
8652 T T T G T T G C T C T G G A G T T A A T C C A T A G G T A G T A G A T C C C C A C T T A G C T T T A 18rs21_ai2.seq
8560 T T T G T T G C T C T G G A G T T A A T C C A T T G G T A G T A G A T C C C C A C T T A G C T T T A 515_ai2.seq
8549 T T T G T T G C T C T G G A G T T A A T C C A T T G G T A G T A G A T C C C C A C T T A G C T T T A cjb111_ai2.seq
8602 T C T T T T T T T C T G G A G T T A A T C C T A G A C T T G T C C C C C C C C A C T T A G C T T C T h36b_ai2.seq

     G G A G C T T C T G T C G G A A T C C T T T T T A T A A T C T C T T C A G C A T T A T T T G T T A A Majority
                         8760                8770                8780                8790                8800
8702 G G A G C T T C T G T C G G A A T C C T T T T T A T A A T C T C T T C A G C A T T A T T T G T T A A 2603_ai2.seq
8702 G G A G C T T C T G T C G G A A T C C T T T T T A T A A T C T C T T C A G C A T T A T T T G T T A A 18rs21_ai2.seq
8610 G G A G C T T C T G T C G G A A T C C T T T T T A T A A T C T C T T C A G C A T T A T T T G T T A A 515_ai2.seq
8599 G G A G C T T C T G T C G G A A T C C T T T T T A T A A T C T C T T C A G C A T T A T T T G T T A A cjb111_ai2.seq
8652 G G A G C T T C T T T A G G G A T C T T T T T T A T A A T A T C A G C A G C A A T A T T A G T G A A h36b_ai2.seq

     T T G T T T A T G A C T A T A A T T C T C T G T C T G A A T T G T G A A C T T A G T T T G A A G G C Majority
                         8810                8820                8830                8840                8850
8752 T T G T T T A T G A C T A T A A T T C T C T G T C T G A A T T G T G A A C T T A G T T T G A A G G C 2603_ai2.seq
8752 T T G T T T A T G A C T A T A A T T C T C T G T C T G A A T T G T G A A C T T A G T T T G A A G G C 18rs21_ai2.seq
8660 T T G T T T A T G A C T A T A A T T C T C T G T C T G A A T T G T G A A C T T A G T T T G A A G G C 515_ai2.seq
8649 T T G T T T A T G A C T A T A A T T C T C T G T C T G A A T T G T G A A C T T A G T T T G A A G G C cjb111_ai2.seq
8702 C T T T T T A T A G C T A T A A T C A T T T G T C T G A A C T G T G A A A C T A G T T T C A A G T C h36b_ai2.seq

     C A T A A T A T T T A T C A T C T T C T T T A A A T C C T T T T A C G A C A T C T A C A C T C C T A Majority
                         8860                8870                8880                8890                8900
8802 C A T A A T A T T T A T C A T C T T C T T T A A A T C C T T T T A C G A C A T C T A C A C T C C T A 2603_ai2.seq
8802 C A T A A T A T T T A T C A T C T T C T T T A A A T C C T T T T A C G A C A T C T A C A C T C C T A 18rs21_ai2.seq
8710 C A T A A T A T T T A T C A T C T T C T T T A A A T C C T T T T A C G A C A T C T A C A C T C C T A 515_ai2.seq
8699 C A T A A T A T T T A T C A T C T T C T T T A A A T C C T T T T A C G A C A T C T A C A C T C C T A cjb111_ai2.seq
8752 C A T A A T A - - - A G G A T C C T C T T T A A A A C C T T T T A T A A C T T T A A C T G T C C T T h36b_ai2.seq

     C C A T C A A A A A T A T C T G A A C C A T A G G T A A C T A A T G C A A C C C T A T T A T C A C T Majority
                         8910                8920                8930                8940                8950
8852 C C A T C A A A A A T A T C T G A A C C A T A G G T A A C T A A T G C A A C C C T A T T A T C A C T 2603_ai2.seq
8852 C C A T C A A A A A T A T C T G A A C C A T A G G T A A C T A A T G C A A C C C T A T T A T C A C T 18rs21_ai2.seq
8760 C C A T C A A A A A T A T C T G A A C C A T A G G T A A C T A A T G C A A C C C T A T T A T C A C T 515_ai2.seq
8749 C C A T C A A A A A T A T C T G A A C C A T A G G T A A C T A A T G C A A C C C T A T T A T C A C T cjb111_ai2.seq
8799 C C A T C A A A A A T A T C T G A A C C A T A A G T A A C T A A A G C T G C T C G G T T T T C A A C h36b_ai2.seq

     G T T T G C T C C T A A A A T A T C T T T T A C T G C G G T C C C A A G A G C T T C G G C A G C T T Majority
                         8960                8970                8980                8990                9000
8902 G T T T G C T C C T A A A A T A T C T T T T A C T G C G G T C C C A A G A G C T T C G G C A G C T T 2603_ai2.seq
8902 G T T T G C T C C T A A A A T A T C T T T T A C T G C G G T C C C A A G A G C T T C G G C A G C T T 18rs21_ai2.seq
8810 G T T T G C T C C T A A A A T A T C T T T T A C T G C G G T C C C A A G A G C T T C G G C A G C T T 515_ai2.seq
8799 G T T T G C T C C T A A A A T A T C T T T T A C T G C G G T C C C A A G A G C T T C G G C A G C T T cjb111_ai2.seq
8849 A T T T G C T C C T A A A A C A T C T T T T A T A A T T G T T T C T A C T G C T T C A C C T G C C T h36b_ai2.seq
```

FIGURE 19U

Alignment Report of Ai-2_alignment, using J. Hein method with Weighted residue weight table.
Thursday, July 29, 2004 6:32 PM

```
     T C T T G G C T T T A T T A T G C C T T T G A A A A T T T G G G C C A T C G T T A T T C A T T G A G Majority
                         9010                9020                9030                9040                9050
8952 T C T T G G C T T T A T T A T G C C T T T G A A A A T T T G G G C C A T C G T T A T T C A T T G A G 2603_ai2.seq
8952 T C T T G G C T T T A T T A T G C C T T T G A A A A T T T G G G C C A T C G T T A T T C A T T G A G 18rs21_ai2.seq
8860 T C T T G G C T T T A T T A T G C C T T T G A A A A T T T G G G C C A T C G T T A T T C A T T G A G 515_ai2.seq
8849 T C T T G G C T T T A T T A T G C C T T T G A A A A T T T G G G C C A T C G T T A T T C A T T G A G cjb111_ai2.seq
8899 T T T T T G C C T T G T T A T T T T T T - - - - - - - - - - - - C C A T T A T T C T T C A T A G A A h36b_ai2.seq

     T T A G A A T T A T C G A G T A C G A A G A C A A C A T C T A A C G G C T T T T G T T T G T C C A C Majority
                         9060                9070                9080                9090                9100
9002 T T A G A A T T A T C G A G T A C G A A G A C A A C A T C T A A C G G C T T T T G T T T G T C C A C 2603_ai2.seq
9002 T T A G A A T T A T C G A G T A C G A A G A C A A C A T C T A A C G G C T T T T G T T T G T C C A C 18rs21_ai2.seq
8910 T T A G A A T T A T C G A G T A C G A A G A C A A C A T C T A A C G G C T T T T G T T T G T C C A C 515_ai2.seq
8899 T T A G A A T T A T C G A G T A C G A A G A C A A C A T C T A A C G G C T T T T G T T T G T C C A C cjb111_ai2.seq
8937 T T T G A A T T A T C A A G A A C A A A A A C A A C A T C C A G A G G T T C A T C T T T A T T T A T h36b_ai2.seq

     T G G T T T T A C T A T G G T T T T T C C A C T G A C A G T T A A C T C A A T T T T A T A T T T A T Majority
                         9110                9120                9130                9140                9150
9052 T G G T T T T A C T A T G G T T T T T C C A C T G A C A G T T A A C T C A A T T T T A T A T T T A T 2603_ai2.seq
9052 T G G T T T T A C T A T G G T T T T T C C A C T G A C A G T T A A C T C A A T T T T A T A T T T A T 18rs21_ai2.seq
8960 T G G T T T T A C T A T G G T T T T T C C A C T G A C A G T T A A C T C A A T T T T A T A T T T A T 515_ai2.seq
8949 T G G T T T T A C T A T G G T T T T T C C A C T G A C A G T T A A C T C A A T T T T A T A T T T A T cjb111_ai2.seq
8987 A G T T T T T A T T A T G G A T T T A C C G C T A A C A G T T A A C T C A A T T T T A T A T T T A T h36b_ai2.seq

     T A T G A G C T A A A T C A C C T A C T T C T G A A A T A C G T T T A G A T A A T G T T C C C T C T Majority
                         9160                9170                9180                9190                9200
9102 T A T G A G C T A A A T C A C C T A C T T C T G A A A T A C G T T T A G A T A A T G T T C C C T C T 2603_ai2.seq
9102 T A T G A G C T A A A T C A C C T A C T T C T G A A A T A C G T T T A G A T A A T G T T C C C T C T 18rs21_ai2.seq
9010 T A T G A G C T A A A T C A C C T A C T T C T G A A A T A C G T T T A G A T A A T G T T C C C T C T 515_ai2.seq
8999 T A T G A G C T A A A T C A C C T A C T T C T G A A A T A C G T T T A G A T A A T G T T C C C T C T cjb111_ai2.seq
9037 T A T G A T C C A A A T C A T T T A C T T C T G A A A T A C G T T T A G A T A A T G T T C C C T C T h36b_ai2.seq

     G G A A T T T C T C T T A T A T G C T C A C C T T C A C T T G A A T A T G G G T T A A C T G C T T T Majority
                         9210                9220                9230                9240                9250
9152 G G A A T T T C T C T T A T A T G C T C A C C T T C A C T T G A A T A T G G G T T A A C T G C T T T 2603_ai2.seq
9152 G G A A T T T C T C T T A T A T G C T C A C C T T C A C T T G A A T A T G G G T T A A C T G C T T T 18rs21_ai2.seq
9060 G G A A T T T C T C T T A T A T G C T C A C C T T C A C T T G A A T A T G G G T T A A C T G C T T T 515_ai2.seq
9049 G G A A T T T C T C T T A T A T G C T C A C C T T C A C T T G A A T A T G G G T T A A C T G C T T T cjb111_ai2.seq
9087 T G A A T T T C T C T T A T G T G C T C A C C T T C A C T T G A A T A T G G A T T A A C T G C T T T h36b_ai2.seq

     T G C C T C T G A C T T T C C A T T T G G A A C T G A A C C T T T A A C A T G C T C A A G T T T A T Majority
                         9260                9270                9280                9290                9300
9202 T G C C T C T G A C T T T C C A T T T G G A A C T G A A C C T T T A A C A T G C T C A A G T T T A T 2603_ai2.seq
9202 T G C C T C T G A C T T T C C A T T T G G A A C T G A A C C T T T A A C A T G C T C A A G T T T A T 18rs21_ai2.seq
9110 T G C C T C T G A C T T T C C A T T T G G A A C T G A A C C T T T A A C A T G C T C A A G T T T A T 515_ai2.seq
9099 T G C C T C T G A C T T T C C A T T T G G A A C T G A A C C T T T A A C A T G C T C A A G T T T A T cjb111_ai2.seq
9137 T G C C T C T A A T T T C C C A T T T G G A A T T G A A T T T T T A A C A T G C T C A A G A T T A T h36b_ai2.seq

     A A G A T T C C T T T G T A T C T T C A T A A A T T C C T G T G G G G G G A T A C T G C T T A T C T Majority
                         9310                9320                9330                9340                9350
9252 A A G A T T C C T T T G T A T C T T C A T A A A T T C C T G T G G G G G G A T A C T G C T T A T C T 2603_ai2.seq
9252 A A G A T T C C T T T G T A T C T T C A T A A A T T C C T G T G G G G G G A T A C T G C T T A T C T 18rs21_ai2.seq
9160 A A G A T T C C T T T G T A T C T T C A T A A A T T C C T G T G G G G G G A T A C T G C T T A T C T 515_ai2.seq
9149 A A G A T T C C T T T G T A T C T T C A T A A A T T C C T G T G G G G G G A T A C T G C T T A T C T cjb111_ai2.seq
9187 A A G A T T C T T T T G T A T C T T C A T A A G C T C C T G T A A G G G G A T A C T G C T T A T C T h36b_ai2.seq

     A G T T C T T C C T G A T T T T G T C C A A T T G T G G A A T T T T T A T C A C C A C T A T T T T G Majority
                         9360                9370                9380                9390                9400
9302 A G T T C T T C C T G A T T T T G T C C A A T T G T G G A A T T T T T A T C A C C A C T A T T T T G 2603_ai2.seq
9302 A G T T C T T C C T G A T T T T G T C C A A T T G T G G A A T T T T T A T C A C C A C T A T T T T G 18rs21_ai2.seq
9210 A G T T C T T C C T G A T T T T G T C C A A T T G T G G A A T T T T T A T C A C C A C T A T T T T G 515_ai2.seq
9199 A G T T C T T C C T G A T T T T G T C C A A T T G T G G A A T T T T T A T C A C C A C T A T T T T G cjb111_ai2.seq
9237 A G T T C C T C T T G C C T T T G T T C A A T T A T A G A T T T T T T A T C A T C A C T A T T T T G h36b_ai2.seq

     T A T C G T A G T T T T T C C A T T A C T C T C A A C C T T A A C T T G C C A A G T C T G G T T A G Majority
                         9410                9420                9430                9440                9450
9352 T A T C G T A G T T T T T C C A T T A C T C T C A A C C T T A A C T T G C C A A G T C T G G T T A G 2603_ai2.seq
9352 T A T C G T A G T T T T T C C A T T A C T C T C A A C C T T A A C T T G C C A A G T C T G G T T A G 18rs21_ai2.seq
9260 T A T C G T A G T T T T T C C A T T A C T C T C A A C C T T A A C T T G C C A A G T C T G G T T A G 515_ai2.seq
9249 T A T C G T A G T T T T T C C A T T A C T C T C A A C C T T A A C T T G C C A A G T C T G G T T A G cjb111_ai2.seq
9287 T A T C G T A G T T T T T C C A T T A C T C T C A A C C T T A A C T T G C C A A G T C T G G G T A G h36b_ai2.seq
```

FIGURE 19V

Alignment Report of Ai-2_alignment, using J. Hein method with Weighted residue weight table.
Thursday, July 29, 2004 6:32 PM

```
     TCTTTTTATAACCTTCGGGCGCTGTTTCTTCTGATAAAGTATAATCTCCA Majority
               9460      9470      9480      9490      9500
9402 TCTTTTTATAACCTTCGGGCGCTGTTTCTTCTGATAAAGTATAATCTCCA 2603_ai2.seq
9402 TCTTTTTATAACCTTCGGGCGCTGTTTCTTCTGATAAAGTATAATCTCCA 18rs21_ai2.seq
9310 TCTTTTTATAACCTTCGGGCGCTGTTTCTTCTGATAAAGTATAATCTCCA 515_ai2.seq
9299 TCTTTTTATAACCTTCGGGCGCTGTTTCTTCTGATAAAGTATAATCTCCA cjb111_ai2.seq
9337 TCTTTTTGTATCCTTCGGGTGCCGTTTCTTCTGATAAAGTGTAATCTCCA h36b_ai2.seq

     GGTATGAGATTATCAAAAGTAGCTTCACCTGTTAGCTCAGCAGTTACTTT Majority
               9510      9520      9530      9540      9550
9452 GGTATGAGATTATCAAAAGTAGCTTCACCTGTTAGCTCAGCAGTTACTTT 2603_ai2.seq
9452 GGTATGAGATTATCAAAAGTAGCTTCACCTGTTAGCTCAGCAGTTACTTT 18rs21_ai2.seq
9360 GGTATGAGATTATCAAAAGTAGCTTCACCTGTTAGCTCAGCAGTTACTTT 515_ai2.seq
9349 GGTATGAGATTATCAAAAGTAGCTTCACCTGTTAGCTCAGCAGTTACTTT cjb111_ai2.seq
9387 GGTGTGAGATTATCAAAAGTAGCTTCACCTGTTACCTCAGTAGTTACTTT h36b_ai2.seq

     TTCTATTTTACTTTCTGGATGAGCAGTAGTTTTTAAAACAAAGGTAGCTT Majority
               9560      9570      9580      9590      9600
9502 TTCTATTTTACTTTCTGGATGAGCAGTAGTTTTTAAAACAAAGGTAGCTT 2603_ai2.seq
9502 TTCTATTTTACTTTCTGGATGAGCAGTAGTTTTTAAAACAAAGGTAGCTT 18rs21_ai2.seq
9410 TTCTATTTTACTTTCTGGATGAGCAGTAGTTTTTAAAACAAAGGTAGCTT 515_ai2.seq
9399 TTCTATTTTACTTTCTGGATGAGCAGTAGTTTTTAAAACAAAGGTAGCTT cjb111_ai2.seq
9437 TTCTACTTTGCTTTCTGAGTGTGAAGTAGGTTTTAAAACAAAGGTAGCTT h36b_ai2.seq

     TTGAAAGTGGTTTGTTCTGGTCATCTGTCTTTTTAACAACTAACTTTCCT Majority
               9610      9620      9630      9640      9650
9552 TTGAAAGTGGTTTGTTCTGGTCATCTGTCTTTTTAACAACTAACTTTCCT 2603_ai2.seq
9552 TTGAAAGTGGTTTGTTCTGGTCATCTGTCTTTTTAACAACTAACTTTCCT 18rs21_ai2.seq
9460 TTGAAAGTGGTTTGTTCTGGTCATCTGTCTTTTTAACAACTAACTTTCCT 515_ai2.seq
9449 TTGAAAGTGGTTTGTTCTGGTCATCTGTCTTTTTAACAACTAACTTTCCT cjb111_ai2.seq
9487 TTGAAAGTGGTTTGTTCTGGTCATCTGTCTTTTTAACAACTAACTTTCCT h36b_ai2.seq

     TTAGCACCATTTTCCGGTACGGTACTTTCCCCTAAAACATTGGTATTAAG Majority
               9660      9670      9680      9690      9700
9602 TTAGCACCATTTTCCGGTACGGTACTTTCCCCTAAAACATTGGTATTAAG 2603_ai2.seq
9602 TTAGCACCATTTTCCGGTACGGTACTTTCCCCTAAAACATTGGTATTAAG 18rs21_ai2.seq
9510 TTAGCACCATTTTCCGGTACGGTACTTTCCCCTAAAACATTGGTATTAAG 515_ai2.seq
9499 TTAGCACCATTTTCCGGTACGGTACTTTCCCCTAAAACATTGGTATTAAG cjb111_ai2.seq
9537 TTAGCACCATTTTCCGGTACGGTACTTTCCCCTAAAACATTGGTATTAAG h36b_ai2.seq

     CGGTATTTGCGACAAACAAAAAAGACTTAACGTCAATATTTTAGAAAATT Majority
               9710      9720      9730      9740      9750
9652 CGGTATTTGCGACAAACAAAAAAGACTTAACGTCAATATTTTAGAAAATT 2603_ai2.seq
9652 CGGTATTTGCGACAAACAAAAAAGACTTAACGTCAATATTTTAGAAAATT 18rs21_ai2.seq
9560 CGGTATTTGCGACAAACAAAAAAGACTTAACGTCAATATTTTAGAAAATT 515_ai2.seq
9549 CGGTATTTGCGACAAACAAAAAAGACTTAACGTCAATATTTTAGAAAATT cjb111_ai2.seq
9587 CGGTATTTGCGACAAACAAAAAAGACTTAACGTCAATATTTTAGAAAATT h36b_ai2.seq

     TTTGGTATTTTCTCATTTTACAACTCCTATTGTGCCGAAATGTCGTTTCT Majority
               9760      9770      9780      9790      9800
9702 TTTGGTATTTTCTCATTTTACAACTCCTATTGTGCCGAAATGTCGTTTCT 2603_ai2.seq
9702 TTTGGTATTTTCTCATTTTACAACTCCTATTGTGCCGAAATGTCGTTTCT 18rs21_ai2.seq
9610 TTTGGTATTTTCTCATTTTACAACTCCTATTGTGCCGAAATGTCGTTTCT 515_ai2.seq
9599 TTTGGTATTTTCTCATTTTACAACTCCTATTGTGCCGAAATGTCGTTTCT cjb111_ai2.seq
9637 TTTGGTATTTTCTCATTTTACAACTCCTATTGTGCCGAAATGTCGTTTCT h36b_ai2.seq

     AAATCTAAGATCAGATACAGAATATCCTAGAATATACAAACTATCACTTA Majority
               9810      9820      9830      9840      9850
9752 AAATCTAAGATCAGATACAGAATATCCTAGAATATACAAACTATCACTTA 2603_ai2.seq
9752 AAATCTAAGATCAGATACAGAATATCCTAGAATATACAAACTATCACTTA 18rs21_ai2.seq
9660 AAATCTAAGATCAGATACAGAATATCCTAGAATATAAAAACTATCACTTA 515_ai2.seq
9649 AAATCTAAGATCAGATACAGAATATCCTAGAATATACAAACTATCACTTA cjb111_ai2.seq
9687 AAATCTAAGATCAGATACAGAATATCCTAGAATATACAAACTATCACTTA h36b_ai2.seq

     TTATGATATCAATAATTTCTTATTATAAGGTATGGAATTTTAATGTTTTT Majority
               9860      9870      9880      9890      9900
9802 TTATGATATCAATAATTTCTTATTATAAGGTATGGAATTTTAATGTTTTT 2603_ai2.seq
9802 TTATGATATCAATAATTTCTTATTATAAGGTATGGAATTTTAATGTTTTT 18rs21_ai2.seq
9710 TTATGATATCAATAATTTCTTATTATAAGGTATGGAATTTTAAAGTTTTT 515_ai2.seq
9699 TTATGATATCAATAATTTCTTATTATAAGGTATGGAATTTTAATGTTTTT cjb111_ai2.seq
9737 TTATGATATCAATAATTTCTTATTATAAGGTATGGAATTTTAAAGTTTTT h36b_ai2.seq
```

FIGURE 19W

Alignment Report of Ai-2_alignment, using J. Hein method with Weighted residue weight table.
Thursday, July 29, 2004 6:32 PM

```
      TCCCAATTTTTGAATAATTTTTCTTTTTATTTGATAATCTTATTTTTTAT Majority
                     9910      9920      9930      9940      9950
9852  TCCCAATTTTTGAATAATTTTTCTTTTTATTTGATAATCTTATTTTTTAT 2603_ai2.seq
9852  TCCCAATTTTTGAATAATTTTTCTTTTTATTTGATAATCTTATTTTTTAT 18rs21_ai2.seq
9760  TCCCAATTTTTGAATGATTTTTCTTTTTATTTGATA--CATTATTGTCTC 515_ai2.seq
9749  TCCCAATTTTTGAATAATTTTTCTTTTTATTTGATAATCTTATTTTTTAT cjb111_ai2.seq
9787  TCCCAATTTTTGAATGATTTTTCTTTTTATTTGATAATCTTATTTTTTAT h36b_ai2.seq

      TATCTTAGAAATATTTCAATGAGCTTAAGTAGTTGATTTTTCTTTTTTTA Majority
                     9960      9970      9980      9990     10000
9902  TATCTTAGAAATATTTCAATGAGCTTAAGTAGTTGATTTTTCTTTTTTTA 2603_ai2.seq
9902  TATCTTAGAAATATTTCAATGAGCTTAAGTAGTTGATTTTTCTTTTTTTA 18rs21_ai2.seq
9808  TATCATGGAAACGTATTAATTA--TAATGTAGTTGTCCCTTACTCACCCC 515_ai2.seq
9799  TATCTTAGAAATATTTCAATGAGCTTAAGTAGTTGATTTTTCTTTTTTTA cjb111_ai2.seq
9837  TATCTTAGAAATACTTCAAT-AGCTTAAGTAGTTGATTTTTCTTTTTTTA h36b_ai2.seq

      TGTTTTAAAATATTGCTTAAAAATAATGTTTGAGAGAG--TTTACTGAAT Majority
                    10010     10020     10030     10040     10050
9952  TGTTTTAAAATATTGCTTAAAAATAATGTTTGAGAGAG--TTTACTGAAT 2603_ai2.seq
9952  TGTTTTAAAATATTGCTTAAAAATAATGTTTGAGAGAG--TTTACTGAAT 18rs21_ai2.seq
9856  T-TTTCATTGAACTACAAAATATATTTATCTATGATAC--ATTACAATAT 515_ai2.seq
9849  TGTTTTAAAATATTGCTTAAAAATAATGTTTGAGAGAG--TTTACTGAAT cjb111_ai2.seq
9887  TGTTTTAAAATATTGCTTAAAAATAATGTTTGAGAGAGAGTTTACTGAAT h36b_ai2.seq

      TGATTGAAAATTATTTAGAAAAAGACATCCTTAATCAAATAAAACTTCTA Majority
                    10060     10070     10080     10090     10100
10000 TGATTGAAAATTATTTAGAAAAAGACATCCTTAATCAAATAAAACTTCTA 2603_ai2.seq
10000 TGATTGAAAATTATTTAGAAAAAGACATCCTTAATCAAATAAAACTTCTA 18rs21_ai2.seq
9903  TGTGTCAAAAATGTTATTATAGATTCGTTTAAAATTAATTTAAAAAAGAC 515_ai2.seq
9897  TGATTGAAAATTATTTAGAAAAAGACATCCTTAATCAAATAAAACTTCTA cjb111_ai2.seq
9937  TGATTGAAAATTATTTAGAAAAAGACATCCTTAATCAAATAAAACTTCTA h36b_ai2.seq

      ACTTTATGCTATGATTACTACCCTTCCATTACTCTAGACAAATCATGTCA Majority
                    10110     10120     10130     10140     10150
10050 ACTTTATGCTATGATTACTACCCTTCCATTACTCTAGACAAATCATGTCA 2603_ai2.seq
10050 ACTTTATGCTATGATTACTACCCTTCCATTACTCTAGACAAATCATGTCA 18rs21_ai2.seq
9953  GATATAGACTATATTTTTCTTGCTTACCTTACTTCCCATAACTCTTTTTC 515_ai2.seq
9947  ACTTTATGCTATGATTACTACCCTTCCATTACTCTAGACAAATCATGTCA cjb111_ai2.seq
9987  ACTTTATGCTATGATTACTACCCTTCCATTACTCTAGACAAATCATGTCA h36b_ai2.seq

      TCAACTTGGTTTATCTGAACTACTTATTAGGAA-ATATTGTCATGATTTA Majority
                    10160     10170     10180     10190     10200
10100 TCAACTTGGTTTATCTGAACTACTTATTAGGAA-ATATTGTCATGATTTA 2603_ai2.seq
10100 TCAACTTGGTTTATCTGAACTACTTATTAGGAA-ATATTGTCATGATTTA 18rs21_ai2.seq
10003 TAATCCAAATTGGACTGAGAAGCGTATCCATAATGTAATAGCTATTTTCG 515_ai2.seq
9997  TCAACTTGGTTTATCTGAACTACTTATTAGGAA-ATATTGTCATGATTTA cjb111_ai2.seq
10037 TCAACTTGGTTTATCTGAACTACTTATTAGGAA-ATATTGTCATGATTTA h36b_ai2.seq

      ACAACTTTATTTAACAGTCAACTCTCTCTGAATATCGAAAAGAGTACAAT Majority
                    10210     10220     10230     10240     10250
10149 ACAACTTTATTTAACAGTCAACTCTCTCTGAATATCGAAAAGAGTACAAT 2603_ai2.seq
10149 ACAACTTTATTTAACAGTCAACTCTCTCTGAATATCGAAAAGAGTACAAT 18rs21_ai2.seq
10053 AAAATTATCCCAAATTCCAAAAATTATTACAGCCACTCAAAGATGCCCTT 515_ai2.seq
10046 ACAACTTTATTTAACAGTCAACTCTCTCTGAATATCGAAAAGAGTACAAT cjb111_ai2.seq
10086 ACAACTTTATTTAACAGTCAACTCTCTCTGAATATCGAAAAGAGTACAAT h36b_ai2.seq

      AGTCTACCAATCTAATGGTGTAACTAGAGAACAAGCTTTCAAATATATTT Majority
                    10260     10270     10280     10290     10300
10199 AGTCTACCAATCTAATGGTGTAACTAGAGAACAAGCTTTCAAATATATTT 2603_ai2.seq
10199 AGTCTACCAATCTAATGGTGTAACTAGAGAACAAGCTTTCAAATATATTT 18rs21_ai2.seq
10103 CCCTTATCTGACTCCTATCATGACGAGTTGGTAAAAGTTGCTAT-CATTT 515_ai2.seq
10096 AGTCTACCAATCTAATGGTGTAACTAGAGAACAAGCTTTCAAATATATTT cjb111_ai2.seq
10136 AGTCTACCAATCTAATGGTGTAACTAGAGAACAAGCTTTCAAATATATTT h36b_ai2.seq

      ATCATCAATCACACGTTTTACAACTTTTAAAATTTTTGATCACGAATGAT Majority
                    10310     10320     10330     10340     10350
10249 ATCATCAATCACACGTTTTACAACTTTTAAAATTTTTGATCACGAATGAT 2603_ai2.seq
10249 ATCATCAATCACACGTTTTACAACTTTTAAAATTTTTGATCACGAATGAT 18rs21_ai2.seq
10152 TTTCCCGAACATTTATTTTAGGA---TTAAATCAATTAATCCC---TGAA 515_ai2.seq
10146 ATCATCAATCACACGTTTTACAACTTTTAAAATTTTTGATCACGAATGAT cjb111_ai2.seq
10186 ATCATCAATCACACGTTTTACAACTTTTAAAATTTTTGATCACGAATGAT h36b_ai2.seq
```

FIGURE 19X

Alignment Report of Ai-2_alignment, using J. Hein method with Weighted residue weight table.
Thursday, July 29, 2004 6:32 PM

```
      T C A G G C A G G T T A C C T T T A A C T T A C T T T A G T G A A A A A T T T G G A C T A T C T T G Majority
                          10360               10370               10380               10390               10400
10299 T C A G G C A G G T T A C C T T T A A C T T A C T T T A G T G A A A A A T T T G G A C T A T C T T G 2603_ai2.seq
10299 T C A G G C A G G T T A C C T T T A A C T T A C T T T A G T G A A A A A T T T G G A C T A T C T T G 18rs21_ai2.seq
10196 A C A A T T T C A T T T C C T T C A T G G A A C T A T C A T A G A C A T G A T A A A T T A A C T A C 515_ai2.seq
10196 T C A G G C A G G T T A C C T T T A A C T T A C T T T A G T G A A A A A T T T G G A C T A T C T T G cjb111_ai2.seq
10236 T C A G G C A G G T T A C C T T T A A C T T A C T T T A G T G A A A A A T T T G G A C T A T C T T G h36b_ai2.seq

      T G C A A C T G C T T A T C G C A T A C G A A A A C A T A T T A G T C C A T T A C T A G A A A A A C Majority
                          10410               10420               10430               10440               10450
10349 T G C A A C T G C T T A T C G C A T A C G A A A A C A T A T T A G T C C A T T A C T A G A A A A A C 2603_ai2.seq
10349 T G C A A C T G C T T A T C G C A T A T G A A A A C A T A T T A G T C C A T T A C T A G A A A A A C 18rs21_ai2.seq
10246 T A T - - - - - T C T C C G A C C G A T A A T T A C A A A T T G G T T A A G T G A A A T T G G A G A 515_ai2.seq
10246 T G C A A C T G C T T A T C G C A T A C G A A A A C A T A T T A G T C C A T T A C T A G A A A A A C cjb111_ai2.seq
10286 T G C A A C T G C T T A T C G C A T A C G A A A A C A T A T T A G T C C G T T A C T A G A A A A A C h36b_ai2.seq

      T T G G A T T T C A G A T T G T C A A A A A T A C T A T T A C C G G T G - A C G A G T A T C G A A T Majority
                          10460               10470               10480               10490               10500
10399 T T G G A T T T C A G A T T G T C A A A A A T A C T A T T A C C G G T G - A C G A G T A T C G A A T 2603_ai2.seq
10399 T T G G A T T T C A G A T T G T C A A A A A T A C T A T T A C C G G T G - A C G A G T A T C G A A T 18rs21_ai2.seq
10291 A T A C A C G T T T A A G G A A C A A C A T T T T C T T C T C C T T T G T G C T C A C C T A G A A A 515_ai2.seq
10296 T T G G A T T T C A G A T T G T C A A A A A T A C T A T T A C C G G T G - A C G A G T A T C G A A T cjb111_ai2.seq
10336 T T G G A T T T C A G A T T G T C A A A A A T A C T A T T A C C G G T G - A C G A G T A T C G A A T h36b_ai2.seq

      T C G C T A T T T A A T C G C A T T T T T A A A T G C T C A A T T T G G T A T A G A A G T T T A T C Majority
                          10510               10520               10530               10540               10550
10448 T C G C T A T T T A A T C G C A T T T T T A A A T G C T C A A T T T G G T A T A G A A G T T T A T C 2603_ai2.seq
10448 T C G C T A T T T A A T C G C A T T T T T A A A T G C T C A A T T T G G T A T A G A A G T T T A T C 18rs21_ai2.seq
10341 G A A T T A T C A A A A A T C A T A T T C C T C C G A T A C A A A T A G - - C C G T A C T A A C T A 515_ai2.seq
10345 T C G C T A T T T A A T C G C A T T T T T A A A T G C T C A A T T T G G T A T A G A A G T T T A T C cjb111_ai2.seq
10385 T C G C T A T T T A A T C G C A C A T T T A A A T G C T C G A T T T G G T A T A G A A G T T T A T C h36b_ai2.seq

      C C A T G T C T A A G A T G G A T A A A T T G C T C A T C A A A C G A T T G T T A T T A G A A C A C Majority
                          10560               10570               10580               10590               10600
10498 C C A T G T C T A A G A T G G A T A A A T T G C T C A T C A A A C G A T T G T T A T T A G A A C A C 2603_ai2.seq
10498 C C A T G T C T A A G A T G G A T A A A T T G C T C A T C A A A C G A T T G T T A T T A G A A C A C 18rs21_ai2.seq
10389 C A G A C T T T A T T A A T A A C A A A A T T T T A A C A G A A T G T T T A T C A C A G A G G T T T 515_ai2.seq
10395 C C A T G T C T A A G A T G G A T A A A T T G C T C A T C A A A C G A T T G T T A T T A G A A C A C cjb111_ai2.seq
10435 C C T T A T C T A A G A T G G A T A A A T T G C T T A T C A A A C G A T T G T T A T T A G A A T A C h36b_ai2.seq

      T C A A C T A C T T T T A C T G C T T C T C A T T A C T T C C - C A A A T A C A T T T A T T T T C T Majority
                          10610               10620               10630               10640               10650
10548 T C A A C T A C T T T T A C T G C T T C T C A T T A C T T C C - C A A A T A C A T T T A T T T T C T 2603_ai2.seq
10548 T C A A C T A C T T T T A C T G C T T C T C A T T A C T T C C - C A A A T A C A T T G A T T T T C T 18rs21_ai2.seq
10439 T C T T C T A A A C A G A T T C A T T T C C A C C C T T A C T A T T T A T T A A C T G A T G A T C T 515_ai2.seq
10445 T C A A C T A C T T T T A C T G C T T C T C A T T A C T T C C - C A A A T A C A T T T A T T T T C T cjb111_ai2.seq
10485 T C A A C T A C T T T T A C T G C T T C T C A T T A C T T C C - C M A A T A C A T T T A T T T T C T h36b_ai2.seq

      T T G A T A C A T T G T T G T C T C T A T C A T G G A A A C G T A T T A A T T A T A A T G T A G T T Majority
                          10660               10670               10680               10690               10700
10597 T T G A T A C A T T G T T G T C T C T A T C A T G G A A A C G T A T T A A T T A T A A T G T A G T T 2603_ai2.seq
10597 T T G A T A C A T T G T T G T C T C T A T C A T G G A A A C G T A T T A A T T A T A A T G T A G T T 18rs21_ai2.seq
10489 T T C C A A T A T T A C T A A T C T T A A T C C A G A T A T - T A T T A T T A C C A A C C C A A A G 515_ai2.seq
10494 T T G A T A C A T T G T T G T C T C T A T C A T G G A A A C G T A T T A A T T A T A A T G T A G T T cjb111_ai2.seq
10534 T T G A T A C A T T A T T G T C T C T A T C A T G G A A A C G T A T T A A T T A T A A T G T A G T T h36b_ai2.seq

      G T C C C T T A C T - - - C A T C C C T T T T C A C T G A A C T A C A A A A T A T A T T T A T C T A Majority
                          10710               10720               10730               10740               10750
10647 G T C C C T T A C T - - - C A T C C C T T T T C A C T G A A C T A C A A A A T A T A T T T A T C T A 2603_ai2.seq
10647 G T C C C T T A C T - - - C A T C C C T T T T C A C T G A A C T A C A A A A T A T A T T T A T C T A 18rs21_ai2.seq
10538 C T T T C T T C C T T T A T A A A A C A T G A G A T T T C T T C A G A G A G T T T A A T T A C A T A 515_ai2.seq
10544 G T C C C T T A C T - - - C A T C C C T T T T C A C T G A A C T A C A A A A T A T A T T T A T C T A cjb111_ai2.seq
10584 G T C C C T T A C T - - - C A C C C C T T T T C A T T G A A C T A C A A A A T A T A T T T A T C T A h36b_ai2.seq

      T G A T A C A T T A C A A T A T T G T G T C A A A A A T G T T A T T A T A G A T T C C T T T A A A A Majority
                          10760               10770               10780               10790               10800
10694 T G A T A C A T T A C A A T A T T G T G T C A A A A A T G T T A T T A T A G A T T C C T T T A A A A 2603_ai2.seq
10694 T G A T A C A T T A C A A T A T T G T G T C A A A A A T G T T A T T A T A G A T T C C T T T A A A A 18rs21_ai2.seq
10588 T A T T G A T T T G A T T C A T A C T C C A G A C C A G A T C A A T C A A A T C C A A G A A A T T A 515_ai2.seq
10591 T G A T A C A T T A C A A T A T T G T G T C A A A A A T G T T A T T A T A G A T T C C T T T A A A A cjb111_ai2.seq
10631 T G A T A C A T T A C A A T A T T G T G T C A A A A A T G T T A T T A T A G A T T C C T T T A A A A h36b_ai2.seq
```

FIGURE 19Y

Alignment Report of Ai-2_alignment, using J. Hein method with Weighted residue weight table.
Thursday, July 29, 2004 6:32 PM

```
      T T A A T T T A A A A A A A G A C G A T A T A G A C T A T A T T T T T C T T G C - - - - - - - - - T Majority
                          10810               10820               10830               10840               10850
10744 T T A A T T T A A A A A A A G A C G A T A T A G A C T A T A T T T T T C T T G C - - - - - - - - - T 2603_ai2.seq
10744 T T A A T T T A A A A A A A G A C G A T A T A G A C T A T A T T T T T C T T G C - - - - - - - - - T 18rs21_ai2.seq
10638 T T T C A T C A A T A C A A G A A G A A A A A T A T T G T A A A C T T T T T G C A A A G A A C A A T 515_ai2.seq
10641 T T A A T T T A A A A A A A G A C G A T A T A G A C T A T A T T T T T C T T G C - - - - - - - - - T cjb111_ai2.seq
10681 T T A A T T T A A A A A A A G A C G A T A T A G A C T A T A T T T T T C T T G C - - - - - - - - - T h36b_ai2.seq

      T A C C T T A C T T C C C A T A A C T C T T T T T C T A A T C C A A A T T G G A C - - T G A G A A G Majority
                          10860               10870               10880               10890               10900
10785 T A C C T T A C T T C C C A T A A C T C T T T T T C T A A T C C A A A T T G G A C - - T G A G A A G 2603_ai2.seq
10785 T A C C T T A C T T C C C A T A A C T C T T T T T C T A A T C C A A A T T G G A C - - T G A G A A G 18rs21_ai2.seq
10688 G A A A T A A C T A C C C G T A G C T C C T A T A A C T C T T A A A A A T T A A C A T T A A A A A G 515_ai2.seq
10682 T A C C T T A C T T C C C A T A A C T C T T T T T C T A A T C C A A A T T G G A C - - T G A G A A G cjb111_ai2.seq
10722 T A C C T T A C T T C C C A T A A C T C T T T T T C T A A T C C A A A T T G G A C - - T G A G A A G h36b_ai2.seq

      C G T A T C G A T A A T G T A A T A - G C T A T T T T C G A A A A T T A T C C C A A A T T C C A A A Majority
                          10910               10920               10930               10940               10950
10833 C G T A T C G A T A A T G T A A T A - G C T A T T T T C G A A A A T T A T C C C A A A T T C C A A A 2603_ai2.seq
10833 C G T A T C G A T A A T G T A A T A - G C T A T T T T C G A A A A T T A T C C C A A A T T C C A A A 18rs21_ai2.seq
10738 C T A G A G C A T T A C A C A A T G C T C T A G C T T T T T A A T G T T A A T T T T T T T G A A T A 515_ai2.seq
10730 C G T A T C G A T A A T G T A A T A - G C T A T T T T C G A A A A T T A T C C C A A A T T C C A A A cjb111_ai2.seq
10770 C G T A T C G A T A A T G T A A T A - G C T A T T T T C G A A A A T T A T C C C A A A T T C C A A A h36b_ai2.seq

      A A T T A T T A C A G C C A C T C A A A G A T G C T C T T C C - - C T T A T C T G G C T C C T A T C Majority
                          10960               10970               10980               10990               11000
10882 A A T T A T T A C A G C C A C T C A A A G A T G C T C T T C C - - C T T A T C T G G C T C C T A T C 2603_ai2.seq
10882 A A T T A T T A C A G C C A C T C A A A G A T G C T C T T C C - - C T T A T C T G G C T C C T A T C 18rs21_ai2.seq
10788 A T A T A A T C C A A C T T T T C A A C T G T T T T T T C C C A G G T G A A A T G T T C T T T A A T 515_ai2.seq
10779 A A T T A T T A C A G C C A C T C A A A G A T G C T C T T C C - - C T T A T C T G G C T C C T A T C cjb111_ai2.seq
10819 A A T T A T T A C A G C C A C T C A A A G A T G C T C T T C C - - C T T A T C T G G C T C C T A T C h36b_ai2.seq

      A T G A T G A G T T G G T A A A A G T T G C T A T C T T T T T T T T C C G A A C A T T T A T T T T A Majority
                          11010               11020               11030               11040               11050
10930 A T G A T G A G T T G G T A A A A G T T G C T A T C T T T T T T T - C C G A A C A T T T A T T T T A 2603_ai2.seq
10930 A T G A T G A G T T G G T A A A A G T T G C T A T C T T T T T T T T C C G A A C A T T T A T T T T A 18rs21_ai2.seq
10838 T C T T T T A G C A A T A T T C T G T T G T A G T T T C T C T C T T A A T G C C T T A T C T T T T A 515_ai2.seq
10827 A T G A T G A G T T G G T A A A A G T T G C T A T C T T T T T T T T C C G A A C A T T T A T T T T A cjb111_ai2.seq
10867 A T G A T G A G T T G G T A A A A G T T G C T A T C T T T T T T T T C C G A A C A T T T A T T T T A h36b_ai2.seq

      G G A T T A A A T C A A T T A A T C C C T G A A A C A A T T - - T C A T T T C C T T C A T G G A A C Majority
                          11060               11070               11080               11090               11100
10979 G G A T T A A A T C A A T T A A T C C C T G A A A C A A T T - - T C A T T T C C T T C A T G G A A C 2603_ai2.seq
10980 G G A T T A A A T C A A T T A A T C C C T G A A A C A A T T - - T C A T T T C C T T C A T G G A A C 18rs21_ai2.seq
10888 C T A A T A A A T C A A G A G A T T C A T G G A G T G A C T G A G T A T T T T C T T C C A T G A T G 515_ai2.seq
10877 G G A T T A A A T C A A T T A A T C C C T G A A A C A A T T - - T C A T T T C C T T C A T G G A A C cjb111_ai2.seq
10917 G G A T T A A A T C A A T T A A T C C C T G A A A C A A T T - - T C A T T T C C T T C A T G G A A C h36b_ai2.seq

      T A T C A T A G A C A T G A T A A A T T A A C T A C T A T T C T C C G A C C G A T A A T T A C A A A Majority
                          11110               11120               11130               11140               11150
11027 T A T C A T A G A C A T G A T A A A T T A A C T A C T A T T C T C C G A C C G A T A A T T A C A A A 2603_ai2.seq
11028 T A T C A T A G A C A T G A T A A A T T A A C T A C T A T T C T C C G A C C G A T A A T T A C A A A 18rs21_ai2.seq
10938 A T T C C T A A C T C A G G G C T A T C G A T A A C T - T C A A C T G T T C C A C C G C G A T C T G 515_ai2.seq
10925 T A T C A T A G A C A T G A T A A A T T A A C T A C T A T T C T C C G A C C G A T A A T T A C A A A cjb111_ai2.seq
10965 T A T C A T A G A C A T G A T A A A T T A A C T A C T A T T C T C C G A C C G A T A A T T A C A A A h36b_ai2.seq

      T T G G T T A A G T A A A A T T G G A G A A T A - - - C A C G T T T A A A G A A C A A C A T T T T C Majority
                          11160               11170               11180               11190               11200
11077 T T G G T T A A G T A A A A T T G G A G A A T A - - - C A C G T T T A A A G A A C A A C A T T T T C 2603_ai2.seq
11078 T T G G T T A A G T A A A A T T G G A G A A T G - - - C A C G T T T A A A G A A C A A C A T T T T C 18rs21_ai2.seq
10987 T T G C A A T A A T A G C A C T T G A A A G T A G A C C A G C T T C T A A A A T A G A G G T T G G T 515_ai2.seq
10975 T T G G T T A A G T A A A A T T G G A G A A T A - - - C A C G T T T A A A G A A C A A C A T T T T C cjb111_ai2.seq
11015 C T G G T T A A G T G A A A T T G G A G A A T A - - - C A C A T T T A A A G A A C A A C A T T T T C h36b_ai2.seq

      T T C T C C T T T G T A C T C A T C T A G A A A G A A T C A T C A A A A A T C A T A T T C C T C C G Majority
                          11210               11220               11230               11240               11250
11124 T T C T C C T T T G T A C T C A T C T A G A A A G A A T C A T C A A A A A T C A T A T T C C T C C G 2603_ai2.seq
11125 T T C T C C T T T G T A C T C A T C T A G A A A G A A T C A T C A A A A A T C A T A T T C C T C C G 18rs21_ai2.seq
11037 A A T C C C T C T G G A T A C A T T G A T G G C T A A A C A - A A G A T A T C A G T C T G T G C C A 515_ai2.seq
11022 T T C T C C T T T G T A C T C A T C T A G A A A G A A T C A T C A A A A A T C A T A T T C C T C C G cjb111_ai2.seq
11062 T T C T C C T T T G T A C T C A T C T A G A A A G A A T C A T C A A A A A T C A T A T T C C T C C G h36b_ai2.seq
```

FIGURE 19Z

Alignment Report of Ai-2_alignment, using J. Hein method with Weighted residue weight table.
Thursday, July 29, 2004 6:32 PM

```
      ATACAGA--TAGCCGTACTAACTACAGACTTTATTAATAACCAAATTTTA Majority
                   11260     11270     11280     11290     11300
11174 ATACAGA--TAGCCGTACTAACTACAGACTTTATTAATAACCAAATTTTA 2603_ai2.seq
11175 ATACAGA--TAGCCGTACTAACTACAGACTTTATTAATAACCAAATTTTA 18rs21_ai2.seq
11086 TTAAAGACATAGTCTGTTCAAAGTTTAATTTCCCCAAAAAGTTAATCTGT 515_ai2.seq
11072 ATACAGA--TAGCCGTACTAACTACAGACTTTATTAATAACCAAATTTTA cjb111_ai2.seq
11112 ATACAGA--TAGCCGTACTAACTACAGACTTTATTAATAACCAAATTTTA h36b_ai2.seq

      ACAGAATGCTTATTACAGAGATTTTCTTCTAAAAAGATTCATTTCCACCC Majority
                   11310     11320     11330     11340     11350
11222 ACAGAATGCTTATTACAGAGATTTTCTTCTAAAAAGATTCATTTCCACCC 2603_ai2.seq
11223 ACAGAATGCTTATTACAGAGATTTTCTTCTAAAAAGATTCATTTCCACCC 18rs21_ai2.seq
11136 TTGGACTGATATTTCT-----CTTTCAAATGTCCTAATTCAGGTCCGTCT 515_ai2.seq
11120 ACAGAATGCTTATTACAGAGATTTTCTTCTAAAAAGATTCATTTCCACCC cjb111_ai2.seq
11160 ACAGAATGCTTATTACAGAGATTTTCTTCTAAAAAGATTCATTTCCACCC h36b_ai2.seq

      TTACTATTTATTAACTGATGATCTTTCCAATATTACTAATCTTAATCCAG Majority
                   11360     11370     11380     11390     11400
11272 TTACTATTTATTAACTGATGATCTTTCCAATATTACTAATCTTAATCCAG 2603_ai2.seq
11273 TTACTATTTATTAACTGATGATCTTTCCAATATTACTAATCTTAATCCAG 18rs21_ai2.seq
11181 CCTGCAATCTGTAAATAAACATTTTCAGAGTACTG-TGACATCAA---AA 515_ai2.seq
11170 TTACTATTTATTAACTGATGATCTTTCCAATATTACTAATCTTAATCCAG cjb111_ai2.seq
11210 TTACTATTTATTAACTGATGATCTTTCCAATATTACTAATCTTAATCCAG h36b_ai2.seq

      ACATTATTATTACCAATAAAAAGCTTTCTCCCTTTATCAAACATGAGATT Majority
                   11410     11420     11430     11440     11450
11322 ACATTATTATTACCAATAAAAAGCTTTCTCCCTTTATCAAACATGAGATT 2603_ai2.seq
11323 ACATTATTATTACCAATAAAAAGCTTTCTCCCTTTATCAAACATGAGATT 18rs21_ai2.seq
11227 ATGCTTCTAAGAGCAATTCAATGCCTTTTTCTTTAAT--------AATTC 515_ai2.seq
11220 ACATTATTATTACCAATAAAAAGCTTTCTCCCTTTATCAAACATGAGATT cjb111_ai2.seq
11260 ACATTATTATTACCAATAAAAAGCTTTCTCCCTTTATCAAACATGAGATT h36b_ai2.seq

      TCTTCAGAGAGTTTAATTACATATATTGATCTGATTAATACTTCAGACCA Majority
                   11460     11470     11480     11490     11500
11372 TCTTCAGAGAGTTTAATTACATATATTGATCTGATTAATACTTCAGACCA 2603_ai2.seq
11373 TCTTCAGAGAGTTTAATTACATATATTGATCTGATTAATACTTCAGACCA 18rs21_ai2.seq
11269 TACCAGCATAAGTGATGAAAATATCATCAGCAGATTTTTCAAGGTAAGCC 515_ai2.seq
11270 TCTTCAGAGAGTTTAATTACATATATTGATCTGATTAATACTTCAGACCA cjb111_ai2.seq
11310 TCTTCAGAGAGTTTAATTACATATATTGATCTGATTAATACTTCAGACCA h36b_ai2.seq

      AATCAATCAAATCCAAAAAAATTATTTCATCAATACAGGAAGAAAAATATT Majority
                   11510     11520     11530     11540     11550
11422 AATCAATCAAATCCAAAAAAATTATTTCATCAATACAGGAAGAAAAATATT 2603_ai2.seq
11423 AATCAATCAAATCCAAAAAAATTATTTCATCAATACAGGAAGAAAAATATT 18rs21_ai2.seq
11319 GTGTCAGCAAAATCAGAGCCTAGACTTTCAGATACCGAATTATAAATAAC 515_ai2.seq
11320 AATCAATCAAATCCAAAAAAATTATTTCATCAATACAGGAAGAAAAATATT cjb111_ai2.seq
11360 AATCAATCAAATCCAAAAAAATTATTTCATCAATACAGGAAGAAAAATATT h36b_ai2.seq

      GCAAACTTTTTGCAAAAACTAATGAAATAACTAATCGTAGCTCCT----- Majority
                   11560     11570     11580     11590     11600
11472 GCAAACTTTTTGCAAAAACTAATGAAATAACTAATCGTAGCTCCT----- 2603_ai2.seq
11473 GCAAACTTTTTGCAAAAACTAATGAAATAACTAATCGTAGCTCCT----- 18rs21_ai2.seq
11369 TCCTTTAGCTTCTATATTAAAATGTTTTAACCATTCAACGCTTCTCTTGG 515_ai2.seq
11370 GCAAACTTTTTGCAAAAACTAATGAAATAACTAATCGTAGCTCCT----- cjb111_ai2.seq
11410 GCAAACTTTTTGCAAAAACTAATGAAATAACTAATCGTAGCTCCT----- h36b_ai2.seq

      ATAACTCTTAAAAATTAACATTAAAAAGCT-AGAGCATTGTGTAATGCTC Majority
                   11610     11620     11630     11640     11650
11517 ATAACTCTTAAAAATTAACATTAAAAAGCT-AGAGCATTGTGTAATGCTC 2603_ai2.seq
11518 ATAACTCTTAAAAATTAACATTAAAAAGCT-AGAGCATTGTGTAATGCTC 18rs21_ai2.seq
11419 ATACCGCATAAAAAATCTGGACGATAATGCTTACACGCGCTGTGAGA--- 515_ai2.seq
11415 ATAACTCTTAAAAATTAACATTAAAAAGCT-AGAGCATTGTGTAATGCTC cjb111_ai2.seq
11455 ATAACTCTTAAAAATTAACATTAAAAAGCT-AGAGCATTGTGTAATGCTC h36b_ai2.seq

      TAGCTTTTTAATGTTAATTTTTTTGAATAATATAATCCAACTTTTCAACT Majority
                   11660     11670     11680     11690     11700
11566 TAGCTTTTTAATGTTAATTTTTTTGAATAATATAATCCAACTTTTCAACT 2603_ai2.seq
11567 TAGCTTTTTAATGTTAATTTTTTTGAATAATATAATCCAACTTTTCAACT 18rs21_ai2.seq
11466 -AGATGTTCATAGATAGCTCCAAAGAAATCTAAAAAACGA-TTATTGACA 515_ai2.seq
11464 TAGCTTTTTAATGTTAATTTTTTTGAATAATATAATCCAACTTTTCAACT cjb111_ai2.seq
11504 TAGCTTTTTAATGTTAATTTTTTTGAATAATATAATCCAACTTTTCAACT h36b_ai2.seq
```

FIGURE 19AA

Alignment Report of Ai-2_alignment, using J. Hein method with Weighted residue weight table.
Thursday, July 29, 2004 6:32 PM

```
      G T T T T T T C C C A T G T G A A A T G T T C T T T A A T T C T T T T A G C A A T A T T C T G T T G Majority
                11710               11720               11730               11740               11750
11616 G T T T T T T C C C A T G T G A A A T G T T C T T T A A T T C T T T T A G C A A T A T T C T G T T G 2603_ai2.seq
11617 G T T T T T T C C C A T G T G A A A T G T T C T T T A A T T C T T T T A G C A A T A T T C T G T T G 18rs21_ai2.seq
11514 G A A A A A T G A C T T G A C C C A T G G T C T A A A A C A A T A C T A G G T A A A T G G T G C T T 515_ai2.seq
11514 G T T T T T T C C C A T G T G A A A T G T T C T T T A A T T C T T T T A G C A A T A T T C T G T T G cjb111_ai2.seq
11554 G T T T T T T C C C A T G T G A A A T G T T C T T T A A T T C T T T T A G C A A T A T T C T G T T G h36b_ai2.seq

      T A G T T T C T C T C T T A A T G C C T T A T C T T T T A C T A A T A A A T C A A G A G A T T C A T Majority
                11760               11770               11780               11790               11800
11666 T A G T T T C T C T C T T A A T G C C T T A T C T T T T A C T A A T A A A T C A A G A G A T T C A T 2603_ai2.seq
11667 T A G T T T C T C T C T T A A T G C C T T A T C T T T T A C T A A T A A A T C A A G A G A T T C A T 18rs21_ai2.seq
11564 C T T T G C A A A A G A T A G C C C T T C T A A C G T T G T T A A C T G A A A A C G T G T A T T A C 515_ai2.seq
11564 T A G T T T C T C T C T T A A T G C C T T A T C T T T T A C T A A T A A A T C A A G A G A T T C A T cjb111_ai2.seq
11604 T A G T T T C T C T C T T A A T G C C T T A T C T T T T A C T A A T A A A T C A A G A G A T T C A T h36b_ai2.seq

      G G A G T - - - G A C T G A G T A T T T T C T T C C A T G A T G A T T C C T A A C T C A G G G C T A Majority
                11810               11820               11830               11840               11850
11716 G G A G T - - - G A C T G A G T A T T T T C T T C C A T G A T G A T T C C T A A C T C A G G G C T A 2603_ai2.seq
11717 G G A G T - - - G A C T G A G T A T T T T C T T C C A T G A T G A T T C C T A A C T C A G G G C T A 18rs21_ai2.seq
11614 A A A T C A C A A A A T C A A T A T T T T C A T C T G A A A C A T A T T T C A T C A G C G T G T T G 515_ai2.seq
11614 G G A G T - - - G A C T G A G T A T T T T C T T C C A T G A T G A T T C C T A A C T C A G G G C T A cjb111_ai2.seq
11654 G G A G T - - - G A C T G A G T A T T T T C T T C C A T G A T G A T T C C T A A C T C A G G G C T A h36b_ai2.seq

      T - - - - - - C A A T A A C T T C A A C T G T T C C A C C G C G A T C T G T T G C A A T A A T A G C Majority
                11860               11870               11880               11890               11900
11763 T - - - - - - C A A T A A C T T C A A C T G T T C C A C C G C G A T C T G T T G C A A T A A T A G C 2603_ai2.seq
11764 T - - - - - - C A A T A A C T T C A A C T G T T C C A C C G C G A T C T G T T G C A A T A A T A G C 18rs21_ai2.seq
11664 T A T T C T C G A T T T T T G T T A A T A A T A G G A T A G C G C T G C T T G A C A A T A T T T T T 515_ai2.seq
11661 T - - - - - - C A A T A A C T T C A A C T G T T C C A C C G C G A T C T G T T G C A A T A A T A G C cjb111_ai2.seq
11701 T - - - - - - C A A T A A C T T C A A C T G T T C C A C C G C G A T C T G T T G C A A T A A T A G C h36b_ai2.seq

      A C T T G A A A G T A G A C C A G C T T C T A A A - - - - - A T A G A G G T T G G T A A T C C C T C Majority
                11910               11920               11930               11940               11950
11807 A C T T G A A A G T A G A C C A G C T T C T A A A - - - - - A T A G A G G T T G G T A A T C C C T C 2603_ai2.seq
11808 A C T T G A A A G T A G A C C A G C T T C T A A A - - - - - A T A G A G G T T G G T A A T C C C T C 18rs21_ai2.seq
11714 G G T C G G T A A A C G G T A A A T T T T T C T A C C C T T G T C T T C A T C T A T A A T C G G T - 515_ai2.seq
11705 A C T T G A A A G T A G A C C A G C T T C T A A A - - - - - A T A G A G G T T G G T A A T C C C T C cjb111_ai2.seq
11745 A C T T G A A A G T A G A C C A G C T T C T A A A - - - - - A T A G A G G T T G G T A A T C C C T C h36b_ai2.seq

      T G G A T A C A T T G A A G G G T A A A C A A A G A T A T C A G T C T G T - G C C A T T A A A G A C Majority
                11960               11970               11980               11990               12000
11852 T G G A T A C A T T G A A G G G T A A A C A A A G A T A T C A G T C T G T - G C C A T T A A A G A C 2603_ai2.seq
11853 T G G A T A C A T T G A A G G G T A A A C A A A G A T A T C A G T C T G T - G C C A T T A A A G A C 18rs21_ai2.seq
11763 A A A T C A C C A T G A T T A G T T G T T A C A A T A A C A A C A C G G T A G C C A C G C T T A A C 515_ai2.seq
11750 T G G A T A C A T T G A A G G G T A A A C A A A G A T A T C A G T C T G T - G C C A T T A A A G A C cjb111_ai2.seq
11790 T G G A T A C A T T G A A G G G T A A A C A A A G A T A T C A G T C T G T - G C C A T T A A A G A C h36b_ai2.seq

      A T A G T C T G T T C A A A G T T T A A T T T C C C C A A A A A G T T A A T C T G T T T G G A C T G Majority
                12010               12020               12030               12040               12050
11901 A T A G T C T G T T C A A A G T T T A A T T T C C C C A A A A A G T T A A T C T G T T T G G A C T G 2603_ai2.seq
11902 A T A G T C T G T T C A A A G T T T A A T T T C C C C A A A A A G T T A A T C T G T T T G G A C T G 18rs21_ai2.seq
11813 C A A A T C T G C T G T C A T T T T A T C T G T A T A A C G T T C A A T A C C T C C G A G G A A G G 515_ai2.seq
11799 A T A G T C T G T T C A A A G T T T A A T T T C C C C A A A A A G T T A A T C T G T T T G G A C T G cjb111_ai2.seq
11839 A T A G T C T G T T C A A A G T T T A A T T T C C C C A A A A A G T T A A T C T G T T T G G A C T G h36b_ai2.seq

      A T A T T T C T C T T T C A A A T G T G C T A A T T C A G G T C C G T C T C C T G C A A T C T G T A Majority
                12060               12070               12080               12090               12100
11951 A T A T T T C T C T T T C A A A T G T G C T A A T T C A G G T C C G T C T C C T G C A A T C T G T A 2603_ai2.seq
11952 A T A T T T C T C T T T C A A A T G T G C T A A T T C A G G T C C G T C T C C T G C A A T C T G T A 18rs21_ai2.seq
11863 G T A G A T A A T A T C C T G A G A A A A C A G C A A C T G T T T T T A C C T T A T T T T C C A T A 515_ai2.seq
11849 A T A T T T C T C T T T C A A A T G T G C T A A T T C A G G T C C G T C T C C T G C A A T C T G T A cjb111_ai2.seq
11889 A T A T T T C T C T T T C A A A T G T G C T A A T T C A G G T C C G T C T C C T G C A A T C T G T A h36b_ai2.seq

      A A T A A A C A T T T T C A - G A G T A C T G T G A C A T C G A A A A T G C T T C T A A G A G C A A Majority
                12110               12120               12130               12140               12150
12001 A A T A A A C A T T T T C A - G A G T A C T G T G A C A T C G A A A A T G C T T C T A A G A G C A A 2603_ai2.seq
12002 A A T A A A C A T T T T C A - G A G T A C T G T G A C A T C G A A A A T G C T T C T A A G A G C A A 18rs21_ai2.seq
11913 T T T A T C C A C T T T C A T C A A T A A G C C A T C T T T T A A G C C T T T A A T C A T A G C A A 515_ai2.seq
11899 A A T A A A C A T T T T C A - G A G T A C T G T G A C A T C G A A A A T G C T T C T A A G A G C A A cjb111_ai2.seq
11939 A A T A A A C A T T T T C A - G A G T A C T G T G A C A T C G A A A A T G C T T C T A A G A G C A A h36b_ai2.seq
```

FIGURE 19AB

Alignment Report of Ai-2_alignment, using J. Hein method with Weighted residue weight table.
Thursday, July 29, 2004 6:32 PM

```
      T T C A A T G C C T T T T T C T T T A A T A A T T C T A C C A G C A T A A G T G A T G A A A A T A T Majority
                          12160               12170               12180               12190               12200
12050 T T C A A T G C C T T T T T C T T T A A T A A T T C T A C C A G C A T A A G T G A T G A A A A T A T 2603_ai2.seq
12051 T T C A A T G C C T T T T T C T T T A A T A A T T C T A C C A G C A T A A G T G A T G A A A A T A T 18rs21_ai2.seq
11963 C T - A T T T T T T T G C T C T T T T G C T C T T C T G C T A C C A A C A C T C G A A C A A A T T C 515_ai2.seq
11948 T T C A A T G C C T T T T T C T T T A A T A A T T C T A C C A G C A T A A G T G A T G A A A A T A T cjb111_ai2.seq
11988 T T C A A T G C C T T T T T C T T T A A T A A T T C T A C C A G C A T A A G T G A T G A A A A T A T h36b_ai2.seq

      C A T C A G C A G A T T T T T C A A G G T A A G C C G T A C C A G C A A A A T C A G A G C C T A G A Majority
                          12210               12220               12230               12240               12250
12100 C A T C A G C A G A T T T T T C A A G G T A A G C C G T A C C A G C A A A A T C A G A G C C T A G A 2603_ai2.seq
12101 C A T C A G C A G A T T T T T C K A G G T A A G C C G T A C C A G C A A A A T C A G A G C C T A G A 18rs21_ai2.seq
12012 A T T T C G C A T A A A T A C T A A A - - T A T T T G T A T C - G C T T C T T C T T A C C A T A T T 515_ai2.seq
11998 C A T C A G C A G A T T T T T C A A G G T A A G C C G T A C C A G C A A A A T C A G A G C C T A G A cjb111_ai2.seq
12038 C A T C A G C A G A T T T T T C A A G G T A A G C C G T A C T A G C A A A A T C A G A G C C T A G A h36b_ai2.seq

      C T T T C A G A T A C C G A A T T A T A A A T A A C T C C T T T A G C T T C T A T A T T A A A A T G Majority
                          12260               12270               12280               12290               12300
12150 C T T T C A G A T A C C G A A T T A T A A A T A A C T C C T T T A G C T T C T A T A T T A A A A T G 2603_ai2.seq
12151 C T T T C A G A T A C C G A A T T A T A A A T A A C T C C T T T A G C T T C T A T A T T A A A A T G 18rs21_ai2.seq
12059 T T T T T A T A A T A T A G A T C G C A - - - T T G C G T A T C A T G T A A T A T T T T C G A A A T 515_ai2.seq
12048 C T T T C A G A T A C C G A A T T A T A A A T A A C T C C T T T A G C T T C T A T A T T A A A A T G cjb111_ai2.seq
12088 C T T T C A G A T A C C G A A T T A T A A A T A A C T C C T T T A G C T T C T A T A T T A A A A T G h36b_ai2.seq

      T T T T A A C C A T T C A A C G C T T C T C T T G G A T A C C G C A T A A A A A T C T G G A C G A T Majority
                          12310               12320               12330               12340               12350
12200 T T T T A A C C A T T C A A C G C T T C T C T T G G A T A C C G C A T A A A A A T C T G G A C G A T 2603_ai2.seq
12201 T T T T A A C C A T T C A A C G C T T C T C T T G G A T A C C G C A T A A A A A T C T G G A C G A T 18rs21_ai2.seq
12106 G G T G A A T G A T T C A A T A C - - A T G A A A A A C A T G G C C A A A T T T T T T A A C T C G T 515_ai2.seq
12098 T T T T A A C C A T T C A A C G C T T C T C T T G G A T A C C G C A T A A A A A T C T G G A C G A T cjb111_ai2.seq
12138 T T T T A A C C A T T C A A C G C T T C T C T T G G A T A C C G C A T A A A A A T C T G G A C G A T h36b_ai2.seq

      A A T G C T T A A C A C G C G C T G T G A G A A G A T G T T C A T A G A T A G C T C C A A A G A A A Majority
                          12360               12370               12380               12390               12400
12250 A A T G C T T A A C A C G C G C T G T G A G A A G A T G T T C A T A G A T A G C T C C A A A G A A A 2603_ai2.seq
12251 A A T G C T T A A C A C G C G C T G T G A G A A G A T G T T C A T A G A T A G C T C C A A A G A A A 18rs21_ai2.seq
12154 G A A G A G T G T C C A A T T T C G T G - T A A C A G A C C A A T A A A A T T A A C C T G A T A A G 515_ai2.seq
12148 A A T G C T T A A C A C G C G C T G T G A G A A G A T G T T C A T A G A T A G C T C C A A A G A A A cjb111_ai2.seq
12188 A A T G C T T A A C A C G C G C T G T G A G A A G A T G T T C A T A G A T A G C T C C A A A G A A A h36b_ai2.seq

      T C T A A A A A A C G A T T A T T G A C A G A A A A A T G A C T T G A C C C A T G G T C T A A A A C Majority
                          12410               12420               12430               12440               12450
12300 T C T A A A A A A C G A T T A T T G A C A G A A A A A T G A C T T G A C C C A T G G T C T A A A A C 2603_ai2.seq
12301 T C T A A A A A A C G A T T A T T G A C A G A A A A A T G A C T T G A C C C A T G G T C T A A A A C 18rs21_ai2.seq
12203 T C T T A T A T C C G A T C T C T G A C A G A - C G A T A A T T C A T T T C A G A G T C A A C A A A 515_ai2.seq
12198 T C T A A A A A A C G A T T A T T G A C A G A A A A A T G A C T T G A C C C A T G G T C T A A A A C cjb111_ai2.seq
12238 T C T A A A A A A C G A T T A T T G A C A G A A A A A T G A C T T G A C C C A T G G T C T A A A A C h36b_ai2.seq

      A A T A C T A G G T A A A T G G T G A T T C T T T G C A A A - - - A G A T A G C C C T T C T A G C G Majority
                          12460               12470               12480               12490               12500
12350 A A T A C T A G G T A A A T G G T G A T T C T T T G C A A A - - - A G A T A G C C C T T C T A G C G 2603_ai2.seq
12351 A A T A C T A G G T A A A T G G T G A T T C T T T G C A A A - - - A G A T A G C C C T T C T A G C G 18rs21_ai2.seq
12252 A T C A A T A A A C A - - - - - - T C T C T T C T G C A A A G C C A G A T G T T T C T T C G A A A A 515_ai2.seq
12248 A A T A C T A G G T A A A T G G T G A T T C T T T G C A A A - - - A G A T A G C C C T T C T A G C G cjb111_ai2.seq
12288 A A T A C T A G G T A A A T G G T G C T T C T T T G C A A A - - - A G A T A G C C C T T C T A G C G h36b_ai2.seq

      T T G T T A A C T G A A A A C G T G T A T T A C A A A T C A C A A A A T C A A T A T T T T C A T C T Majority
                          12510               12520               12530               12540               12550
12397 T T G T T A A C T G A A A A C G T G T A T T A C A A A T C A C A A A A T C A A T A T T T T C A T C T 2603_ai2.seq
12398 T T G T T A A C T G A A A A C G T G T A T T A C A A A T C A C A A A A T C A A T A T T T T C A T C T 18rs21_ai2.seq
12296 C G C T C G T T T T C A T T A A A G C A G C C G A A G T A A T A C A C T C T T C A A T T T C T T T A 515_ai2.seq
12295 T T G T T A A C T G A A A A C G T G T A T T A C A A A T C A C A A A A T C A A T A T T T T C A T C T cjb111_ai2.seq
12335 T T G T T A A C T G A A A A C G T G T A T T A C A A A T C A C A A A A T C A A T A T T T T C A T C T h36b_ai2.seq

      G A A A C A T A T T T C A T C A G C G T G T T G T A T T C T C G A T T - - - - - T T T G T T A A T A Majority
                          12560               12570               12580               12590               12600
12447 G A A A C A T A T T T C A T C A G C G T G T T G T A T T C T C G A T T - - - - - T T T G T T A A T A 2603_ai2.seq
12448 G A A A C A T A T T T C A T C A G C G T G T T G T A T T C T C G A T T - - - - - T T T G T T A A T A 18rs21_ai2.seq
12346 T A G T C A A A T T C T T G C A T C A C T A A A T T T T C A C G G T T C A T A T C T T G A T A C A A 515_ai2.seq
12345 G A A A C A T A T T T C A T C A G C G T G T T G T A T T C T C G A T T - - - - - T T T G T T A A T A cjb111_ai2.seq
12385 G A A A C A T A T T T C A T C A G C G T G T T G T A T T C T C G A T T - - - - - T T T G T T A A T A h36b_ai2.seq
```

FIGURE 19AC

Alignment Report of Ai-2_alignment, using J. Hein method with Weighted residue weight table.
Thursday, July 29, 2004 6:32 PM

```
      A T A G G A T A G C - - - - - - - - - - - - - G C T G C T T G A C A A T A T T T T T G G T C G G T A A Majority
                          12610           12620           12630           12640           12650
12492 A T A G G A T A G C - - - - - - - - - - - - - G C T G C T T G A C A A T A T T T T T G G T C G G T A A 2603_ai2.seq
12493 A T A G G A T A G C - - - - - - - - - - - - - G C T G C T T G A C A A T A T T T T T G G T C G G T A A 18rs21_ai2.seq
12396 A C A A G A T A A C A T A C C G A C C T T A G G G T A A A T G A A C G T A A T T T T C A T A A T T A T 515_ai2.seq
12390 A T A G G A T A G C - - - - - - - - - - - - - G C T G C T T G A C A A T A T T T T T G G T C G G T A A cjb111_ai2.seq
12430 A T A G G A T A G C - - - - - - - - - - - - - G C T G C T T G A C A A T A T T T T T G G T C G G T A A h36b_ai2.seq

      A C G G T A A A T T T T T C - - - - T A C C C T T G T C T T C A T C T A T A A T C G G T A A A T C A Majority
                          12660           12670           12680           12690           12700
12530 A C G G T A A A T T T T T C - - - - T A C C C T T G T C T T C A T C T A T A A T C G G T A A A T C A 2603_ai2.seq
12531 A C G G T A A A T T T T T C - - - - T A C C C T T G T C T T C A T C T A T A A T C G G T A A A T C A 18rs21_ai2.seq
12446 C T A T C A A A T C A C C T A G G A C A A C C G A A T C T T G A T C T A A A G T C A A G A A C C A A 515_ai2.seq
12428 A C G G T A A A T T T T T C - - - - T A C C C T T G T C T T C A T C T A T A A T C G G T A A A T C A cjb111_ai2.seq
12468 A C G G T A A A T T T T T C - - - - T A C C C T T G T C T T C A T C T A T A A T C G G T A A A T C A h36b_ai2.seq

      C C A T G A T T A G T T G T T A C A A T A A C A A C A C G G T A G C C A C G C T T A A C C A A A T C Majority
                          12710           12720           12730           12740           12750
12576 C C A T G A T T A G T T G T T A C A A T A A C A A C A C G G T A G C C A C G C T T A A C C A A A T C 2603_ai2.seq
12577 C C A T G A T T A G T T G T T A C A A T A A C A A C A C G G T A G C C A C G C T T A A C C A A A T C 18rs21_ai2.seq
12496 T C A A A T T C T T G T G C T A C T G C A A A T T G A C C G A T A C A G T T C A A A G C A T A T G C 515_ai2.seq
12474 C C A T G A T T A G T T G T T A C A A T A A C A A C A C G G T A G C C A C G C T T A A C C A A A T C cjb111_ai2.seq
12514 C C A T G A T T A G T T G T T A C A A T A A C A A C A C G G T A G C C A C G C T T A A C C A A A T C h36b_ai2.seq

      T G C T G T C A T T T T A T C T G T A T A A C G T T C A A T A C C T C C G A G G A A G G G T A G A T Majority
                          12760           12770           12780           12790           12800
12626 T G C T G T C A T T T T A T C T G T A T A A C G T T C A A T A C C T C C G A G G A A G G G T A G A T 2603_ai2.seq
12627 T G C T G T C A T T T T A T C T G T A T A A C G T T C A A T A C C T C C G A G G A A G G G T A G A T 18rs21_ai2.seq
12546 A A T C C C T T T A T T T T C T G T T A A A T A A T C A A C A G C T A G G T G C C C C T C T T C A T 515_ai2.seq
12524 T G C T G T C A T T T T A T C T G T A T A A C G T T C A A T A C C T C C G A G G A A G G G T A G A T cjb111_ai2.seq
12564 T G C T G T C A T T T T A T C T G T A T A A C G T T C A A T A C C T C C G A G G A A G G G T A G A T h36b_ai2.seq

      A A T A T C C T G A G A A A A C A G C A A C T G T T T T T A C C T T A T T T T C C A T A T T T A T C Majority
                          12810           12820           12830           12840           12850
12676 A A T A T C C T G A G A A A A C A G C A A C T G T T T T T A C C T T A T T T T C C A T A T T T A T C 2603_ai2.seq
12677 A A T A T C C T G A G A A A A C A G C A A C T G T T T T T A C C T T A T T T T C C A T A T T T A T C 18rs21_ai2.seq
12596 T A T A A T C G G C T A C T A A T T G A G A A A T T T C T T C C T T A T T T T T C G - - - - - A G C 515_ai2.seq
12574 A A T A T C C T G A G A A A A C A G C A A C T G T T T T T A C C T T A T T T T C C A T A T T T A T C cjb111_ai2.seq
12614 A A T A T C C T G A G A A A A C A G C A A C T G T T T T T A C C T T A T T T T C C A T A T T T A T C h36b_ai2.seq

      C A C T T T C A T C A A T A A G C C A T C T T T T A A G C C T T T A A T C A T A G C A A C T A T T T Majority
                          12860           12870           12880           12890           12900
12726 C A C T T T C A T C A A T A A G C C A T C T T T T A A G C C T T T A A T C A T A G C A A C T A T T T 2603_ai2.seq
12727 C A C T T T C A T C A A T A A G C C A T C T T T T A A G C C T T T A A T C A T A G C A A C T A T T T 18rs21_ai2.seq
12641 C A T T A T C T A C G A T A - - - - - - - - T A G A T G T G G C T T A C T T G A G G A T A A A T T G 515_ai2.seq
12624 C A C T T T C A T C A A T A A G C C A T C T T T T A A G C C T T T A A T C A T A G C A A C T A T T T cjb111_ai2.seq
12664 C A C T T T C A T C A A T A A G C C A T C T T T T A A G C C T T T A A T C A T A G C A A C T A T T T h36b_ai2.seq

      T T T T G C T C T T T T G C T C T T C T G C T A C C A A C A C T C G A A C A A A T T C A T T T C G C Majority
                          12910           12920           12930           12940           12950
12776 T T T T G C T C T T T T G C T C T T C T G C T A C C A A C A C T C G A A C A A A T T C A T T T C G C 2603_ai2.seq
12777 T T T T G C T C T T T T G C T C T T C T G C T A C C A A C A C T C G A A C A A A T T C A T T T C G C 18rs21_ai2.seq
12683 C T C G A A T G T T C T G A T C T - A A G C G T T C A A T A T T G G G G T T A A - - A G G T G A C A 515_ai2.seq
12674 T T T T G C T C T T T T G C T C T T C T G C T A C C A A C A C T C G A A C A A A T T C A T T T C G C cjb111_ai2.seq
12714 T T T T G C T C T T T T G C T C T T C T G C T A C C A A C A C T C G A A C A A A T T C A T T T C G C h36b_ai2.seq

      A T A A A T A C T A A A T A T T T - G T A T C G C T T C T T C T T A C C A T A T T T T T T T A T A A Majority
                          12960           12970           12980           12990           13000
12826 A T A A A T A C T A A A T A T T T - G T A T C G C T T C T T C T T A C C A T A T T T T T T T A T A A 2603_ai2.seq
12827 A T A A A T A C T A A A T A T T T - G T A T C G C T T C T T C T T A C C A T A T T T T T T T A T A A 18rs21_ai2.seq
12730 A T A C C C G C T A A A T A T T T C A T G T T C T A T G C T C T T T T C T A A A A T C T C T A A A T 515_ai2.seq
12724 A T A A A T A C T A A A T A T T T - G T A T C G C T T C T T C T T A C C A T A T T T T T T T A T A A cjb111_ai2.seq
12764 A T A A A T A C T A A A T A T T T - G T A T C G C T T C T T C T T A C C A T A T T T T T T T A T A A h36b_ai2.seq

      T A T A G A T C G C A T T G C G T A T C A T G T A A T A T T T T C G A A A T G G T G A A T G A T T C Majority
                          13010           13020           13030           13040           13050
12875 T A T A G A T C G C A T T G C G T A T C A T G T A A T A T T T T C G A A A T G G T G A A T G A T T C 2603_ai2.seq
12876 T A T A G A T C G C A T T G C G T A T C A T G T A A T A T T T T C G A A A T G G T G A A T G A T T C 18rs21_ai2.seq
12780 A A C T G A A T G A C T G G T G C T T T G - G T T A T A A A A A C G A T A C C G A C A T A G A T - - 515_ai2.seq
12773 T A T A G A T C G C A T T G C G T A T C A T G T A A T A T T T T C G A A A T G G T G A A T G A T T C cjb111_ai2.seq
12813 T A T A G A T C G C A T T G C G T A T C A T G T A A T A T T T T C G A A A T G G T G A A T G A T T C h36b_ai2.seq
```

FIGURE 19AD

Alignment Report of Ai-2_alignment, using J. Hein method with Weighted residue weight table.
Thursday, July 29, 2004 6:32 PM

```
      AATACATGAAAAACATGGCCAAATTTTTTAACTCGTGAAGAGTGTCCAAT Majority
           13060     13070     13080     13090     13100
12925 AATACATGAAAAACATGGCCAAATTTTTTAACTCGTGAAGAGTGTCCAAT 2603_ai2.seq
12926 AATACATGAAAAACATGGCCAAATTTTTTAACTCGTGAAGAGTGTCCAAT 18rs21_ai2.seq
12827 AGTTACTGCTACTAAACTTTGAATGACATAATTTACCAATGATACTGACA 515_ai2.seq
12823 AATACATGAAAAACATGGCCAAATTTTTTAACTCGTGAAGAGTGTCCAAT cjb111_ai2.seq
12863 AATACATGAAAAACATGGCCAAATTTTTTAACTCGTGAAGAGTGTCCAAT h36b_ai2.seq

      TTCGTGTAACAGACCAATAAAATTAA--CCTGATAAGTCTTATATCCCAT Majority
           13110     13120     13130     13140     13150
12975 TTCGTGTAACAGACCAATAAAATTAA--CCTGATAAGTCTTATATCCCAT 2603_ai2.seq
12976 TTCGTGTAACAGACCAATAAAATTAA--CCTGATAAGTCTTATATCCCAT 18rs21_ai2.seq
12877 TTTGAGTATTGATATAATAGAGTACAGCTCCACTAAGAGTAGCAGCAATT 515_ai2.seq
12873 TTCGTGTAACAGACCAATAAAATTAA--CCTGATAAGTCTTATATCCCAT cjb111_ai2.seq
12913 TTCGTGTAAAAGACCAATAAAATTAA--CCTGATAAGTCTTATATCCCAT h36b_ai2.seq

      CTCTGACAGACGATAATTCATTTCAGAGTCAACAAAATCAATAAACATCT Majority
           13160     13170     13180     13190     13200
13023 CTCTGACAGACGATAATTCATTTCAGAGTCAACAAAATCAATAAACATCT 2603_ai2.seq
13024 CTCTGACAGACGATAATTCATTTCAGAGTCAACAAAATCAATAAACATCT 18rs21_ai2.seq
12927 AAATAGCGCAGCATTCCTCTTGTTA-ATTCTTTAAAA---GTAAATACAT 515_ai2.seq
12921 CTCTGACAGACGATAATTCATTTCAGAGTCAACAAAATCAATAAACATCT cjb111_ai2.seq
12961 CTCTGACAGACGATAATTCATTTCAGAGTCAACAAAATCAATAAACATCT h36b_ai2.seq

      CTTCTGCAAAGCCAGATGTTTCTTCGAAAACGCTCGTTTTCATTAAAGCA Majority
           13210     13220     13230     13240     13250
13073 CTTCTGCAAAGCCAGATGTTTCTTCGAAAACGCTCGTTTTCATTAAAGCA 2603_ai2.seq
13074 CTTCTGCAAAGCCAGATGTTTCTTCGAAAACGCTCGTTTTCATTAAAGCA 18rs21_ai2.seq
12973 CTCTTAAAGAGATAGCTTGATATAGGGAGACAATAAATTCAGTAATAACT 515_ai2.seq
12971 CTTCTGCAAAGCCAGATGTTTCTTCGAAAACGCTCGTTTTCATTAAAGCA cjb111_ai2.seq
13011 CTTCTGCAAAGCCAGATGTTTCTTCAAAAACGCTCGTTTTCATTAAAGCA h36b_ai2.seq

      GCCGAAGTAATACACTCTTCAATTTCT-----TTATAGTCAAATTCT-TG Majority
           13260     13270     13280     13290     13300
13123 GCCGAAGTAATACACTCTTCAATTTCT-----TTATAGTCAAATTCT-TG 2603_ai2.seq
13124 GCCGAAGTAATACACTCTTCAATTTCT-----TTATAGTCAAATTCT-TG 18rs21_ai2.seq
13023 GTAGAGATAATAGCTCCCATAGCACCTAAAATTGGTATTAAAAGTATATT 515_ai2.seq
13021 GCCGAAGTAATACACTCTTCAATTTCT-----TTATAGTCAAATTCT-TG cjb111_ai2.seq
13061 GCCGAAGTAATACACTCTTCAATTTCT-----TTATAGTCAAATTCT-TG h36b_ai2.seq

      CATCACTAAATTT-TCACGGTTCATATCTTGATACAAACAAGATAACATA Majority
           13310     13320     13330     13340     13350
13167 CATCACTAAATTT-TCACGGTTCATATCTTGATACAAACAAGATAACATA 2603_ai2.seq
13168 CATCACTAAATTT-TCACGGTTCATATCTTGATACAAACAAGATAACATA 18rs21_ai2.seq
13073 AAGCACAACATTTGCCACAAGTCCAATAACTGCAGACATTGTGTAAGCTT 515_ai2.seq
13065 CATCACTAAATTT-TCACGGTTCATATCTTGATACAAACAAGATAACATA cjb111_ai2.seq
13105 CATAACTAAATCT-TCACGGTTCATATCTTGATACAAACAAGATAACATA h36b_ai2.seq

      C----CGACCTTAGGTAAATGAAGGTAATTTTCATAA----TTATCTATC Majority
           13360     13370     13380     13390     13400
13216 C----CGACCTTAGGTAAATGAAGGTAATTTTCATAA----TTATCTATC 2603_ai2.seq
13217 C----CGACCTTAGGTAAATGAAGGTAATTTTCATAA----TTATCTATC 18rs21_ai2.seq
13123 TTGTACGTCTTGAAGCCAGTAGATACTGTGTCCCTAAAGCGTTACCATAA 515_ai2.seq
13114 C----CGACCTTAGGTAAATGAAGGTAATTTTCATAA----TTATCTATC cjb111_ai2.seq
13154 C----CGACCTTAGGTAAAAGAAGGTAATTTTCATAA----TTATCTATC h36b_ai2.seq

      AAATCACCTAGGACAACCGAATCTTGATCTAAAGTCAAGAACCAATCAAA Majority
           13410     13420     13430     13440     13450
13258 AAATCACCTAGGACAACCGAATCTTGATCTAAAGTCAAGAACCAATCAAA 2603_ai2.seq
13259 AAATCACCTAGGACAACCGAATCTTGATCTAAAGTCAAGAACCAATCAAA 18rs21_ai2.seq
13173 GAAATGCAAATGATCATCAAAGACTCAACACCCATTAGCGGACCGACAGC 515_ai2.seq
13156 AAATCACCTAGGACAACCGAATCTTGATCTAAAGTCAAGAACCAATCAAA cjb111_ai2.seq
13196 AAATCACCTAGGACAACCGAATCTTGATCTAAAGTCAAGAACCAATCAAA h36b_ai2.seq

      TTCTTGTGCTACTGCAAATTGACCGATACAGTTCAAAGCATATGCAATTC Majority
           13460     13470     13480     13490     13500
13308 TTCTTGTGCTACTGCAAATTGACCGATACAGTTCAAAGCATATGCAATCC 2603_ai2.seq
13309 TTCTTGTGCTACTGCAAATTGACCGATACAGTTCAAAGCATATGCAATCC 18rs21_ai2.seq
13223 TTCATACCCTTTCCCAAA--AAAGAAGACAG-CAAATGTCGACGAAACTC 515_ai2.seq
13206 TTCTTGTGCTACTGCAAATTGACCAATACAGTTCAAAGCATATGCAATTC cjb111_ai2.seq
13246 TTCTTGTGCTACTGCAAATTGACCGATACAGTTCAAAGCATATGCAATTC h36b_ai2.seq
```

FIGURE 19AE

Alignment Report of Ai-2_alignment, using J. Hein method with Weighted residue weight table.
Thursday, July 29, 2004 6:32 PM

```
      C T T T A T T T T C T G T T A A A T A A T C A A C A G T T A G G T G C C C C T C T T C A T T A T A A Majority
                         13510                13520                13530                13540                13550
13358 C T T T A T T T T C T G T T A A A T A A T C A A C A G T T A G G T G C C C C T C T T C A T T A T A A 2603_ai2.seq
13359 C T T T A T T T T C T G T T A A A T A A T C A A C A G T T A G G T G C C C C T C T T C A T T A T A A 18rs21_ai2.seq
13270 C T A C C A C T C C C G C - - A A T C A T T A A C A T T G A G A T A G C A T T G C T T A A A T C A A 515_ai2.seq
13256 C T T T A T T T T C T G T T A A A T A A T C A A C A G T T A G G T G C C C C T C T T C A T T A T A A cjb111_ai2.seq
13296 C T T T A T T T T C T G T T A A A T A A T C A A C A G T T A G G T G C C C C T C T T C A T T A T A A h36b_ai2.seq

      T C G G C T A C T A A T T G A G A A A T T T C T T C C T T A T T T T T C G A G C C A T T A T C T A C Majority
                         13560                13570                13580                13590                13600
13408 T C G G C T A C T A A T T G A G A A A T T T C T T C C T T A T T T T T C G A G C C A T T A T C T A C 2603_ai2.seq
13409 T C G G C T A C T A A T T G A G A A A T T T C T T C C T T A T T T T T C G A G C C A T T A T C T A C 18rs21_ai2.seq
13318 C A A G T T T C A A A A G T A A A G C C T T A G C T T G C T T T T C T T T T C C T G A A G A A A A T 515_ai2.seq
13306 T C G G C C A C T A A T T G A G A A A T T T C C T C C T T A T T T T T C G A G C C A T T A T C T A C cjb111_ai2.seq
13346 T C G G C C A C T A A T T G A G A A A T T T C T T C C T T A T T T T T C G A G C C A T T A T C T A C h36b_ai2.seq

      G A T G T A G A T A T G G C T T A C T T G A G G A - - - - - T A A A T T G C T C G A A T G T T C T G Majority
                         13610                13620                13630                13640                13650
13458 G A T A T A G A T G T G G C T T A C T T G A G G A - - - - - T A A A T T G C T C G A A T G T T C T G 2603_ai2.seq
13459 G A T A T A G A T G T G G C T T A C T T G A G G A - - - - - T A A A T T G C T C G A A T G T T C T G 18rs21_ai2.seq
13368 A G A C T G G A G A G C C T T G G T A A G A A A A C T C C T C C G A T T G C T G A A A C A A T G G T 515_ai2.seq
13356 G A T G T A G A T A T G G C T T A C T T G A G G A - - - - - T A A A T T G C T C G A A T G T T C T G cjb111_ai2.seq
13396 G A T G T A G A T A T G G C T T A C T T G A G G A - - - - - T A A A T T G C T C G A A T G T T C T G h36b_ai2.seq

      A T C T A A G C G T T C A A T A T T G G G G T T A A A G G T G A C A A T A C C C G C T A A A T A T T Majority
                         13660                13670                13680                13690                13700
13503 A T C T A A G C G T T C A A T A T T G G G G T T A A A G G T G A C A A T A C C C G C T A A A T A T T 2603_ai2.seq
13504 A T C T A A G C G T T C A A T A T T G G G G T T A A A G G T G A C A A T A C C C G C T A A A T A T T 18rs21_ai2.seq
13418 A A A T A A A A T A C G A A T A A T T T T A T C A G A T T G A T C A A A A T A T C C A G C A C T G A 515_ai2.seq
13401 A T C T A A G C G T T C A A T A T T G G G G T T A A A G G T G A C A A T A C C C G C T A A A T A T T cjb111_ai2.seq
13441 A T C T A A G C G T T C A A T A T T G G G G T T A A A G G T G A C A A T A C C C G C T A A A T A T T h36b_ai2.seq

      T C A T G T T C T A T G C T C T T T T C T A A A A T C T C T A A A T A A C T G A A T G A C - - - - - Majority
                         13710                13720                13730                13740                13750
13553 T C A T G T T C T A T G C T C T T T T C T A A A A T C T C T A A A T A A C T G A A T G A C - - - - - 2603_ai2.seq
13554 T C A T G T T C T A T G C T C T T T T C T A A A A T C T C T A A A T A A C T G A A T G A C - - - - - 18rs21_ai2.seq
13468 C C A C A C T A T C C A T T G C T C C C A G C A T A C T C T T G T T A A G A G A G A G A T A A A T C 515_ai2.seq
13451 T C A T G T T C T A T G C T C T T T T C T A A A A T C T C T A A A T A A C T G A A T G A C - - - - - cjb111_ai2.seq
13491 T C A T G T T C T G T G C T C T T T T C T A A A A T C T C T A A A T A A C T G A A T G A C - - - - - h36b_ai2.seq

      - - - - T G G T G C T T T G G T T A T A A A A A C G A T A C C G A C A T A G A T A G T T A C T G C T Majority
                         13760                13770                13780                13790                13800
13598 - - - - T G G T G C T T T G G T T A T A A A A A C G A T A C C G A C A T A G A T A G T T A C T G C T 2603_ai2.seq
13599 - - - - T G G T G C T T T G G T T A T A A A A A C G A T A C C G A C A T A G A T A G T T A C T G C T 18rs21_ai2.seq
13518 T G C A T G G T G A T T T G G - G G T A A A A A T A A C A T T A A A G T T G G T C T T A G A T G T A 515_ai2.seq
13496 - - - - T G G T G C T T T G G T T A T A A A A A C G A T A C C G A C A T A G A T A G T T A C T G C T cjb111_ai2.seq
13536 - - - - T G G T G C T T T G G T T A T A A A A A C G A T A C C G A C A T A G A T A G T T A C T G C T h36b_ai2.seq

      A C T A A A C T T T G A A T - - - - G A C A T A A T T T A C C A A T G A T A C T G A C A T T T G A G Majority
                         13810                13820                13830                13840                13850
13644 A C T A A A C T T T G A A T - - - - G A C A T A A T T T A C C A A T G A T A C T G A C A T T T G A G 2603_ai2.seq
13645 A C T A A A C T T T G A A T - - - - G A C A T A A T T T A C C A A T G A T A C T G A C A T T T G A G 18rs21_ai2.seq
13567 T T A A G A T A T C T A A T C T A C T A A A T G G T A T C T T G A T G A T T T C A T G C T T T A A A 515_ai2.seq
13542 A C T A A A C T T T G A A T - - - - G A C A T A A T T T A C C A A T G A T A C T G A C A T T T G A G cjb111_ai2.seq
13582 A C T A A A C T T T G A A T - - - - G A C A T A A T T T A C C A A T G A T A C T G A C A T T T G A G h36b_ai2.seq

      T A T T G A T A T A A T A G A G T A C A G C T C C A C T A A G A - G T A G C A G C A A T T A A A T A Majority
                         13860                13870                13880                13890                13900
13690 T A T T G A T A T A A T A G A G T A C A G C T C C A C T A A G A - G T A G C A G C A A T T A A A T A 2603_ai2.seq
13691 T A T T G A T A T A A T A G A G T A C A G C T C C A C T A A G A - G T A G C A G C A A T T A A A T A 18rs21_ai2.seq
13617 T G A T G C C A G A C T G T T A A A T T T C C G A G T A A T G A T G C A A A T G C A A T T A A A - - 515_ai2.seq
13588 T A T T G A T A T A A T A G A G T A C A G C T C C A C T A A G A - G T A G C A G C A A T T A A A T A cjb111_ai2.seq
13628 T A T T G A T A T A A T A A A G T A C A G C T C C A C T A A G A - G T A G C A G C A A T T A A A T A h36b_ai2.seq

      G C G C A G C A T T C C T C T T G T T A A T T C T T T A A A A G T A A A T A C A T C T C T T A A A G Majority
                         13910                13920                13930                13940                13950
13739 G C G C A G C A T T C C T C T T G T T A A T T C T T T A A A A G T A A A T A C A T C T C T T A A A G 2603_ai2.seq
13740 G C G C A G C A T T C C T C T T G T T A A T T C T T T A A A A G T A A A T A C A T C T C T T A A A G 18rs21_ai2.seq
13665 - - - - A A C A T A T A A A G T G C T A G G T C A T C T G G C G T C T T C A C A A C T A A G A A G G 515_ai2.seq
13637 G C G C A G C A T T C C T C T T G T T A A T T C T T T A A A A G T A A A T A C A T C T C T T A A A G cjb111_ai2.seq
13677 G C G C A G C A T T C C T C T T G T T A A T T C T T T A A A A G T A A A T A C A T C T C T T A A A G h36b_ai2.seq
```

FIGURE 19AF

Alignment Report of Ai-2_alignment, using J. Hein method with Weighted residue weight table.
Thursday, July 29, 2004 6:32 PM

```
      A G A T A G C T T G A T A T A G G G A G A C A A T A A A T T C A G T A A T A A C T G T A G A G A T A Majority
                      13960               13970               13980               13990               14000
13789 A G A T A G C T T G A T A T A G G G A G A C A A T A A A T T C A G T A A T A A C T G T A G A G A T A 2603_ai2.seq
13790 A G A T A G C T T G A T A T A G G G A G A C A A T A A A T T C A G T A A T A A C T G T A G A G A T A 18rs21_ai2.seq
13711 T C A A A A C - - - - - - - - - A A C T G T A A T A A G C T T A A C A A T G G T A T T A C G A A T G 515_ai2.seq
13687 A G A T A G C T T G A T A T A G A G A G A C A A T A A A T T C A G T A A T A A C T G T A G A G A T A cjb111_ai2.seq
13727 A G A T A G C T T G A T A G A G G G A G A C A A T A A A T T C A G T A A T A A C T G T A G A G A T A h36b_ai2.seq

      A T A G C T C C C A T A G C A C C T A A A A T T G G T A T T A A A A G T A T A T T A A G C A C A A C Majority
                      14010               14020               14030               14040               14050
13839 A T A G C T C C C A T A G C A C C T A A A A T T G G T A T T A A A A G T A T A T T A A G C A C A A C 2603_ai2.seq
13840 A T A G C T C C C A T A G C A C C T A A A A T T G G T A T T A A A A G T A T A T T A A G C A C A A C 18rs21_ai2.seq
13752 A C A A T T A T C T T A A A G T C T T C A A C T C C A A T A A A A T A C C A C G A A A T A T C A G T 515_ai2.seq
13737 A T A G C T C C C A T A G C A C C T A A A A T T G G T A T T A A A A G T A T A T T A A G C A C A A C cjb111_ai2.seq
13777 A T A G C T C C C A T A G C A C C T A A A A T T G G T A T T A A A A G T A T A T T A A G C A C A A C h36b_ai2.seq

      A T T T G C C A C A A G T C C A A T A A C T G C A G A C A T T G T G T A - - - - A G C T T T T G T A Majority
                      14060               14070               14080               14090               14100
13889 A T T T G C C A C A A G T C C A A T A A C T G C A G A C A T T G T G T A - - - - A G C T T T T G T A 2603_ai2.seq
13890 A T T T G C C A C A A G T C C A A T A A C T G C A G A C A T T G T G T A - - - - A G C T T T T G T A 18rs21_ai2.seq
13802 T G C A G T C G C T A A T A A A T T A A T A C C T T G A A T T A A A T A G A A T A A T T G C C A T T 515_ai2.seq
13787 A T T T G C C A C A A G T C C A A T A A C T G C A G A C A T T G T G T A - - - - A G C T T T T G T A cjb111_ai2.seq
13827 A T T T G C C A C A A G T C C A A T A A C T G C A G A C A T T G T G T A - - - - A G C T T T T G T A h36b_ai2.seq

      C G T C T T G A A G C C A G T A G A T A C T G T G T C C C T A A A G C G T T A C C A T A A G A A A T Majority
                      14110               14120               14130               14140               14150
13935 C G T C T T G A A G C C A G T A G A T A C T G T G T C C C T A A A G C G T T A C C A T A A G A A A T 2603_ai2.seq
13936 C G T C T T G A A G C C A G T A G A T A C T G T G T C C C T A A A G C G T T A C C A T A A G A A A T 18rs21_ai2.seq
13852 C G T T T G T A A G T A A G A C A A A T C C A A A G A A T A A T A A C G T T G C T A T A G A T A C A 515_ai2.seq
13833 C G T C T T G A A G C C A G T A G A T A C T G T G T C C C T A A A G C G T T A C C A T A A G A A A T cjb111_ai2.seq
13873 C G T C T T G A A G C C A G T A G A T A C T G T G T C C C T A A A G C G T T A C C A T A A G A A A T h36b_ai2.seq

      G C A A A T G A T C A T C A A A G A C T C A A C - - - - - - - - - - - - A C C G A C A A C T T C A T Majority
                      14160               14170               14180               14190               14200
13985 G C A A A T G A T C A T - - - - - - - - - - - - - - - - - - - - - - - - - - - - - - - - - - - - - - 2603_ai2.seq
13986 G C A A A T G A T C A T - - - - - - - - - - - - - - - - - - - - - - - - - - - - - - - - - - - - - - 18rs21_ai2.seq
13902 G A G G C A A G T T T T A A T A C A A C T A A T - - - - - - - - - - - - T C C C A A A A T A T C T T 515_ai2.seq
13883 G C A A A T G A T C A T C A A A G A C T C A A C A G C C A T T A G C G G A C C G A C A A C T T C A T cjb111_ai2.seq
13923 G C A A A T G A T C A T C A A A G A C T C A A C A G C C A T T A G C G G A C C G A C A G C T T C A T h36b_ai2.seq

      A C C C T T T C C C A A A A A A G A A G A C - G C A - - - - - A A X X X X X X X X X X X X X X X X X Majority
                      14210               14220               14230               14240               14250
13997 - - - - - - - - - - - - - - - - - - - - - - - - C A - - - - - A A                                 2603_ai2.seq
13998 - - - - - - - - - - - - - - - - - - - - - - - - C A - - - - - A                                   18rs21_ai2.seq
13940 A C T T C T C T T A T A C T T A T T T G A C T G C A - - - - - C A A A A G C T A T C T C A C G A T T 515_ai2.seq
13933 A C C C T T T C C C A A A A A A G A A G A C A G C A A A T G T C G A C G A A A C T C C T A C C A C T cjb111_ai2.seq
13973 A C C C T T T C C C A A A A A A G A A G A C G G C A - - - - - A A                                   h36b_ai2.seq

      X X X X X X X X X X X X X X X X X X                                                                 Majority
                      14260
14000                                                                                                     2603_ai2.seq
14000                                                                                                     18rs21_ai2.seq
13985 A C C G T A     C A A A G A T A T C                                                                 515_ai2.seq
13983 C C C G C A A T C A T T A A C A T T                                                                 cjb111_ai2.seq
14000                                                                                                     h36b_ai2.seq
```

Decoration 'Decoration #1': Shade (with solid black) residues that differ from the Consensus.

FIGURE 20A

Alignment Report of Ai-2_alignment, using J. Hein method with Weighted residue weight table.
Thursday, July 29, 2004 6:48 PM

```
        GTTGCTTCATAAGTTGTCTGAAGGCCTAATTCTAAAGTCACATGCATTCT Majority
                 10        20        30        40        50
1       G------------------------------------------------- 2603_ai2.seq
1       GTTGCTTCATAAGTTGTCTGAAGGCCTAATTCTAAAGTCACATGCATTCT nem316_ai2.seq

        TTCAGAAAGTTCAGCGAGATAGTATATAGTTTCATCAGGTAAGCAATCCG Majority
                 60        70        80        90       100
2       -------------------------------------------------- 2603_ai2.seq
51      TTCAGAAAGTTCAGCGAGATAGTATATAGTTTCATCAGGTAAGCAATCCG nem316_ai2.seq

        GCCTTGTTCCGATGTTGATTCCGATAACTCCTGGCTCATTAATAGCCTGT Majority
                110       120       130       140       150
2       GCCTTGTTCCGATGTTGATTCCGATAACTCCTGGCTCATTAATAGCCTGT 2603_ai2.seq
101     GCCTTGTTCCGATGTTGATCCCGATAACTCCTGGCTCATTAATAGCCTGT nem316_ai2.seq

        TCGTAACGCTCTTTAATTATCTCTAACTTAGCATGGGTATTGGTAAAATT Majority
                160       170       180       190       200
52      TCGTAACGCTCTTTAATTATCTCTAACTTAGCATGGGTATTGGTAAAATT 2603_ai2.seq
151     TCGTAACGCTCTTTAATTATCTCTAACTTAGCATGGGTATTGGTAAAATT nem316_ai2.seq

        TTGAAAATAGACTAAGTATTTATTAACCTCGGGCCACTTTCTATGCATGA Majority
                210       220       230       240       250
102     TTGAAAATAGACTAAGTATTTATTAACCTCAGGCCACTTTCTATGCATGA 2603_ai2.seq
201     TTGAAAATAGACTAAGTATTTATTAACCTCGGGCCACTTTCTATGCATGA nem316_ai2.seq

        AATCAATTTCTTTATAGAATTGTTCACGAATAGGAGCTTCTGGAGCAACT Majority
                260       270       280       290       300
152     AATCAATTTCTTTATAGAATTGTTCACGAATAGGAGCTTCTGGAGCAACT 2603_ai2.seq
251     AATCAATTTCTTTATAGAATTGTTCACGAATAGGAGCTTCTGGAGCAACT nem316_ai2.seq

        ATAGCATCCCCTGAACCAGAAACTGTGCAAAAAGTGCATCCTCCTCTAGC Majority
                310       320       330       340       350
202     ATAGCATCCCCTGAACCAGAAACTGTGCAAAAAGTGCACCCTCCTCTAGC 2603_ai2.seq
301     ATAGCATCCCCTGAACCAGAAACTGTGCAAAAAGTGCATCCTCCTCTAGC nem316_ai2.seq

        AACTGTTCCGTCTCTGTTAGGACAGTCAAAACCAGCATCTATAGGTAATT Majority
                360       370       380       390       400
252     AACTGTTCCGTCTCTGTTAGGACAGTCAAAACCAGCATCTATAGGTAATT 2603_ai2.seq
351     AACTGTTCCGTCTCTGTTAGGACAGTCAAAACCAGCATCTATAGGTAATT nem316_ai2.seq

        TAAATATTTTTTCTCCAAAGAGTTCTCGATAATAATCATTAATCGCACGA Majority
                410       420       430       440       450
302     TAAATATTTTTTCTCCAAAGAGTTCTCGATAATAATCATTAATCGCACGA 2603_ai2.seq
401     TAAATATTTTTTCTCCAAAGAGTTCTCGATAATAATCATTAATCGCACGA nem316_ai2.seq

        TAACGTTTTTTCATAGGATAATTGTATCACAATTTTAACTAAAATAACCT Majority
                460       470       480       490       500
352     TAACGTTTTTTCATAGGATAATTGTATCACAATTTTAACTAAAATAACCT 2603_ai2.seq
451     TAACGTTTTTTCATAGGATAATTGTATCACAATTTTAACTAAAATAACCT nem316_ai2.seq

        CACTACTACAATAAAACTTAAAAAGATTGGAACGTCAGTTAGTCCCAATC Majority
                510       520       530       540       550
402     CACTACTACAATAAAACTAAAAAAGATTGGAACGTCAGTTAGTCCCAATC 2603_ai2.seq
501     CACTACTACAATAAAACTTAAAAAGATTGGAACGTCAGTTAGTCCCAATC nem316_ai2.seq

        TTTTATTTACTTCACTTTCTTTAACCAATCCTTGGCTAAAAAGATATACG Majority
                560       570       580       590       600
452     TTTTATTTACTTCACTTTCTTTAACCAATCCTTGGCTAAAAAGATATACG 2603_ai2.seq
551     TTTTATTTACTTCACTTTCTTTAACCAATCCTTGGCTAAAAAGATATACG nem316_ai2.seq

        CAGTTAGATTCAAAATACCATAAGCAAGTATAAAACCAGCTAAAACATCT Majority
                610       620       630       640       650
502     CAGTTAGATTCAAAATACCATAAGCAAGTATAAAACCAGCTAAAACATCT 2603_ai2.seq
601     CAGTTAGATTCAAAATACCATAAGCAAGTATAAAACCAGCTAAAACATCT nem316_ai2.seq
```

FIGURE 20B

Alignment Report of Ai-2_alignment, using J. Hein method with Weighted residue weight table.
Thursday, July 29, 2004 6:46 PM

```
     GTCGGAAAATGAACCCCTAGGTAAATACGAGATAACCCAATTAAAAAAAT Majority
              660       670       680       690       700
552  GTCGGAAAATGAACCCCTAGGTAAATACGAGATAACCCAATTAAAAAAAT 2603_ai2.seq
651  GTCGGAAAATGAACCCCTAGGTAAATACGAGATAACCCAATTAAAAAAAT nem316_ai2.seq

     GAGCAAACCCAAAGTACCTTGGCACAACAGTTTCCATATACTCTTAGGCA Majority
              710       720       730       740       750
602  GAGCAAACCCAAAGTACCTTGGCACAACAGTTTCCATATACTCTTAGGCA 2603_ai2.seq
701  GAGCAAACCCAAAATACCTTGGCACAACAGTTTCCATATACTCTTAGGCA nem316_ai2.seq

     TATAGTACTGCAATAAAATAATAATACTCCCAAATATCATAAATGTTCCC Majority
              760       770       780       790       800
652  TATAGTACTGCAATAAAATAATAATACTCCCAAATATCATAAATGTTCCC 2603_ai2.seq
751  TATAGTACTGCAATAAAATAATAATACTCCCAAATATCATAAATGTTCCC nem316_ai2.seq

     ATCGAGTGCCCACTGGGAAACGAATAGCCACCTGCAAATACTAAATGGGT Majority
              810       820       830       840       850
702  ATCGAGTGCCCACTGGGAAACGAATAGCCACCTGCAAATACTAAATGGGT 2603_ai2.seq
801  ATCGAGTGCCCACTGGGAAACGAATAGCCACCTGCAAATACTAAATGGGT nem316_ai2.seq

     TAAAGTTGGTCTTACTCTTTGAAAAATAAGTTTTAAAGAAAGTATACATA Majority
              860       870       880       890       900
752  TAAAGTTGGTCTTACTCTTTGAAAAATAAGTTTTAAAGAAAGTATACATA 2603_ai2.seq
851  TAAAGTTGGTCTCACTCTTTGAAAAATAAGTTTTAAAGAAAGTATACATA nem316_ai2.seq

     TACCAGAGATAATAGCATTTACTGCGATAAATCTAGCTTGAGGATACCAC Majority
              910       920       930       940       950
802  TACCAGAGATAATAGCATTTACTGCGATAAATCTAGCTTGAGGATACCAC 2603_ai2.seq
901  TACCAGAGATAATAGCATTTACTGCGATAAATCTAGCTTGAGGATACCAC nem316_ai2.seq

     TTCTTAAGGTAACAGAAAGTGACGCTCATAATCGCAATAGCTATCTGGCT Majority
              960       970       980       990       1000
852  TTCTTAAGGTAACAGAAAGTGACGCTCATAATCGCAATAGCTATCTGGCT 2603_ai2.seq
951  TTCTTAAGGTAACAGAAAGTGACGCTCATAATCGCAATAGCTATCTGGCT nem316_ai2.seq

     TACAGTATTACCAATCACAGTGATTAACTTGAAAAATCTTGTAGAAAGAT Majority
              1010      1020      1030      1040      1050
902  TACAGTATTACCAATCACAGTGATTAACTTGAAAAATCTTGTAGAAAGAT 2603_ai2.seq
1001 TACAGTATTACCAATCACAGTGATTAACTTGAAAAATCTTGTAGAAAGAT nem316_ai2.seq

     TTGGCAACTGTCCTCTAACACTTTCTTGAATGTTTTGGTCAAATGCAATT Majority
              1060      1070      1080      1090      1100
952  TTGGCAACTGTCCTCTAACACTTTCTTGAATAGTTTGGTCAAATGAAATT 2603_ai2.seq
1051 TTGGCAACTGTCCTCTAACACTTTCTTGAATGTTTTGGTCAAATGCAATT nem316_ai2.seq

     ACAGTGTCGGGCCAATATTTGATGACCAATCCTAAACTGAAAAATAAGAT Majority
              1110      1120      1130      1140      1150
1002 ACAGTGTCGGGCCAATATTTGATGACCAATCCTAAACTGAAAAATAAGAT 2603_ai2.seq
1101 ACAGTGTCGGGCCAATATTTGATGACCAATCCTAAACTGAAAAATAAGAT nem316_ai2.seq

     AATAGCAATAAATGCTTGAATAAGTTTACTATTTTGACGAGATAACATTA Majority
              1160      1170      1180      1190      1200
1052 AATAGCAATAAATGCTTGAATAAGTTTACTATTTTGACGAGATAACATTA 2603_ai2.seq
1151 AATAGCAATAAATGCTTGAATAAGTTTACTATTTTGACGAGATAACATTA nem316_ai2.seq

     GTCTTTTTATATCTTTCTAATATTGGCAAACAAGCCACGTAAGTTAGATA Majority
              1210      1220      1230      1240      1250
1102 GTCTTTTTATATCTTTCTAATATTGGCAAACAAGCCACGTAAGTTAGATA 2603_ai2.seq
1201 GTCTTTTTATATCTTTCTAATATTGGCAAACAAGCCACGTAAGTTAGATA nem316_ai2.seq

     GAAAACAATCGAAATTAAAATTCCCTCAACGATATTAAATGGAATAACCA Majority
              1260      1270      1280      1290      1300
1152 GAAAACAATCGAAATTAAAATTCCCTCAACGATATTAAATGGAATAACCA 2603_ai2.seq
1251 GAAAACAATCGAAATTAAAATTCCCTCAACGATATTAAATGGAATAACCA nem316_ai2.seq
```

FIGURE 20C

Alignment Report of Ai-2_alignment, using J. Hein method with Weighted residue weight table.
Thursday, July 29, 2004 6:46 PM T T G T T A A A A G G T A A T T G C C T A C A C C A A T A A A T G T T C T G A T A T C A A A G T T A Majority
1310 1320 1330 1340 1350
1202 T T G T T A A A A G G T A A T T G C C T A C A C C A A T A A A T G T T C T G A T A T C A A A G T T A 2603_ai2.seq
1301 T T G T T A A A A G G T A A T T G C C T A C A C C A A T A A A T G T T C T G A T A T C A A A G T T A nem316_ai2.seq G C A A A T A T A G C A T A C A A A G G A A T C G C A A A G A C A T A G T T G A G A G C T A C C A T Majority
1360 1370 1380 1390 1400
1252 G C A A A T A T A G C A T A C A A A G G A A T C G C A A A G A C A T A G T T G A G A G C T A C C A T 2603_ai2.seq
1351 G C A A A T A T A G C A T A C A A A G G A A T C G C A A A G A C A T A G T T G A G A G C T A C C A T nem316_ai2.seq A G A T A C G G T C A A G C T A A C T G T A C C A A A T A G A C T A G C T T T A A T A A A A T C T T Majority
1410 1420 1430 1440 1450
1302 A G A T A C G G T C A A G C T A A C T G T A C C A A A T A G A C T A G C T T T A A T A A A A T C T T 2603_ai2.seq
1401 A G A T A C A G T C A A G C T A A C T G T A C C A A A T A G A C T A G C T T T A A T A A A A T C T T nem316_ai2.seq T T G C A C T C T C T C T A T T T T T C C A G A A A A T A G C G A A A C T T G C T A A A A A T A A A Majority
1460 1470 1480 1490 1500
1352 T T G C A C T C T C T C T A T T T T T C C A G A A A A T A G C G A A A C T T G C T A A A A A T A A A 2603_ai2.seq
1451 T T G C A C T C T C T C T A T T T T T C C A G A A A A T A G C G A A A C T T G C T A A A A A T A A A nem316_ai2.seq G C T A G A G C A A C C A T A T T C A T C G G T A A A C C G A T A A A G G T T T C T G G A C C A C G Majority
1510 1520 1530 1540 1550
1402 G C T A G A G C A A C C A T A T T C A T C G G T A A A C C A A T A A A C G T T T C T G G A C C A C G 2603_ai2.seq
1501 G C T A G A G C A A C C A T A T T C A T C G G T A A A C C G A T A A A G G T T T C T G G A C C A C G nem316_ai2.seq A T T A G C A A G T A T A A C T T T T A A A A G T G A T C T T A A T A A G A G T A C A C C A T A A C Majority
1560 1570 1580 1590 1600
1452 A T T A G C A A G T A T A A C T T T T A A A A G T G A T C T T A A T A A G A G T A C A C C A T A A C 2603_ai2.seq
1551 A T T A G C A A G T A T A A C T T T T A A A A G T G A T C T T A A T A A G A G T A C A C C A T A A C nem316_ai2.seq T T G A T T T C A A A T C A A A T A A A A T A A A A G C A A C T A A C A T C G G A A G G A T T G A A Majority
1610 1620 1630 1640 1650
1502 T T G A T T T C A A A T C A A A T A A A A T A A A A G C A A C T A A C A T C G G A A G G A T T G A A 2603_ai2.seq
1601 T T G A T T T C A A A T C A A A T A A A A T A A A A G C A A C T A A C A T C G G A A G G A T T G A A nem316_ai2.seq A A A T C A A C C T T T A A A A A T T C T G C T C C T G G T A T T A A T G G A A A T G A A A C C A T Majority
1660 1670 1680 1690 1700
1552 A A A T C A A C C T T T A A A A A T T C T G C T C C T G G T A T T A A T G G A A A T G A A A C C A T 2603_ai2.seq
1651 A A A T C A A C C T T T A A A A A T T C T G C T C C T G G T A T T A A T G G A A A T G A A A C C A T nem316_ai2.seq C A T C A A T A C A A A A G A T A A G G C A G A A A G A A T G G C G A T T G T C A C C A T T T T A C Majority
1710 1720 1730 1740 1750
1602 C A T C A A T A C A A A A G A T A A G G C A G A A A G A A T G G C G A T T G T C A C C A T T T T A C 2603_ai2.seq
1701 C A T C A A T A C A A A A G A T A A G G C A G A A A G A A T G G C G A T T G T C A C C A T T T T A C nem316_ai2.seq G T G T A T T T G T C A T A A A A A A A T T C C T C C A A T T T A A A T A A A T T G A A A G A A G C Majority
1760 1770 1780 1790 1800
1652 G T G T A T T T G T C A T A A A A A A A T T C C T C C A A T T T A A A T A A A T T G A A A G A A G C 2603_ai2.seq
1751 G T G T A T T T G T C A T A A A A A A A T T C C T C C A A T T T A A A T A A A T T G A A A G A A G C nem316_ai2.seq T C C A A A G G T A A G C G T A T G T A C G C G A A A A A A A C C T T T G T C T T C T C C C A T C C Majority
1810 1820 1830 1840 1850
1702 T C C A A A G G T A A G C G T A T G T A C G C G A A A A A A - C C T T T G T C T T C T C C C A T C C 2603_ai2.seq
1801 T C C A A A G G T A A G C G T A G G T A C G C G A A A A A A A C C T T T G T C T T C T C C C A T C C nem316_ai2.seq A G A C T T T A C T G T C G G T T G T G G A A T C T C A C C A C A T C A G C T T T C G C T C G C G G Majority
1860 1870 1880 1890 1900
1751 A G A C T T T A C T G T C G G T T G T G G A A T C T C A C C A C A T C A G C T T T C G C T C G C G G 2603_ai2.seq
1851 A G A C T T T A C T G T C G G T T G T G G A A T C T C A C C A C A T C A G C T T T C G C T C G C G G nem316_ai2.seq A C T G A T G C T T C A C A A C T G A C A A A T A A G T T G G A A G C G A T T A C C G C C G G T C G Majority
1910 1920 1930 1940 1950
1801 A C T G A T G C T T C A C A A C T G A C A A A T A A G T T G G A A G C G A T T A C C G C C G G T C G 2603_ai2.seq
1901 A C T G A T G C T T C A C A A C T G A C A A A T A A G T T G G A A G C G A T T A C C G C C G G T C G nem316_ai2.seq

FIGURE 20D

Alignment Report of Ai-2_alignment, using J. Hein method with Weighted residue weight table.
Thursday, July 29, 2004 6:46 PM

```
     GGAATTACACCCTGCCCTGAAGACACCTATAGCATAACAAAAAAAACTTG Majority
              1960      1970      1980      1990      2000
1851 GGAATTACACCCTGCCCTGAAGACACCTATAGCATAACAAAAAAAACTTG 2603_ai2.seq
1951 GGAATTACACCCTGCCCTGAAGACACCTATAGCATAACAAAAAAAACTTG nem316_ai2.seq

     CAATTGCAAGTTTTTTAATTACTAATTAGTAGTAGTGATTAAAAATCATA Majority
              2010      2020      2030      2040      2050
1901 CAATTGCAAGTTTTTTAATTACTAATTAGTAGTAGTGATTAAAAATCATA 2603_ai2.seq
2001 CAATTGCAAGTTTTTTAATTACTAATTAGTAGTAGTGATTAAAAATCATA nem316_ai2.seq

     TTAATACCAAATTACTATGCTGTATCGTTTCTTTCAGATTTGCTATTTTT Majority
              2060      2070      2080      2090      2100
1951 TTAATACCAAATTACTATACTGTATCGTTTCTTTCAGATTTGCTATTTTT 2603_ai2.seq
2051 TTAATACCAAATTACTATGCTGTATCGTTTCTTTCAGATTTGCTATTTTT nem316_ai2.seq

     AGTTTTTCTTAAAAAGATAAACAAAATTCCCAAAATAATACAACCAAGAA Majority
              2110      2120      2130      2140      2150
2001 AGTTTTTCTTAAAAAGATAAACAAAATTCCCAAAATAATACAACCAAGAA 2603_ai2.seq
2101 AGTTTTTCTTAAAAAGATAAACAAAATTCCCAAAATAATACAACCAAGAA nem316_ai2.seq

     TTGTCAGTCCTCCACCAATAATCATTCCTGTTTTAGGAAGAAATGATTGT Majority
              2160      2170      2180      2190      2200
2051 TTGTCAGTCCTCCACCAATAATCATTCCTGTTTTAGGAAGAAATGATTGT 2603_ai2.seq
2151 TTGTCAGTCCTCCACCAATAATCATTCCTGTTTTAGGAAGAAATGATTGT nem316_ai2.seq

     GGAAAAAGCGGTTGTGATGGTTTAGGATTTGTTGGTGGAGGAGTTTCTTT Majority
              2210      2220      2230      2240      2250
2101 GGAAAAAGCGGTTGTGATGGTTTAGGATTTGTTGGTGGAGGAGTTTCTTT 2603_ai2.seq
2201 GGAAAAAGCGGTTGTGATGGTTTAGGATTTGTTGGTGGAGGAGTTTCTTT nem316_ai2.seq

     TTCGTTTTCTACCTCTACTTCCTGTGTTTTATTAGCAACTACAGCAACTA Majority
              2260      2270      2280      2290      2300
2151 TTCGTTTTCTACCTCTACTTCCTGTGTTTTATTAGCAACTACAGCAACTA 2603_ai2.seq
2251 TTCGTTTTCTACCTCTACTTCCTGTGTTTTATTAGCAACTACAGCAACTA nem316_ai2.seq

     CAGCATCCTTCATAGATATACGGTAACCAGTTAGTGCTTTTGCTTCTCGA Majority
              2310      2320      2330      2340      2350
2201 CAGCATCCTTCATAGATATACGGTAACCAGTTAGTGCTTTTGCTTCTCGA 2603_ai2.seq
2301 CAGCATCCTTCATAGATATACGGTAACCAGTTAGTGCTTTTGCTTCTCGA nem316_ai2.seq

     AAAATATACTTACCAGGTAATAAACCTTCAACCTCAATTTCTCCCTTATC Majority
              2360      2370      2380      2390      2400
2251 AAAATATACTTACCAGGTAATAAACCTTCAACCTCAATTTCTCCCTTATC 2603_ai2.seq
2351 AAAATATACTTACCAGGTAATAAACCTTCAACCTCAATTTCTCCCTTATC nem316_ai2.seq

     ATCAGTTACTAATGAAGTAATCCCATCTTGATCGGTCGTAAATCGTCCAT Majority
              2410      2420      2430      2440      2450
2301 ATCAGTTACTAATGAAGTAATCCCATCTTGATCGGTCGTAAATCGTCCAT 2603_ai2.seq
2401 ATCAGTTACTAATGAAGTAATCCCATCTTGATCGGTCGTAAATCGTCCAT nem316_ai2.seq

     TTTTAAAGCGAACTGGCTGATTCTGGTTATCGTATAATACAAATATTACT Majority
              2460      2470      2480      2490      2500
2351 TTTTAAAGCGAACTGGCTGATTCTGGTTATCGTATAATACAAATATTACT 2603_ai2.seq
2451 TTTTAAAGCGAACTGGCTGATTCTGGTTATCGTATAATACAAATATTACT nem316_ai2.seq

     CCTGATAGCCTTTTCTTTATCTTTCCTTCTTTTGTATATTTAATAAGTTT Majority
              2510      2520      2530      2540      2550
2401 CCGGATAGCCTTTTCTTTATCTTTCCTTCTTTTGTATATTTAATAAGTTT 2603_ai2.seq
2501 CCTGATAGCCTTTTCTTTATCTTTCCTTCTTTTGTATATTTAATAAGTTT nem316_ai2.seq

     TAATCGGCCTGTTTCAACTTTTCGCTTAGGATTTATCTGTAATTGATTTG Majority
              2560      2570      2580      2590      2600
2451 TAATCGGCCTGTTTCAACTTTTCGCTTAGGATTTATCTGTAATTGATTTG 2603_ai2.seq
2551 TAATCGGCCTGTTTCAACTTTTCGCTTAGGATTTATCTGTAATTGATTTG nem316_ai2.seq
```

FIGURE 20E

Alignment Report of Ai-2_alignment, using J. Hein method with Weighted residue weight table.
Thursday, July 29, 2004 6:46 PM

```
     A T A A C T T A T C A T C T G G T A T T T C A A T A T A A A A A G G T A C T A T T G T T G A A A C G Majority
                   2610                2620                2630                2640                2650
2501 A T A A C T T A T C A T C T G G T A A T T C A A T A T A A A A A G G T A C T A T T G T T G A A A C G 2603_ai2.seq
2601 A T A A C T T A T C A T C T G G T A T T T C A A T A T A A A A A G G T A C T A T T G T T G A A A C G nem316_ai2.seq

     C T T T G A T C A G C T T T A T A A G C A C G A C C A A A G T A C G A A C C A T T T G G G A G T G C Majority
                   2660                2670                2680                2690                2700
2551 C T T T G A T C A G C T T T A T A A G C A C G A C C A A A G T A C G A A C C A T T T G G G A G T G C 2603_ai2.seq
2651 C T T T G A T C A G C T T T A T A A G C A C G A C C A A A G T A C G A A C C A T T T G G G A G T G C nem316_ai2.seq

     T A T C T T T G T C T G A C C A T T A G T A T C A G T A G G A G A A G T C A A G A T A C T C T T A T Majority
                   2710                2720                2730                2740                2750
2601 T A T C T T T G T C T G A C C A T T A G T A T C A G T A G G A G A A G T C A A G A T A C T C T T A T 2603_ai2.seq
2701 T A T C T T T G T C T G A C C A T T A G T A T C A G T A G G A G A A G T C A A G A T A C T C T T A T nem316_ai2.seq

     A C T T C T G G T T C A A T T C G C T A T C T G T C A T T T G G C T C A A T A A A T C A A C T T T T Majority
                   2760                2770                2780                2790                2800
2651 A C T T C T G G T T C A A T T C G C T A T C T G T C A T T T G G C T C A A T A A A T C A A C T T T T 2603_ai2.seq
2751 A C T T C T G G T T C A A T T C G C T A T C T G T C A T T T G G C T C A A T A A A T C A A C T T T T nem316_ai2.seq

     A A G T T G T C A G T C A C A G T C C A T A A A C G A T A A G A A A T C C C C T C C T C T G T A G T Majority
                   2810                2820                2830                2840                2850
2701 A A G T T G T C A G T C A C A G T C C A T A A A C G A T A A G A A A T C C C C T C C T C T G T A G T 2603_ai2.seq
2801 A A G T T G T C A G T C A C A G T C C A T A A A C G A T A A G A A A T C C C C T C C T C T G T A G T nem316_ai2.seq

     A T T T G G C T G A A G T C C T A T C T G T G T G A T T G T T A G T T G A T T A G G G G T A T C A G Majority
                   2860                2870                2880                2890                2900
2751 A T T T G G C T G A A G T C C T A T C T G T G T G A T T G T T A G T T G A T T A G G G G T A T C A G 2603_ai2.seq
2851 A T T T G G C T G A A G T C C T A T C T G T G T G A T T G T T A G T T G A T T A G G G G T A T C A G nem316_ai2.seq

     C A T T T A C A C T G G C T A C C G A A A A A A A C G C T A A T T G T A C C A A T C C T A A A A A G Majority
                   2910                2920                2930                2940                2950
2801 C A T T T A C A C T G G C T A C C G A A A A A A A C G C T A A T T G T A C C A A T C C T A A A A A G 2603_ai2.seq
2901 C A T T T A C A C T G G C T A C C G A A A A A A A C G C T A A T T G T A C C A A T C C T A A A A A G nem316_ai2.seq

     C A A C A T A G T A G A A G T C C T A A A C T T T T T C T A A T C T T T T T C A T T T T T G A T T T Majority
                   2960                2970                2980                2990                3000
2851 C A A C A T A G T A G A A G T C C T A A A C T T T T T C T A A T C T T T T T C A T T T T T G A T T T 2603_ai2.seq
2951 C A A C A T A G T A G A A G T C C T A A A C T T T T T C T A A T C T T T T T C A T T T T T G A T T T nem316_ai2.seq

     C C C T T T C T T T T T C T C T C T T T A A A T T T T C G T T T T A A A T A T A A T A G T A A A G C Majority
                   3010                3020                3030                3040                3050
2901 C C C T T T C T C T T T C T C T C T T T A A A T T T T C G T T T T A A A T A T A A T A G T A A A G C 2603_ai2.seq
3001 C C C T T T C T T T T T C T C T C T T T A A A T T T T C G T T T T A A A T A T A A T A G T A A A G C nem316_ai2.seq

     G A C T A A T A T A A G A A T A A C T A G G A T T G A T A A G A G G A A A T A A A G T T T A T A G T Majority
                   3060                3070                3080                3090                3100
2951 G A C T A A T A T A A G A A T A A C T A G G A T T G A T A A G A G G A A A T A A A G T T T A T A G T 2603_ai2.seq
3051 G A C T A A T A T A A G A A T A A C T A G G A T T G A T A A G A G G A A A T A A A G T T T A T A G T nem316_ai2.seq

     G T G T T T G C A A T T C T T T C A T T A A A T A G T T C T T T T C T T T A A C A G G A G G T A C A Majority
                   3110                3120                3130                3140                3150
3001 G T G T T T G C A A T T C T T T C A T T A A A T A G T T C T T T T C T T T A A C A G G A G G T A C A 2603_ai2.seq
3101 G T G T T T G C A A T T C T T T C A T T A A A T A G T T C T T T T C T T T A A C A G G A G G T A C A nem316_ai2.seq

     T A C T T G A T T C G A T G C C C T C T A A C T A G T A A A C G A T G T G A A T T A A T C G A A T A Majority
                   3160                3170                3180                3190                3200
3051 T A C T T G A T T C G A T G C C C T C T A A C T A G T A A A C G A T G T G A A T T A A T C G A A T A 2603_ai2.seq
3151 T A C T T G A T T C G A T G C C C T C T A A C T A G T A A A C G A T G T G A A T T A A T C G A A T A nem316_ai2.seq

     A G G T G T A C A T G T T A G C A A A G T C G C A T A A T C C T T A C C T T T A A C A A C C A A T A Majority
                   3210                3220                3230                3240                3250
3101 A G G T G T A C A T G T T A G C A A A G T C G C A T A A T C C T T A C C T T T A A C A A C C A A T A 2603_ai2.seq
3201 A G G T G T A C A T G T T A G C A A A G T C G C A T A A T C C T T A C C T T T A A C A A C C A A T A nem316_ai2.seq
```

FIGURE 20F

Alignment Report of Ai-2_alignment, using J. Hein method with Weighted residue weight table.
Thursday, July 29, 2004 6:47 PM

```
      A T T T A G A A A A A T T A T C T G G C T T T A C A A C A C T T A T T T G A T C A A C C T T A T A G  Majority
                  3260             3270            3280            3290            3300
3151  A T T T A G A A A A A T T A T C T G G C T T T A C A A C A C T T A T T T G A T C A A C C T T A T A G  2603_ai2.seq
3251  A T T T A G A A A A A T T A T C T G G C T T T A C A A C A C T T A T T T G A T C A A C C T T A T A G  nem316_ai2.seq

      G C T A A A A C T T C T T T G A T A T T A T G A A T A T A A A A A A T T T T T C C T T T T T T A A G  Majority
                  3310             3320            3330            3340            3350
3201  G C T A A A A C T T C T T T G A T A T T A T G A A T A T A A A A A A T T T T T C C T T T T T T A A G  2603_ai2.seq
3301  G C T A A A A C T T C T T T G A T A T T A T G A A T A T A A A A A A T T T T T C C T T T T T T A A G  nem316_ai2.seq

      T T T A T C T A A A T C T G T A A A T A A C T T A G C T T T A G G T A A G C C G C G A T G A G C T G  Majority
                  3360             3370            3380            3390            3400
3251  T T T A T C T A A A T C T G T A A A T A A C T T A G C T T T A G G T A A G C C G C G A T G A G C T G  2603_ai2.seq
3351  T T T A T C T A A A T C T G T A A A T A A C T T A G C T T T A G G T A A G C C G C G A T G A G C T G  nem316_ai2.seq

      T G A T A A C A G T A T G T G A A C T T T T T C C A C C A A T T G G C A A G G A G G T T C C T T C A  Majority
                  3410             3420            3430            3440            3450
3301  T G A T A A C A G T A T G T G A A C T T T T T C C A C C A A T T G G C A A G G A G G T T C C T T C A  2603_ai2.seq
3401  T G A T A A C A G T A T G T G A A C T T T T T C C A C C A A T T G G C A A A G A A G T T C C T T C A  nem316_ai2.seq

      A G G T G T C C T G C T C C T T T T T C A A G A A C A C T A C T G G T A G T C C C C G C A T A G A T  Majority
                  3460             3470            3480            3490            3500
3351  A G G T G T C C T G C T C C T T T T T C A A G A A C A C T A C T G G T A G T C C C C G C A T A G A T  2603_ai2.seq
3451  A G G T G T C C T G C T C C T T T T T C A A G A A C A C T A C T G G T A G T C C C C G C A T A G A T  nem316_ai2.seq

      A G G T A A T T T T T G C T T G A T A G A C G G T A T A T C A A T A T A T C C A A T C A T T T C A G  Majority
                  3510             3520            3530            3540            3550
3401  A G G T A A T T T T T G C T T G A T A G A C G G T A T A T C A A T A T A T C C A A T C A T T T C A G  2603_ai2.seq
3501  A G G T A A T T T T T G C T T G A T A G A C G G T A T A T C A A T A T A T C C A A T C A T T T C A G  nem316_ai2.seq

      T A A T C T C A A G C A T G T G G G C G T A T T C A G C A A T A C C T T T T T T T T C T T T T T C A  Majority
                  3560             3570            3580            3590            3600
3451  C A A T C T C A A G C A T G T G G G C G T A T T C A G C A A T A C C T T T T T T T T C T T T T T C A  2603_ai2.seq
3551  T A A T C T C A A G C A T A T G G G C G T A T T C A G C A A T A C C T T T T T T T T C T T T T T C A  nem316_ai2.seq

      G T A T A G G G A T C T G A T A G G C G G C T T G G G T C C A G T G T T C T A T T A T A A G C T T T  Majority
                  3610             3620            3630            3640            3650
3501  G T A T A G G G A T C T G A T A G G C G G C T T G G G T C C A G T G T T C T A T T A T A A G C T T T  2603_ai2.seq
3601  G T A T A G G G A T C T G A T A G G C G G C T T G G G T C C A G T G T T C T A T T A T A A G C T T T  nem316_ai2.seq

      T G C T A A C T C A A A T C G T C T A T T A A T C T C T T T A G T A T T T A A T T T T T G G G T T T  Majority
                  3660             3670            3680            3690            3700
3551  T G C T A A C T C A A A T C G T C T A T T A A T C T C T T T A G T A T T T A A T T T T T G G G T T T  2603_ai2.seq
3651  T G C T A A C T C A A A T C G T C T A T T A A T C T C T T T A G C A T T T A A T T T T T G G G T T T  nem316_ai2.seq

      G A T T A T C A A A G T T A G T T A C T T G A T T A T T A G C T T T A A T A T T A T A G T A C C A A  Majority
                  3710             3720            3730            3740            3750
3601  G A T T A T C A A A G T T A G T T A C T T G A T T A T T A G C T T T A A T A T T A T A G T A C C A A  2603_ai2.seq
3701  G A T T A T C A A A G T T A G T T A C T T G A T T A T T A G C T T T A A T A T T A T A G T A C C A A  nem316_ai2.seq

      T T T G A A A T A A A A G G A T A T G A G G T T A T C A A A A G A C C A A C T A A G A A C A A T A G  Majority
                  3760             3770            3780            3790            3800
3651  T T T G A A A T A A A A G G A T A T G A G G T T A T C A A A A G A C C A A C T A A G A A C A A T A G  2603_ai2.seq
3751  T T T G A A A T A A A A G G A T A T G A G G T T A T C A A A A G A C C A A C T A A G A A C A A T A G  nem316_ai2.seq

      T A T C A G G C C T A C A T T C A T C C A T C G A T T T A A A A C G A C C G A T T T C T T A A G G T  Majority
                  3810             3820            3830            3840            3850
3701  T A T C A A G C C T A C A T T C A T C C A T C G A T T T A A A A C G A C C G A T T T C T T A A G G T  2603_ai2.seq
3801  T A T C A G G C C T A C A T T C A T C C A T C G A T T T A A A A C G A C C G A T T T C T T A A G G T  nem316_ai2.seq

      T T T T C T G A A A T T T T C C T C C C A T T A T G A T T C A A T T C C T T T T C T A A C A C T T G  Majority
                  3860             3870            3880            3890            3900
3751  T T T T C T G A A A T T T T C C T C C C A T T A T G A T T C A A T T C C T T T T C T A A C A C T T G  2603_ai2.seq
3851  T T T T C T G A A A T T T T C C T C C C A T T A T G A T T C A A T T C C T T T T C T A A C A C T T G  nem316_ai2.seq
```

FIGURE 20G

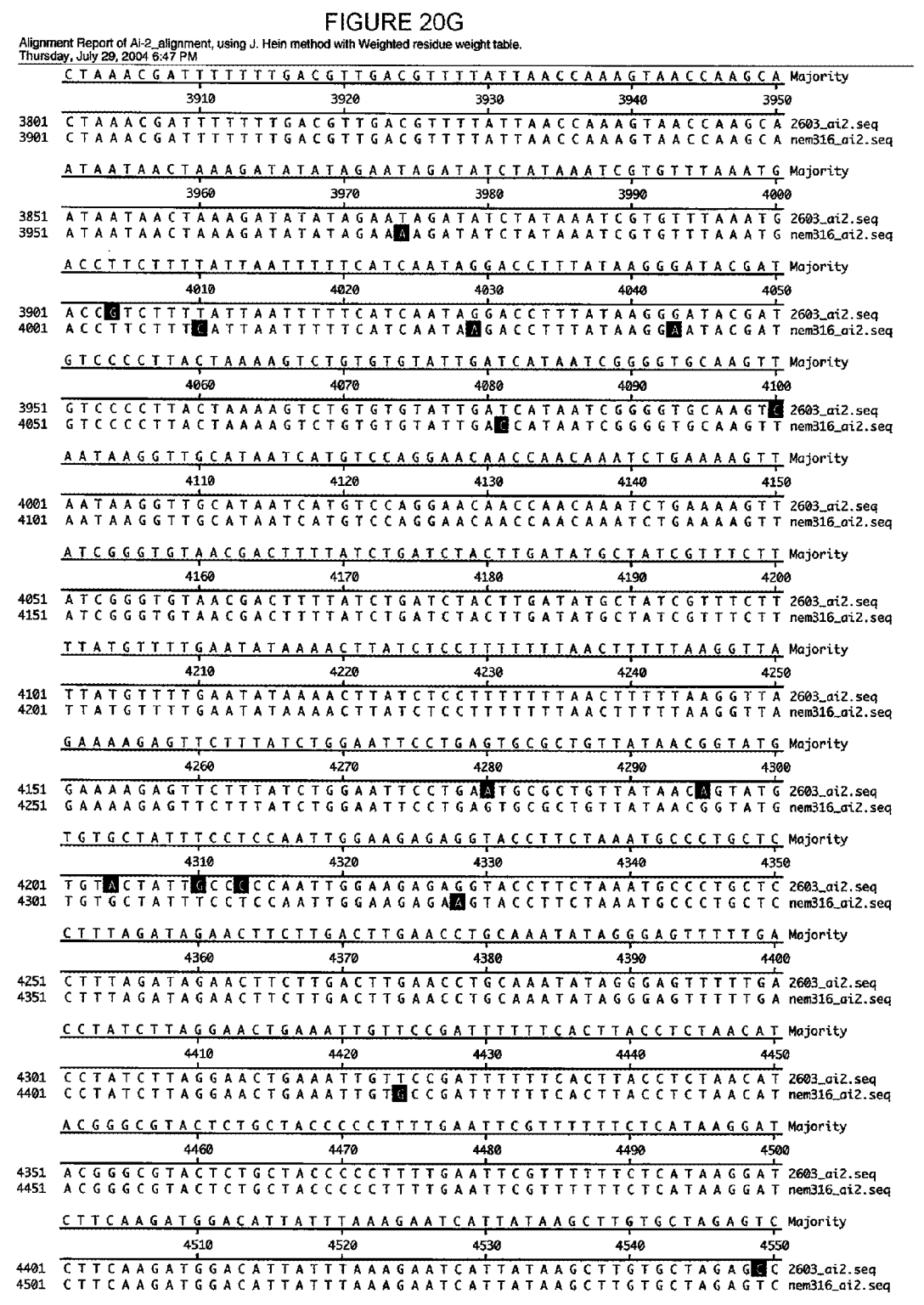

Alignment Report of AI-2_alignment, using J. Hein method with Weighted residue weight table.
Thursday, July 29, 2004 6:47 PM

```
     C T A A A C G A T T T T T T T G A C G T T G A C G T T T T A T T A A C C A A A G T A A C C A A G C A Majority
                   3910                3920                3930                3940                3950
3801 C T A A A C G A T T T T T T T G A C G T T G A C G T T T T A T T A A C C A A A G T A A C C A A G C A 2603_ai2.seq
3901 C T A A A C G A T T T T T T T G A C G T T G A C G T T T T A T T A A C C A A A G T A A C C A A G C A nem316_ai2.seq

     A T A A T A A C T A A A G A T A T A T A G A A T A G A T A T C T A T A A A T C G T G T T T A A A T G Majority
                   3960                3970                3980                3990                4000
3851 A T A A T A A C T A A A G A T A T A T A G A A T A G A T A T C T A T A A A T C G T G T T T A A A T G 2603_ai2.seq
3951 A T A A T A A C T A A A G A T A T A T A G A A A A G A T A T C T A T A A A T C G T G T T T A A A T G nem316_ai2.seq

     A C C T T C T T T T A T T A A T T T T T C A T C A A T A G G A C C T T T A T A A G G G A T A C G A T Majority
                   4010                4020                4030                4040                4050
3901 A C C G T C T T T T A T T A A T T T T T C A T C A A T A G G A C C T T T A T A A G G G A T A C G A T 2603_ai2.seq
4001 A C C T T C T T T C A T T A A T T T T T C A T C A A T A A G A C C T T T A T A A G G A A T A C G A T nem316_ai2.seq

     G T C C C C T T A C T A A A A G T C T G T G T G T A T T G A T C A T A A T C G G G G T G C A A G T T Majority
                   4060                4070                4080                4090                4100
3951 G T C C C C T T A C T A A A A G T C T G T G T G T A T T G A T C A T A A T C G G G G T G C A A G T C 2603_ai2.seq
4051 G T C C C C T T A C T A A A A G T C T G T G T G T A T T G A C C A T A A T C G G G G T G C A A G T T nem316_ai2.seq

     A A T A A G G T T G C A T A A T C A T G T C C A G G A A C A A C C A A C A A A T C T G A A A A G T T Majority
                   4110                4120                4130                4140                4150
4001 A A T A A G G T T G C A T A A T C A T G T C C A G G A A C A A C C A A C A A A T C T G A A A A G T T 2603_ai2.seq
4101 A A T A A G G T T G C A T A A T C A T G T C C A G G A A C A A C C A A C A A A T C T G A A A A G T T nem316_ai2.seq

     A T C G G G T G T A A C G A C T T T T A T C T G A T C T A C T T G A T A T G C T A T C G T T T C T T Majority
                   4160                4170                4180                4190                4200
4051 A T C G G G T G T A A C G A C T T T T A T C T G A T C T A C T T G A T A T G C T A T C G T T T C T T 2603_ai2.seq
4151 A T C G G G T G T A A C G A C T T T T A T C T G A T C T A C T T G A T A T G C T A T C G T T T C T T nem316_ai2.seq

     T T A T G T T T T G A A T A T A A A A C T T A T C T C C T T T T T T T T A A C T T T T T A A G G T T A Majority
                   4210                4220                4230                4240                4250
4101 T T A T G T T T T G A A T A T A A A A C T T A T C T C C T T T T T T T T A A C T T T T T A A G G T T A 2603_ai2.seq
4201 T T A T G T T T T G A A T A T A A A A C T T A T C T C C T T T T T T T T A A C T T T T T A A G G T T A nem316_ai2.seq

     G A A A A G A G T T C T T T A T C T G G A A T T C C T G A G T G C G C T G T T A T A A C G G T A T G Majority
                   4260                4270                4280                4290                4300
4151 G A A A A G A G T T C T T T A T C T G G A A T T C C T G A A T G C G C T G T T A T A A C A G T A T G 2603_ai2.seq
4251 G A A A A G A G T T C T T T A T C T G G A A T T C C T G A G T G C G C T G T T A T A A C G G T A T G nem316_ai2.seq

     T G T G C T A T T T C C T C C A A T T G G A A G A G A G G T A C C T T C T A A A T G C C C T G C T C Majority
                   4310                4320                4330                4340                4350
4201 T G T A C T A T T G C C C C C A A T T G G A A G A G A G G T A C C T T C T A A A T G C C C T G C T C 2603_ai2.seq
4301 T G T G C T A T T T C C T C C A A T T G G A A G A G A A G T A C C T T C T A A A T G C C C T G C T C nem316_ai2.seq

     C T T T A G A T A G A A C T T C T T G A C T T G A A C C T G C A A A T A T A G G G A G T T T T T G A Majority
                   4360                4370                4380                4390                4400
4251 C T T T A G A T A G A A C T T C T T G A C T T G A A C C T G C A A A T A T A G G G A G T T T T T G A 2603_ai2.seq
4351 C T T T A G A T A G A A C T T C T T G A C T T G A A C C T G C A A A T A T A G G G A G T T T T T G A nem316_ai2.seq

     C C T A T C T T A G G A A C T G A A A T T G T T C C G A T T T T T T C A C T T A C C T C T A A C A T Majority
                   4410                4420                4430                4440                4450
4301 C C T A T C T T A G G A A C T G A A A T T G T T C C G A T T T T T T C A C T T A C C T C T A A C A T 2603_ai2.seq
4401 C C T A T C T T A G G A A C T G A A A T T G T G C C G A T T T T T T C A C T T A C C T C T A A C A T nem316_ai2.seq

     A C G G G C G T A C T C T G C T A C C C C C T T T T G A A T T C G T T T T T T C T C A T A A G G A T Majority
                   4460                4470                4480                4490                4500
4351 A C G G G C G T A C T C T G C T A C C C C C T T T T G A A T T C G T T T T T T C T C A T A A G G A T 2603_ai2.seq
4451 A C G G G C G T A C T C T G C T A C C C C C T T T T G A A T T C G T T T T T T C T C A T A A G G A T nem316_ai2.seq

     C T T C A A G A T G G A C A T T A T T T A A A G A A T C A T T A T A A G C T T G T G C T A G A G T C Majority
                   4510                4520                4530                4540                4550
4401 C T T C A A G A T G G A C A T T A T T T A A A G A A T C A T T A T A A G C T T G T G C T A G A G C C 2603_ai2.seq
4501 C T T C A A G A T G G A C A T T A T T T A A A G A A T C A T T A T A A G C T T G T G C T A G A G T C nem316_ai2.seq
```

FIGURE 20H

Alignment Report of Ai-2_alignment, using J. Hein method with Weighted residue weight table.
Thursday, July 29, 2004 6:47 PM

```
     ATACGTCGATTGATTTCTTTCTGACTAAGTTTTTTAGCAGCTCTCTCAAA Majority
               4560      4570      4580      4590      4600
4451 ATACGTCGATTGATTTCTTTCTGACTAAGTTTTTTAGCAGCTCTCTCAAA 2603_ai2.seq
4551 ATACGACGATTGATTTCTTTCTGACTAAGTTTTTTAGCAGCTCTCTCAAA nem316_ai2.seq

     ATCCTGTGTTTGATTATTAGATTCTATCGTATAGTAAAAACGTGATACCA Majority
               4610      4620      4630      4640      4650
4501 ATCCTGTGTTTGATTATTAGATTCTATCGTATAGTAAAAACGTGATACCA 2603_ai2.seq
4601 ATCCTGTGTTTGATTATTAGATTCTATCGTATAGTAAAAACGTGATACCA nem316_ai2.seq

     CTGGATACAATAAAATAGATAGACCTATTAGAAAAAGAATGATAAAAGGA Majority
               4660      4670      4680      4690      4700
4551 CTGGATACAATAAAATAGATAGACCTATTAGAAAAAGAATGATAAAAGGA 2603_ai2.seq
4651 CTGGATACAATAAAATAGATAGACCTATTAGAAAAAGAATGATAAAAGGA nem316_ai2.seq

     AGATTTGACTTCTTCTTTTTTTTTGTTTTTTTGTTGATTTTTTTAGTCTT Majority
               4710      4720      4730      4740      4750
4601 AGATTTGACTTCTTCTTTTTTTTTGTTTTTTTGATGATTTTTTTAGTCTT 2603_ai2.seq
4701 AGATTTGACTTCTTCTTTTTA---GTTTTTTTGTTGATATTTTTAGTCTT nem316_ai2.seq

     CACGTCATCTCCTAGATAATGGCTCTTGCTTATGATCTAAGAGTACTTCT Majority
               4760      4770      4780      4790      4800
4651 CACGTCATCTCCTAGATAATGGCTCTTGCTTATGATCTAAGAGTACTTCT 2603_ai2.seq
4748 CACGTCATCTCCTAAATAATGGCTCTTGCTTATGATCTAAGAGTACTTCT nem316_ai2.seq

     ACTGAAATACCCTTAGATCATAAGCACAGCTTTAACTGTGCTTATACATC Majority
               4810      4820      4830      4840      4850
4701 ACTGAAATACCCTTAGATCATAAGCACAGCTTTAACTGCGCTTATACATC 2603_ai2.seq
4798 ACTGAAATACCCTTAGATCATAAGCACAGCTTTAACTGTGCTTATACAGC nem316_ai2.seq

     ATCAAAGACTAGCCTTAAGCTTCCTTTGATTGGCGTTTTTTCATGATAAC Majority
               4860      4870      4880      4890      4900
4751 ATCAAAGACTAGCCTTAAGCTTCCTTTGATTGGCGTCTTTTCATGATAAC 2603_ai2.seq
4848 ATCAAAGACTAGCCTTAAGCTTCCTCTGATTGACGTTTTTTCATGACAAC nem316_ai2.seq

     TACTGCTCCAAGCATAATGCTTAAACCAATAATTGTGAAAAGAATTGTAC Majority
               4910      4920      4930      4940      4950
4801 TACTGCTCCAAGCATAATGCTTAAACCAATAATTGTGAAAAGAATTGTAC 2603_ai2.seq
4898 TACTGCTCCAAGCATAATGCTTAAACCAATAATTGTGAAAAGAATTGTAC nem316_ai2.seq

     CAATACCACCTGTTTGTGGGATTGTTACTTTTTTGTTTTGTACTTGTTTG Majority
               4960      4970      4980      4990      5000
4851 CAATACCACCTGTTTGTGGGATTGTTACCTTTTTATTTTCTACACGTGTC 2603_ai2.seq
4948 CAATACCACCTGTTTGTGGGATGGTTACTTTTTTGTTTTGAACTTGTTGG nem316_ai2.seq

     GCATCTTTTTTTACAGGTTTTTTTGTTATCTGCGTTGTCAGTTTTAGCCCC Majority
               5010      5020      5030      5040      5050
4901 GCATCTTTTT------GGTTGGTGTTAGCAACGTAGTCAATGTTAGCACC 2603_ai2.seq
4998 GCATCTTTTTTTACAGATCCTTTATCATATGCGATGTCAGTTGTAGCCCC nem316_ai2.seq

     TTTTCTGTATGATGTTTGATTTACTTCAAAGTTTATATTACCTGCCAATT Majority
               5060      5070      5080      5090      5100
4945 TGTTATGTATGACCCTTGATTAACTACAAACTTAATATTACCTGCCAAGT 2603_ai2.seq
5048 TTTGCTATATGATGTGGCAGTTACTTCAAAGTTTAGATCACCTGACAATG nem316_ai2.seq

     TCGCATATCCTGCTGGTGCTTGTGTTTCTTCCAGGTTGTAAGTGCCTTTT Majority
               5110      5120      5130      5140      5150
4995 TAGCAAATCCTGCTGGAGCAAGTGTTTCTTCAAGGTTGTAAGTACCGTCT 2603_ai2.seq
5098 TCGCATAACCTGCTGGTGCTTGAGTTTCTTCCAAGGTATAAGTGCCTTTA nem316_ai2.seq

     TCCAGACCTGTAATTTCAAATTGACCTTGGTCGTTTGAGGTGTATTTAAT Majority
               5160      5170      5180      5190      5200
5045 GCAAGACCTGTAACTTCAAATTGACCTTGATCGTTTGAAGTGTAGCTAAT 2603_ai2.seq
5148 TCCAAACCAGTAATTTCAAATTGACCACCGGCGTTAGAGATCAATTTAAC nem316_ai2.seq
```

FIGURE 20I

Alignment Report of Ai-2_alignment, using J. Hein method with Weighted residue weight table.
Thursday, July 29, 2004 6:47 PM

```
     GGCTTTATCAGCCTTTTTATCTGTTATCCATTCATATGCTTTGTTAGCTT Majority
              5210      5220      5230      5240      5250
5095 GGCTCTAGC------CTTATCTGTTATCCACTCATAAGCTGTACGAGCCT 2603_ai2.seq
5198 AACATTATCAGCCTTTTTATCTGCAACCCATTCATATGAGTAGTTAGCTT nem316_ai2.seq

     TAATGAAGGCTTCATTGTAATCTTTTTGTTTTTTTTTGATAGTTTCTTTT Majority
              5260      5270      5280      5290      5300
5139 CAATGAAGGCTGCATCGTAATCTGCTTGTTTAGTTTTGATAAGTTCTTTT 2603_ai2.seq
5248 TAACAAAAGCGTCATTGTAAGCTTTTTGTTTTTGATCAACAGTAGCCAAT nem316_ai2.seq

     GCTGTTTTTCCTTTTTGGCCTTTTTGTTTTTTTTTAGTCAAGTTGTTATA Majority
              5310      5320      5330      5340      5350
5189 GCAGTAATTCCTTTTTCACCTTTTTGGTCTGTTGCAGACAACTTGTTATA 2603_ai2.seq
5298 GCTGTTTTACCTTCTTGGCCTTCTTGTTTTTCTTTAGTCAAGTCGTTATA nem316_ai2.seq

     AGCTTTGATAGCTTCATCTAATGCTATTTTAGCAGTTTTTGCAGCTGCCT Majority
              5360      5370      5380      5390      5400
5239 AGCAGCGATAGCTTCATCTAAAGCTATTTT------CTTAGCAGCTAAAG 2603_ai2.seq
5348 AGCTTTAACAGCTTCATCCAATGCTAGTTTAGCAGTTTTTACAGCTGCCT nem316_ai2.seq

     TTTTTTGAGCTTTTGCTTGATCTGCTTTACGTGCCAGGTATTTTCCTTCT Majority
              5410      5420      5430      5440      5450
5283 TTTTTTGACCTTCTGATTGATCTGCTTTAAGAGCAAGGTATTTACCTGCT 2603_ai2.seq
5398 TTGCTTCAGCAGTTGCTGCACCTGCTTTACGTGCCAAGTATTTTCCTTCT nem316_ai2.seq

     GAGTTTTTCACAAGGAATTTTGCTCCTGCCAAGCGTTCAGTTTTAGCTTG Majority
              5460      5470      5480      5490      5500
5333 GAGTTTTTCACAACGAATTGTGCACCAGCCAAACGGTCACCTTG---TTC 2603_ai2.seq
5448 ---TTCTTAACAAGGAAGGTAGCTCCTGCCAAGCGTTCAGTGTTAGCTTG nem316_ai2.seq

     ATTTGTTTTGACAAATTTCTTTCCATGAGTTTCCACTTTTGGTTCTGTTG Majority
              5510      5520      5530      5540      5550
5380 ATTAGTTTTGACAAATTTCTTACCATGAGTTTCAACTTTTGGTTCAGTTG 2603_ai2.seq
5495 ATTTGTTTTCACAAATTTACGTCCATAAGTCACCACTTTTGGTTCTGATG nem316_ai2.seq

     GGTTGATTGGTGTTGGGTTATTTGAGTTTTTGTTGTTGTTGATGGTTACT Majority
              5560      5570      5580      5590      5600
5430 GGTTCAATGGTGTTGGGTTATCAGAATCTTTGGTATTGGTAATGGTTACT 2603_ai2.seq
5545 GGTTGATTGGAGTTGGATCATTTGAGTTTTTGTTGTTCTTGATAGTCACA nem316_ai2.seq

     TTACCATTTTTTAGTTTTATTTCTTTTGGAGTGTAGCCGGTAACACGTTC Majority
              5610      5620      5630      5640      5650
5480 TTACCATTTTCTAGATTTATTGCACTTC---CGTAACCAGAAACACGTTC 2603_ai2.seq
5595 ACACCATTTTTTAAATGATACATATTCTGGAGTGTAGCCGCTAACACGTTC nem316_ai2.seq

     TGCGATGCTGTATGTTTTGGTATTTTCTAGACCTGTGAATTTACCCGAGT Majority
              5660      5670      5680      5690      5700
5527 TGAGATCATGTATGATTTG---TTTTCTAGACCAGTGAATTTACCCGAGA 2603_ai2.seq
5645 GACAACGCGGTAAGTTTTAGTATTATCCAAACCTGTGAA--------AGT nem316_ai2.seq

     ATTTTCCAGGTGTTTTGGTTTTGTTGCTTTTTGTGAGGTCGCTTTTACCT Majority
              5710      5720      5730      5740      5750
5574 AGTTACCAGATACTTCAAATTTGATACCATTTCCAAGGTCGATTGTACCT 2603_ai2.seq
5687 ATGTTCAAAGCGTGATGGTTTTGTTGCTTCGTGTGAAGCAACGTTCACCC nem316_ai2.seq

     TTGTATGTTTTTGTTTGTTTTTCTTGCGCGGTAGTTTTATCTTTATCTTT Majority
              5760      5770      5780      5790      5800
5624 TTAGATGTTTTTGTCAATGATACTGAAGCAACAGTTTTATCTTTATCTTT 2603_ai2.seq
5737 ATGTAC-CATCCGTTTGTTTTTCTTGCAAGGTAAAGATAGCTTTAACT-- nem316_ai2.seq

     CAATGTGTAAGCAACGTTTACATCATTAGTTGTACTTTCTTCTGCCCAGT Majority
              5810      5820      5830      5840      5850
5674 CAATGTGTAAACAACGTTTACACCATCAGGTGCAATTCCGTCAGACCAAG 2603_ai2.seq
5784 ----------GCAACATTAACATCAGTAATTGTACCATCTACTGCCCAGT nem316_ai2.seq
```

FIGURE 20J

Alignment Report of Ai-2_alignment, using J. Hein method with Weighted residue weight table.
Thursday, July 29, 2004 6:47 PM TTTTAGTGACTTTTATTTCTTGGTTTGCTGGTGTACCTTGTTGTTGTTTC Majority 5860 5870 5880 5890 5900

5724 TTTTAGCAACTGTTAGTTCACCCTTTGAAGGTGTAACAGGAAGTTCAGTC 2603_ai2.seq

5824 GTTTAATGACTTTAATTTCTTGGTTAGCTGGAGTACCTTCTTGTGGTTCA nem316_ai2.seq

CTTTCTTTCGTTGGTTTGTTACCATAGTCCAATTTGATATCATTGGTTTC Majority 5910 5920 5930 5940 5950

5774 AAGTCTTTACCTGGTTTGTTACCATACGACAATTTGATATCATTGGATTC 2603_ai2.seq

5874 CTTTCTTCCGTTGGGTTATTACCATAGTCCAATTTAACATCATTGGTTTC nem316_ai2.seq

TGGATTTTCAATAGTTGTTTGGCCGTTCACCGTAGCTGTGTAAGTGATTT Majority 5960 5970 5980 5990 6000

5824 TGGATTATCAATAATTGCTTGACCATTAACAGTAGCAGTATAAGTGAATG 2603_ai2.seq

5924 TGGAACTTCAACAGTAGTGGAGCCGTTCACCGTAGCTGAGTAAGTGATCT nem316_ai2.seq

TGATTTCAATATCTTTTTTTTTTGCTGCTTTTTCTACTTTTGCCAGTCCT Majority 6010 6020 6030 6040 6050

5874 TAAATTCAATATCAGCTGTTTTAGCTGCTTTTTCCAATTTGGCCAATCCA 2603_ai2.seq

5974 TGATTTCAACATCTTTGTCTTTTGCAGCAGCTGCTACTGCTGCAAGACCT nem316_ai2.seq

TTTGCTTTGAATTTTAGTGTGAAACCTTGGTCATCTGTTCTGAGTTTGTA Majority 6060 6070 6080 6090 6100

5924 TCAGCTGTGAATTTTAATGTGAAACCACGGGCATCAATGCTAAGTTCATA 2603_ai2.seq

6024 GTTGCATTCAAGGCAAGACGGAAACCTTGGTCATCTGTTACGAGTTTGTA nem316_ai2.seq

GTTTGTATCCTTAGGAAAATTTTTTGTATTTCCTGTTGCTTTAAGGTTGT Majority 6110 6120 6130 6140 6150

5974 GTCTGTATCCTTAGCAAAAGTTTCTGTAGTTCCTGAAGCTTTAAGGCTAA 2603_ai2.seq

6074 GTTTAAAAC---AGGAAAATCTTTACCATCCAATGTTACTTTAACGTTGT nem316_ai2.seq

TAGTTGAACCCATTGTCAAACCTTTTGTCATTCTATCTGTCCAAACCAGT Majority 6160 6170 6180 6190 6200

6024 CAGTTGAACCCATTGTCAAACCATTTGACATTATATCTGTCCAAACCAAG 2603_ai2.seq

6121 T-GTTGAAC-----GTCAAACCTTTAGTCATGCTATCAGTCCAAACCAGT nem316_ai2.seq

TTTTTGTATTTTGAGCCTTTGTGAATTTTTGTTTTAACTTTGTATTGTTT Majority 6210 6220 6230 6240 6250

6074 TTTTCGTATTTAGAACCTTTGTGAATTTTTGTTTTAACTTCATAAGGAAC 2603_ai2.seq

6165 TTCTTATAGTCTGAGCCTTTAAGAATTTTTGTTCCAACTATGTATTCTTT nem316_ai2.seq

TTTTTTACCGATTTTCGCTGTGGCAGTTGCTTTGTCACGTGCATAATTAC Majority 6260 6270 6280 6290 6300

6124 AACTTTACCGATTTCAGCAGTAGCAGTTGCTTTGTCACGTGCATAATTAC 2603_ai2.seq

6215 TTTGTCACCAACTGTCGCTGAGACAACACCTTTGTC-------------- nem316_ai2.seq

CATAATTTGCGCCAGCTGTCAAAAGTCTATTTTCGTTTGTCAGTGTTGTC Majority 6310 6320 6330 6340 6350

6174 CATAATTTGCGCCAGCTGTCAAAAGTCTATTAACATCTGTCAATGCTGTC 2603_ai2.seq

6251 -----------------------------TTTTCGGTTGTCAGTATAATC nem316_ai2.seq

AAGTTGTTTGTTTTTGCAAAGTTTTTATCTATTTGTGGTTTTTTTTCAGT Majority 6360 6370 6380 6390 6400

6224 AAATCGTTTGTTTTAGCAAAGTTTTTATCAATTTCTGGTTTTTCTTCAGT 2603_ai2.seq

6272 AAGATCTTTATC--TGCAAAGTTCTTATCTACTTGTGGTTTTGTTTCAGT nem316_ai2.seq

GTTCTTTGGATAAATGTGGGCATCTTTAACAACACCTTGTTTGTTTACCA Majority 6410 6420 6430 6440 6450

6274 GTTCTTTGGATAAACATGGGCATCAGCAACAACACCATCTTCATTTACCA 2603_ai2.seq

6320 ATTCTTTGGATAAATGTGAGCATCTTTAACAACACCTTGGTTGTTTACCA nem316_ai2.seq

ATGGCAGAGTGATTTTAACTGGAACTGCTTTTGAATCAGCCAGGATGGAA Majority 6460 6470 6480 6490 6500

6324 ATGGAAGAGTGATGTTAACTGGAACCGCTTTTGAAGCAGCCAGGAGGGAA 2603_ai2.seq

6370 ATGGCAGAGTGATTTTAACTGGAACTGCTTTTGAATCAGCCAAGATAGAA nem316_ai2.seq

FIGURE 20K

Alignment Report of Ai-2_alignment, using J. Hein method with Weighted residue weight table.
Thursday, July 29, 2004 6:47 PM

```
     CCGTTGTTGTTGTAGTTTGATTTTTCTTTCACTTCAACGATTTTGTACTT Majority
               6510      6520      6530      6540      6550
6374 CCATTATTGTTGTAAGTAGATTTTGATTTAACTTCAACAATTTTAAACTC 2603_ai2.seq
6420 CCGTTGTTATCGTAGTTTGATTTTTCTTTCAATTCAACGATTTGGTAAGT nem316_ai2.seq

     TCCTTTTAATTTTTTGGTGTTGAAAGCAAGTCCAGTGTCTTTTTTTGGTG Majority
               6560      6570      6580      6590      6600
6424 GCCTTTCAATCCTTTGGTGTTGAAAACAAGTCCAGTATCTCCCTCTGGTG 2603_ai2.seq
6470 TCCTTTTAACTTAGCAGTGTTAAAAGCAAAACCAGTGTCTTTTGTTAACC nem316_ai2.seq

     TTGATCCAGGCACGGCCTCATCTTTATTTTCTTTTGTTTCCGGAGTATCG Majority
               6610      6620      6630      6640      6650
6474 TCAATCCAGACACGGCCTCATCAATATTTACTGTTATTTCAGGAGTACCA 2603_ai2.seq
6520 CTGA---AAGAACAGCACCAGCTTGAGCATCTTTAGGTTCCAAAGTATCG nem316_ai2.seq

     TCTTTCTTAATTAAGGCTGGTGTTAATTTGTTACCTTCTTTTTCCTTAAT Majority
               6660      6670      6680      6690      6700
6524 TCTTTATTAATTAAGGCTGGTGTTAATTTGTTACCTTCTTTTGCCTTAAC 2603_ai2.seq
6567 ACTTCCTTA---------------------------CCATTTTCAGTAAT nem316_ai2.seq

     GTATTGCATTTTACCAGTTTTATTTTTTTTCAAAGCTAAAGCAAAGAACG Majority
               6710      6720      6730      6740      6750
6574 ATATTGCACTTTACCAGTTTTATCTTCTTTCAAAGCTAAAGCAAAGAACG 2603_ai2.seq
6590 GAATT---TTGTACCAGTTTCATTTTTC---------AAAACAAAGAAAG nem316_ai2.seq

     CACCTTTGATTTCTTTAGCTTCGTTTGAGCCAAAGTAAGCTTTAAGGTCA Majority
               6760      6770      6780      6790      6800
6624 CACCTTCGATTTCTTTAGATCCCTC---GCCAAAGTAAGCAGCAAGGTCA 2603_ai2.seq
6628 CACCCTTAATTTCTTTAGCATCGGTTGAGCCAAAATAAGATTTAAGGTCA nem316_ai2.seq

     TTAATTTGTTTACCTTTGTAGTCTTTTTCGTTCTTACCTTTTGTTCCTTG Majority
               6810      6820      6830      6840      6850
6671 GAAATAGCTCCACCTTTGTAGTCTTTTCCGTTAAGACCTGTAGTTCCTGG 2603_ai2.seq
6678 TTAATTTGTTTACCAACATAATCGCTATCATTCTTACCTTTTGTACCTTC nem316_ai2.seq

     GGAGTTACTTTTGTTAAGTTTTGCTTGTGTTTTGACAATCTTGTGCAAGG Majority
               6860      6870      6880      6890      6900
6721 GAAGTTACTTTTGTTAAGATTTGATTCGGTTTGCAAAATCTTGTGCAAAG 2603_ai2.seq
6728 AG---TAAAGTTATCAAATGCAGCTTGTGGCATGACAATCTTGTGCAAGG nem316_ai2.seq

     TCACTGTATTAGTTGTTGCTTCGTCCGCAAACGCTGGTGCAACTGAGAGT Majority
               6910      6920      6930      6940      6950
6771 TCACTGTATTAGTTGTTGCTTCATCCGCAAACGCTGGTGCAACTGAGAGC 2603_ai2.seq
6775 TCACAGTATCAGTTGTTACGTCGTCCGCAAACGCTGGTGCAACTGAGAAT nem316_ai2.seq

     AGTGACGTTAAGGTCAGTAGCAGTGTCGAGAACATTGTAAGATATTTGTT Majority
               6960      6970      6980      6990      7000
6821 AATGACGTTAAAGTCAGTAACAATGCCGAGAACATTGCAAAATATTTGTT 2603_ai2.seq
6825 AGTGACGTTAAGATCAATAGCAGTGTCGAGAACACTGTAAGACATTTGTT nem316_ai2.seq

     GATTTTTTTCATTTCTATCTCCTTCTTATTTTAGTTAATCAACATGGTTA Majority
               7010      7020      7030      7040      7050
6871 GATTCTTTTCATTTCTATCTCCTTCTTATTTTAGTTAATCAACATGATTA 2603_ai2.seq
6875 GATTTTTTTCATTTCTATCTCCTTCTTATTCTAGTTAATCAACATAGATA nem316_ai2.seq

     ATAATATGCGGATTTTAATATTACCGCAGCACCACTCCTTTCAAGTCATG Majority
               7060      7070      7080      7090      7100
6921 ATAATATGCGGATTTTAATAC-ACCGCAGCACCACTCCCTTCAAGTCATG 2603_ai2.seq
6925 ATAATATACGGATTATAATATTACCGCAGCACCACTCCTTTC-------- nem316_ai2.seq

     GAATTTTATTTAATTAATTAAGAATACTAAAGCGCATGATTTTTAATCTT Majority
               7110      7120      7130      7140      7150
6970 GAATTTTAGTTAATTAATTAAGAATACTAAAGCGCATAATTTTTAATCTT 2603_ai2.seq
6967 GAATTATATTTAATTAATTAAGAATACTAAAACACATGATTCTTAATCTT nem316_ai2.seq
```

FIGURE 20L

Alignment Report of Ai-2_alignment, using J. Hein method with Weighted residue weight table.
Thursday, July 29, 2004 6:47 PM

```
     T T T T T C T G G A T A T A T C A C T A G A T T T C T T A T A T C T T T T C C A A A T A T A A A T T Majority
                        7160                7170                7180                7190                7200
7020 T T T T G A T G G A C A T A T C A C T A G A T T T C T T A T A C C T T T T C C A A A T A T A A A T T 2603_ai2.seq
7017 T T T C T C T A G A T A T A T C A C T A G A T T T C T T A T A T C T T T T C C A A A T A T A A A T T nem316_ai2.seq

     C C A C C T G C A A T A G A C A T C A T A G C T C C A C C T A T T A A A A T G A A A G A T A G A A T Majority
                        7210                7220                7230                7240                7250
7070 C C A C C T G C A A T A G A C A T C A T A G C T C C A C C T A T T A A A A T G A A A G A T A G A A T 2603_ai2.seq
7067 C C A C C T G C A A T A G A C A T C A T A G A T C C A C C T A T T A A A A T G A A A G A T A G A A T nem316_ai2.seq

     T C C T T T C C C A C C T G T C A T C G G A A T A A T T C C T T T T G G T G G A A T A T G C G T G T Majority
                        7260                7270                7280                7290                7300
7120 T C C T T T C C C A C C T G T C A T A G G A A T A A T T C C T T T T G G T G G A A T A T G C G T G T 2603_ai2.seq
7117 T C C T T T C C C A C C T G T C A T C G G A A T A A T T C C T T T T G G T G G A A T A T G C G T G T nem316_ai2.seq

     T G G T A A T T A A A T G C T T G T C A C C T T C C T C A T G A T A T T C A G A A A T C T G T T T A Majority
                        7310                7320                7330                7340                7350
7170 T G G T A A T T A A A T G C T T G T C A C C T T C C T C A T G A T A T T C A G A A A T C T G T T T A 2603_ai2.seq
7167 T G G T A A T T A A A T G C T T G T C A C C T T C C T C A T G A T A T T C A G A A A T C T G T T T A nem316_ai2.seq

     T T A A C A G C T A T T A T A T T T T T T A T C G A T C C T T T A A C C A C T T C A A A A G T T A A Majority
                        7360                7370                7380                7390                7400
7220 T T A A C A G C T A T T A T A T T T T T T A T C G A T C C T T T A A C C A C T T C A A A A G T T A A 2603_ai2.seq
7217 T T A A C A G C T A T T A T A T T T T G T A T C G A T C C T T T A A C A A C T T C A A A A G T T A A nem316_ai2.seq

     A A T T G G T T T A T T A G T A A T T T T T T G A T A A T C C T T C G G C G A A A C T G C T T C T A Majority
                        7410                7420                7430                7440                7450
7270 A A T T G G T T T A T T A G T A A T T T T T T G A T A A T C C T C C G G C G A A A C T G C T T C T A 2603_ai2.seq
7267 A A T T G G T T T A T T A G T A A T T T T T T G A T A A T C C T T C G G C G A A A C T G C T T C T A nem316_ai2.seq

     T T A A C T G A T A T T T G C C A T C T T T C A A A T C T T T G T A A G A A A T T T T G C C G T T T Majority
                        7460                7470                7480                7490                7500
7320 T T A A C T G A T A T T T G C C A T C T T T C A A A T C T T T G T A A G A A A T T T T G C C G T T T 2603_ai2.seq
7317 T T A A C T G A T A T T T G C C A T C T T T C A A A T C T T T G T A A G A A A T T T T G C C G T T T nem316_ai2.seq

     T C T C C C G T C A C T A C T T T T G A A T T A T T A T T T T T T T A T T G G T A A A T A A A G T T T Majority
                        7510                7520                7530                7540                7550
7370 T C T C C C G T C A C T A C T T T T G A A T T A T T A T T T T T T T A T T G G T A A A T A A A G T T T 2603_ai2.seq
7367 T C T C C C G T C A C T A C T T T T G A A T T A T T A T T T T T T T A T T G G T A A A T A A A G T T T nem316_ai2.seq

     A T A A T C T T C A T T A A A T T C T T G A A G T T C A A A C G T A G C T C C T T T G A G A A G C A Majority
                        7560                7570                7580                7590                7600
7420 A T A A T C T T C A T T A A A T T C T T G A A G T T C A A A C G T A G C T C C T T T G A G A A G C A 2603_ai2.seq
7417 A T A A T C T T C A T T A A A T T C T T G A A G T T C A A A C G T A G C T C C T T T G A G A A G C A nem316_ai2.seq

     A C T T A T T A T T A T C T T T A T C A A C T T T T G T A A A T T C A A T T T C A C C T A A C T T C Majority
                        7610                7620                7630                7640                7650
7470 A C T T A T T A T T A T C T T T A T C A A C T T T T A T A A A T T C A A T T T C A C C T A A C T T C 2603_ai2.seq
7467 A C T T A T T A T T A T C T T T A T C A A C T T T T G T A A A T T C A A T T T C A C C T A A C T T C nem316_ai2.seq

     T T C T C G T T T T T A A T C G T T A T T G T A G G A T A T T C T C T C A C A T C A C G A A T T T T Majority
                        7660                7670                7680                7690                7700
7520 T T C T C G T T T T T A A T C G T T A T T G T A G G A T A T T C T C T C A C A T C A C G A A T T T T 2603_ai2.seq
7517 T T C T C G T T T T T A A T C G T T A T T G T A G G A T A T T C T C T C A C A T C A C G A A T T T T nem316_ai2.seq

     A G G G A T T G G A A A A T C T C T A A G T G T A T T A G G A T C C T C T G A T T T A G G A T T C A Majority
                        7710                7720                7730                7740                7750
7570 A G G G A T T G G A A A A T C T C T A A G T G T A T T A G G A T C C T C T G A C T T A G G A T T C A 2603_ai2.seq
7567 A G G G A T T G G A A A A T C T C T A A G T G T A T T A G G A T C C T C T G A T T T A G G A T T C A nem316_ai2.seq

     A T G T T G T T C T A C C A T T A G T G T C A T A G A A T T T G T T A C T T A T A A A A C T G T C A Majority
                        7760                7770                7780                7790                7800
7620 A T G T T G T T C T A C C A T T A G T G T C A T A G A A T T T G T T A C T T A T A A A A C T G T C A 2603_ai2.seq
7617 A T G T T G T T C T A C C A T T A G T G T C A T A G A A T T T G T T A C T T A T A A A A C T G T C A nem316_ai2.seq
```

FIGURE 20M

Alignment Report of Ai-2_alignment, using J. Hein method with Weighted residue weight table.
Thursday, July 29, 2004 6:47 PM

```
     T C T A G T T T C A C A T C A T A T G T G A G T G T T A C T T T T T G T C C T T C T C C T A A G T T Majority
                     7810                7820                7830                7840                7850
7670 T C T A G T T T C A C A T C A T A T G T G A G T G T T A C T T T T T G A C C T T C T C C T A A A T T 2603_ai2.seq
7667 T C T A G T T T C A C A T C A T A T G T G A G T G T T A C T T T T T G T C C C T C C C C T A A G T T nem316_ai2.seq

     C A A A C C T C T A A C G T A G A G T T T A T T T T T G A T G T A T T C T A A T T T A A C C C C T T Majority
                     7860                7870                7880                7890                7900
7720 C A A A C C T C T A A C A T A G A G T T T A T T T C C G A T G T A T T C T A A T T T A A C C C C C T 2603_ai2.seq
7717 C A A A C C T C T A A C G T A G A G T T T A T T T T T G A T G T A T T C T A A T T T A A C C C C T T nem316_ai2.seq

     T A A G T A T T C C A C C A T C A T T A T T A G G C C C A C C A G T T G C A A T G C T A T C T T T C Majority
                     7910                7920                7930                7940                7950
7770 T A A G T A T T C C A C C A T C A T T A T T A G G C C C A C C A G T T G C A A T A C C A T C C T T C 2603_ai2.seq
7767 T A A G T A T T C C A C C A T C A T T A T T A G G C C C A C C A G T T G C A A T G C T A T C T T T C nem316_ai2.seq

     A T T A T A C T T C C A T C A T T T C C C T G T A A A G T A T A A T C A C T T G G T T G T A A T G T Majority
                     7960                7970                7980                7990                8000
7820 A T T A C A C T T C C A T C A T T T C C C T G T A A A G T A T A A T C A C T T G G C T G T A A T G T 2603_ai2.seq
7817 A T T A T A C T T C C A T C A T T T C C C T G T A A A G T A T A A T C A C T T G G T T G C A A T G T nem316_ai2.seq

     T T G T C C G T T G C C A A G C T G T A A A T T G A T T T T G T C A C C C A T A G G A T C T T C T A Majority
                     8010                8020                8030                8040                8050
7870 T T G T C C A T T A C C A A G C T G T A A A T T G A T T T T A T C A C C C A T A G G A T C T T C G A 2603_ai2.seq
7867 T T G T C C G T T G C C A A G C T G T A A A T T G A T T T T G T C A C C C A T A G G A T C T T C T A nem316_ai2.seq

     T A G T T C C A T T A A C A A T T G A G T T T T C T T T T G T T A A A A T C T T T T C A A A T T G T Majority
                     8060                8070                8080                8090                8100
7920 T A G T T C C A T T A A C A A T T G A G T T T T C T T T T G T T A A A A T C G T T T C A A A T T G T 2603_ai2.seq
7917 T A G T T C C A T T A A C A A T T G A G T T T T C T T T T G T T A A A A C C T T T T C A A A T T G T nem316_ai2.seq

     T G C T G A A T T T T A G A T A A A A T T T C A T T G T T A G A T G T A T C G G C T G A A G T T A C Majority
                     8110                8120                8130                8140                8150
7970 T G C T G A A T T T T A G A T A A A A T T T C A T T G T T A G A T G T A T C G G C T G A A G T T A C 2603_ai2.seq
7967 T G C T G A A T T T T A G A T A A A A T T T C A T T G T T A G A T G C A T C G G A T G A A G T T A C nem316_ai2.seq

     T A T C G G G G T G T A G T A C T C A G G T T T G G A A G A G A A T G A C T T C A T T A G T T C T G Majority
                     8160                8170                8180                8190                8200
8020 G A T A G G G G T G T A G T A C T C A G G T T T G G A A G A G A A C G A C C T C A T T A G T T C T G 2603_ai2.seq
8017 T A T C G G G G T A T A A T A C T C A G G T T T A G A A G A G A A T G A C T T C A T T A G T T C T G nem316_ai2.seq

     T T A T T T C T C C A T C T G A A A G T T T A A A A G C T T C C T C T T T C A A T T T T T G A A A A Majority
                     8210                8220                8230                8240                8250
8070 T G A T T T C T C C A T C T G A A A G T T T A A A A G C T T C C T C T T T C A A T T T T T G A A A A 2603_ai2.seq
8067 T T A T T T C C C C A T C T G A A A G T T C A A A A G C T T C C T C T T T C A A T T T T T G A A A A nem316_ai2.seq

     G T A C C A T C T T G A T T T T T C T T A T A C T C C T C A T T A T A A A C T T G T C T A A A A G C Majority
                     8260                8270                8280                8290                8300
8120 G T A C C A T C T T G A T T T T T C T T A T A C T C C T C A T T A T A A A C T T G T C T A A A A C C 2603_ai2.seq
8117 G T A C C A T C T T G A T T T T T C T T A T A A T C C T C A T T A T A A A C T T G T C T A A A A G C nem316_ai2.seq

     A G A T A T A T C T A T A C C A A A A T T A A A G A T G T C A T A A T T T T T C T G T T T T A A A C Majority
                     8310                8320                8330                8340                8350
8170 A G A T A T A T C G A T A C C A A A A T T A A A A A T G T C A T A A T T T T T C T G T T T T A A A C 2603_ai2.seq
8167 A G A T A T A T C T A T A C C A A A A T T A A A G A T G T C A T A A T T T T T C T G T T T T A A A C nem316_ai2.seq

     T A T T T A T A T A A A G T T T G G T T G G T G T T C C A T G T T C T T T T A C T G G T C C A T T T Majority
                     8360                8370                8380                8390                8400
8220 T A T T T A T A T A A A G T T T G G T T G G T G T T C C A T G T T C T T T C A C T G G T C C A T T T 2603_ai2.seq
8217 T A T T T A T A T A A A G T T T G G T T G G T G T T C C A T G T T C T C T T A C T G G T C C A T T T nem316_ai2.seq

     C G A T A A A T T G T A C C T T T A G G G T A A T T A A G A T T T A A A T C T A A A T A A T G A A G Majority
                     8410                8420                8430                8440                8450
8270 C G A T A A A T T G T A C C T T T A G G G T A A T T A A G A T T T A A A T C T A A A T A A T G A A G 2603_ai2.seq
8267 C G A T A A A T T G T A C C T T T A G G G T A A T T A A G A T T T A A A T C T A A A T A A T G A A G nem316_ai2.seq
```

FIGURE 20N

Alignment Report of Ai-2_alignment, using J. Hein method with Weighted residue weight table.
Thursday, July 29, 2004 6:47 PM

```
     T T T T T G T A A G T T T C C A G A G A T T A T C T G T G T T T G A T A A C T A T C T A A G G G A A Majority
               8460      8470      8480      8490      8500
8320 T T T T T G T A A G T T T C C A G A G A T T A T C T G T G T T T G A T A A C T A T C T A A G G G A A 2603_ai2.seq
8317 T T T T T G T A A G T T T C C A G A G A T T A T C T G T G T T T G A T A A C T A T C T A A G G G A A nem316_ai2.seq

     A C A A A A A G T A A C T C T C C C C A T T T C C T T T T A T A T C C T C G G G C T T A T C A G T A Majority
               8510      8520      8530      8540      8550
8370 A C A A A A A G T A A C T C T C C C C A T T T C C T T T T A T A T C C T C G G G C T T A T C A G T A 2603_ai2.seq
8367 A C A A A A A G T A A C T C T C C C C A T T T C C T T T T A T A T C C T C G G G C T T A T C A G T A nem316_ai2.seq

     A G T A G A A A A T T A C T T T T A T T T A G A T A T C C A T T T T T T T T C A T T T G T T C A A A Majority
               8560      8570      8580      8590      8600
8420 A G T A G A A A A T T A C T T T T A T T T A G A T A T C C A T T T T T T T T C A T T T G T T C A A A 2603_ai2.seq
8417 A G T A G A A A A T T A C T T T T A T T T A G A T A T C C A T T T T T T T T C A T T T G T T C A A A nem316_ai2.seq

     T T G G C T T T C A T A T G A T G C A C C C A G T T T A A A A T T A T T A A T A G C A T A T G A T C Majority
               8610      8620      8630      8640      8650
8470 T T G G C T T T C A T A T G A T G C A C C C A G T T T A A A A T T A T T A A T A G C A T A T G A T C 2603_ai2.seq
8467 T T G G C T T T C A T A T G A T G C A C C C A A T T T A A A A T T A T T A A T A G C A T A T G A T C nem316_ai2.seq

     T T G T T G G A A C A C C A T C A G T T A T A T G A A C A A T A A T T T T T T G A C T A T T T C G A Majority
               8660      8670      8680      8690      8700
8520 T C G T A G G A A C A C C A T C A G T T A C A T G A A C A A T A A T T T T T T G A C T A T T T C G A 2603_ai2.seq
8517 T T G T T G G A A C A C C A T C A G T T A T A T G A A C A A T A A T T T T T T G A C T A T T T C G A nem316_ai2.seq

     T T T A C T T G A C T C A A A A T A T C A T C T G C C T C C A T G A A G G C T T T C A T A G T A A A Majority
               8710      8720      8730      8740      8750
8570 T T T A C T T G A C T C A A A A T A T C A T C T G C C T C C A T G A A G G C T T T C A T A G T A A A 2603_ai2.seq
8567 T C T A C T T G A C T C A A A A T A T C A T C T G C C T C C A T G A A G G C T T T C A T A G T A A A nem316_ai2.seq

     T G T T T C T C C T A C T T T A C T A A G A T A G T A C T G C T T T T G T T G C T C T G G A G T T A Majority
               8760      8770      8780      8790      8800
8620 T G T T T C T C C T A C T T T A C T A A G A T A G T A C T C C T T T T G T T G C T C T G G A G T T A 2603_ai2.seq
8617 T G T T T C C C C T A C T T T A C T A A G A T A G T A C T G C T T T T G T T G C T C T G G A G T A A nem316_ai2.seq

     G T C C G T T T G T A G T T G A T C C C C A T T T A G C T T T A G G A G C T T C T G T C G G A A T C Majority
               8810      8820      8830      8840      8850
8670 A T C C A T T G G T A G T A G A T C C C C A C T T A G C T T T A G G A G C T T C T G T C G G A A T C 2603_ai2.seq
8667 G T C C G T T T G T A G T T G A T C C C C A T T T A G C T C T A G G A G C T T C T G T A G G A A T C nem316_ai2.seq

     C T T T T T A T A A T C T C T T C A G C A T T A T T T G T T A A T T G T T T A T G A C T A T A A T T Majority
               8860      8870      8880      8890      8900
8720 C T T T T T A T A A T C T C T T C A G C A T T A T T T G T T A A T T G T T T A T G A C T A T A A T T 2603_ai2.seq
8717 C T T T T T A T A A T C T C T T C A G C A T T A T T T G T T A A T T G T T T A T G A C T A T A A T T nem316_ai2.seq

     C T C T G T C T G A A T T G T G A A C T T A G T T T G A A G G C C A T A A T A T T T A T C A T C T T Majority
               8910      8920      8930      8940      8950
8770 C T C T G T C T G A A T T G T G A A C T T A G T T T G A A G G C C A T A A T A T T T A T C A T C T T 2603_ai2.seq
8767 C T C T G T C T G A A T T G T G A A C T T A G T T T G A A G G C C A T A A T A T T T A T C A T C T T nem316_ai2.seq

     C T T T A A A T C C T T T T A C G A C A T C T A C A C T C C T A C C A T C A A A A A T A T C T G A A Majority
               8960      8970      8980      8990      9000
8820 C T T T A A A T C C T T T T A C G A C A T C T A C A C T C C T A C C A T C A A A A A T A T C T G A A 2603_ai2.seq
8817 C T T T A A A T C C T T T T A C G A C A T C T A C A C T C C T A C C A T C A A A A A T A T C T G A A nem316_ai2.seq

     C C A T A G G T A A C T A A T G C A A C C C T A T T A T C A C T G T T T G C T C C T A A A A T A T C Majority
               9010      9020      9030      9040      9050
8870 C C A T A G G T A A C T A A T G C A A C C C T A T T A T C A C T G T T T G C T C C T A A A A T A T C 2603_ai2.seq
8867 C C A T A G G T A A C T A A T G C A A C C C T A T T A T C A C T G T T T G C T C C T A A A A T A T C nem316_ai2.seq

     T T T T A C T G C G G T C C C A A G A G C T T C G G C A G C T T T C T T G G C T T T A T T A T G C C Majority
               9060      9070      9080      9090      9100
8920 T T T T A C T G C G G T C C C A A G A G C T T C G G C A G C T T T C T T G G C T T T A T T A T G C C 2603_ai2.seq
8917 T T T T A C T G C G G T C C C A A G A G C T T C G G C A G C T T T C T T G G C T T T A T T A T G C C nem316_ai2.seq
```

FIGURE 20O

Alignment Report of Ai-2_alignment, using J. Hein method with Weighted residue weight table.
Thursday, July 29, 2004 6:47 PM

```
     T T T G A A A A T T T G G G C C A T C G T T A T T C A T T G A G T T A G A A T T A T C G A G T A C G Majority
                       9110                9120                9130                9140                9150
8970 T T T G A A A A T T T G G G C C A T C G T T A T T C A T T G A G T T A G A A T T A T C G A G T A C G 2603_ai2.seq
8967 T T T G A A A A T T T G G G C C A T C G T T A T T C A T T G A G T T A G A A T T A T C G A G T A C G nem316_ai2.seq

     A A G A C A A C A T C T A A C G G C T T T T G T T T G T C C A C T G G T T T T A C T A T G G T T T T Majority
                       9160                9170                9180                9190                9200
9020 A A G A C A A C A T C T A A C G G C T T T T G T T T G T C C A C T G G T T T T A C T A T G G T T T T 2603_ai2.seq
9017 A A G A C A A C A T C T A A C G G C T T T T G T T T G T C C A C T G G T T T T A C T A T G G T T T T nem316_ai2.seq

     T C C A C T G A C A G T T A A C T C A A T T T T A T A T T T A T T A T G A G C T A A A T C A C C T A Majority
                       9210                9220                9230                9240                9250
9070 T C C A C T G A C A G T T A A C T C A A T T T T A T A T T T A T T A T G A G C T A A A T C A C C T A 2603_ai2.seq
9067 T C C A C T G A C A G T T A A C T C A A T T T T A T A T T T A T T A T G A G C T A A A T C A C C T A nem316_ai2.seq

     C T T C T G A A A T A C G T T T A G A T A A T G T T C C C T C T G G A A T T T C T C T T A T A T G C Majority
                       9260                9270                9280                9290                9300
9120 C T T C T G A A A T A C G T T T A G A T A A T G T T C C C T C T G G A A T T T C T C T T A T A T G C 2603_ai2.seq
9117 C T T C T G A A A T A C G T T T A G A T A A T G T T C C C T C T G G A A T T T C T C T T A T A T G C nem316_ai2.seq

     T C A C C T T C A C T T G A A T A T G G G T T A A C T G C T T T T G C C T C T G A C T T T C C A T T Majority
                       9310                9320                9330                9340                9350
9170 T C A C C T T C A C T T G A A T A T G G G T T A A C T G C T T T T G C C T C T G A C T T T C C A T T 2603_ai2.seq
9167 T C A C C T T C A C T T G A A T A T G G G T T A A C T G C T T T T G C C T C T G A C T T T C C A T T nem316_ai2.seq

     T G G A A C T G A A C C T T T A A C A T G C T C A A G T T T A T A A G A T T C C T T T G T A T C T T Majority
                       9360                9370                9380                9390                9400
9220 T G G A A C T G A A C C T T T A A C A T G C T C A A G T T T A T A A G A T T C C T T T G T A T C T T 2603_ai2.seq
9217 T G G A A C T G A A C C T T T A A C A T G C T C A A G T T T A T A A G A T T C C T T T G T A T C T T nem316_ai2.seq

     C A T A A A T T C C T G T G G G G G G A T A C T G C T T A T C T A G T T C T T C G T G A T T T T G T Majority
                       9410                9420                9430                9440                9450
9270 C A T A A A T T C C T G T G G G G G G A T A C T G C T T A T C T A G T T C T T C C T G A T T T T G T 2603_ai2.seq
9267 C A T A A A T T C C T G T G G G G G G A T A C T G C T T A T C T A G T T C T T C G T G A T T T T G T nem316_ai2.seq

     C C A A T T G T G G A A T T T T T A T C A C C A C T A T T T T G T A T C G T A G T T T T T C C A T T Majority
                       9460                9470                9480                9490                9500
9320 C C A A T T G T G G A A T T T T T A T C A C C A C T A T T T T G T A T C G T A G T T T T T C C A T T 2603_ai2.seq
9317 C C A A T T G T G G A A T T T T T A T C A C C A C T A T T T T G T A T C G T A G T T T T T C C A T T nem316_ai2.seq

     A C T C T C A A C C T T A A C T T G C C A A G T C T G G T T A G T C T T T T T A T A A C C T T C G G Majority
                       9510                9520                9530                9540                9550
9370 A C T C T C A A C C T T A A C T T G C C A A G T C T G G T T A G T C T T T T T A T A A C C T T C G G 2603_ai2.seq
9367 A C T C T C A A C C T T A A C T T G C C A A G T C T G G T T A G T C T T T T T A T A A C C T T C G G nem316_ai2.seq

     G C G C T G T T T C T T C T G A T A A A G T A T A A T C T C C A G G T A T G A G A T T A T C A A A A Majority
                       9560                9570                9580                9590                9600
9420 G C G C T G T T T C T T C T G A T A A A G T A T A A T C T C C A G G T A T G A G A T T A T C A A A A 2603_ai2.seq
9417 G C G C T G T T T C T T C T G A T A A A G T A T A A T C T C C A G G T A T G A G A T T A T C A A A A nem316_ai2.seq

     G T A G C T T C A C C T G T T A G C T C A G C A G T T A C T T T T T C T A T T T A C T T T C T G G Majority
                       9610                9620                9630                9640                9650
9470 G T A G C T T C A C C T G T T A G C T C A G C A G T T A C T T T T T C T A T T T A C T T T C T G G 2603_ai2.seq
9467 G T A G C T T C A C C T G T T A G C T C A G C A G T T A C T T T T T C T A T T T A C T T T C T G G nem316_ai2.seq

     A T G A G C A G T A G T T T T T A A A A C A A A G G T A G C T T T T G A A A G T G G T T T G T T C T Majority
                       9660                9670                9680                9690                9700
9520 A T G A G C A G T A G T T T T T A A A A C A A A G G T A G C T T T T G A A A G T G G T T T G T T C T 2603_ai2.seq
9517 A T G A G C A G T A G T T T T T A A A A C A A A G G T A G C T T T T G A A A G T G G T T T G T T C T nem316_ai2.seq

     G G T C A T C T G T C T T T T T A A C A A C T A A C T T T C C T T T A G C A C C A T T T T C C G G T Majority
                       9710                9720                9730                9740                9750
9570 G G T C A T C T G T C T T T T T A A C A A C T A A C T T T C C T T T A G C A C C A T T T T C C G G T 2603_ai2.seq
9567 G G T C A T C T G T C T T T T T A A C A A C T A A C T T T C C T T T A G C A C C A T T T T C C G G T nem316_ai2.seq
```

FIGURE 20P

Alignment Report of Ai-2_alignment, using J. Hein method with Weighted residue weight table.
Thursday, July 29, 2004 6:47 PM

```
                A C G G T A C T T T C C C C T A A A A C A T T G G T A T T A A G C G G T A T T T G C G A C A A A C A Majority
                         9760               9770              9780               9790               9800
9620            A C G G T A C T T T C C C C T A A A A C A T T G G T A T T A A G C G G T A T T T G C G A C A A A C A 2603_ai2.seq
9617            A C G G T A C T T T C C C C T A A A A C A T T G G T A T T A A G C G G T A T T T G C G A C A A A C A nem316_ai2.seq

                A A A A A G A C T T A A C G T C A A T A T T T T A G A A A A T T T T T G G T A T T T T C T C A T T T Majority
                         9810               9820              9830               9840               9850
9670            A A A A A G A C T T A A C G T C A A T A T T T T A G A A A A T T T T T G G T A T T T T C T C A T T T 2603_ai2.seq
9667            A A A A A G A C T T A A C G T C A A T A T T T T A G A A A A T T T T T G G T A T T T T C T C A T T T nem316_ai2.seq

                T A C A A C T C C T A T T G T G C C G A A A T G T C G T T T C T A A A T C T A A G A T C A G A T A C Majority
                         9860               9870              9880               9890               9900
9720            T A C A A C T C C T A T T G T G C C G A A A T G T C G T T T C T A A A T C T A A G A T C A G A T A C 2603_ai2.seq
9717            T A C A A C T C C T A T T G T G C C G A A A T G T C G T T T C T A A A T C T A A G A T C A G A T A C nem316_ai2.seq

                A G A A T A T C C T A G A A T A T A C A A A C T A T C A C T T A T T A T G A T A T C A A T A A T T T Majority
                         9910               9920              9930               9940               9950
9770            A G A A T A T C C T A G A A T A T A C A A A C T A T C A C T T A T T A T G A T A T C A A T A A T T T 2603_ai2.seq
9767            A G A A T A T C C T A G A A T A T A C A A A C T A T C A C T T A T T A T G A T A T C A A T A A T T T nem316_ai2.seq

                C T T A T T A T A A G G T A T G G A A T T T T A A T G T T T T T T C C C A A T T T T T G A A T G A T Majority
                         9960               9970              9980               9990              10000
9820            C T T A T T A T A A G G T A T G G A A T T T T A A T G T T T T T T C C C A A T T T T T G A A T A A T 2603_ai2.seq
9817            C T T A T T A T A A G G T A T G G A A T T T T A A A G T T T T T T C C C A A T T T T T G A A T G A T nem316_ai2.seq

                T T T T C T T T T T A T T T G A T A A T C T T A T T T T T T A T T A T C T T A G A A A T A T T T C A Majority
                        10010              10020             10030              10040              10050
9870            T T T T C T T T T T A T T T G A T A A T C T T A T T T T T T A T T A T C T T A G A A A T A T T T C A 2603_ai2.seq
9867            T T T T C T T T T T A T T T G A T A A T C T T A T T T T T T A T T A T C T T A G A A A T A C T T C A nem316_ai2.seq

                A T T A G C T T A A G T A G T T G A T T T T T C T T T T T T T A T G T T T T A A A A T A T T G C T T Majority
                        10060              10070             10080              10090              10100
9920            A T G A G C T T A A G T A G T T G A T T T T T C T T T T T T T A T G T T T T A A A A T A T T G C T T 2603_ai2.seq
9917            A T T A G C T T A A G T A G T T G A T T T T T C T T T T T T T A T G T T T T A A A A T A T T G C T T nem316_ai2.seq

                A A A A T A A T G T T T G A G A G A G A G T T T A C T G A A T T G A T T G A A A A T T A T T T A G Majority
                        10110              10120             10130              10140              10150
9970            A A A A T A A T G T T T G A G A G A    G T T T A C T G A A T T G A T T G A A A A T T A T T T A G 2603_ai2.seq
9967            A A A A T A A T G T T T G A G A G A G A G T T T A C T G A A T T G A T T G A A A A T T A T T T A G nem316_ai2.seq

                A A A A G A C A T C C T T A A T C A A A T A A A A C T T C T A A C T T T A T G C T A T G A T T A C Majority
                        10160              10170             10180              10190              10200
10018           A A A A G A C A T C C T T A A T C A A A T A A A A C T T C T A A C T T T A T G C T A T G A T T A C 2603_ai2.seq
10017           A A A A G A C A T C C T T A A T C A A A T A A A A C T T C T A A C T T T A T G C T A T G A T T A C nem316_ai2.seq

                T A C C C T T C C A T T A C T C T A G A C A A A T C A T G T C A T C A A C T T G G T T T A T C T G A Majority
                        10210              10220             10230              10240              10250
10068           T A C C C T T C C A T T A C T C T A G A C A A A T C A T G T C A T C A A C T T G G T T T A T C T G A 2603_ai2.seq
10067           T A C C C T T C C A T T A C T C T A G A C A A A T C A T G T C A T C A A C T T G G T T T A T C T G A nem316_ai2.seq

                A C T A C T T A T T A G G A A A T A T T G T C A T G A T T T A A C A A C T T T A T T T A A C A G T C Majority
                        10260              10270             10280              10290              10300
10118           A C T A C T T A T T A G G A A A T A T T G T C A T G A T T T A A C A A C T T T A T T T A A C A G T C 2603_ai2.seq
10117           A C T A C T T A T T A G G A A A T A T T G T C A T G A T T T A A C A A C T T T A T T T A A C A G T C nem316_ai2.seq

                A A C T C T C T C T G A A T A T C G A A A A G A G T A C A A T A G T C T A C C A A T C T A A T G G T Majority
                        10310              10320             10330              10340              10350
10168           A A C T C T C T C T G A A T A T C G A A A A G A G T A C A A T A G T C T A C C A A T C T A A T G G T 2603_ai2.seq
10167           A A C T C T C T C T G A A T A T C G A A A A G A G T A C A A T A G T C T A C C A A T C T A A T G G T nem316_ai2.seq

                G T A A C T A G A G A A C A A G C T T T C A A A T A T A T T T A T C A T C A A T C A C A C G T T T T Majority
                        10360              10370             10380              10390              10400
10218           G T A A C T A G A G A A C A A G C T T T C A A A T A T A T T T A T C A T C A A T C A C A C G T T T T 2603_ai2.seq
10217           G T A A C T A G A G A A C A A G C T T T C A A A T A T A T T T A T C A T C A A T C A C A C G T T T T nem316_ai2.seq
```

FIGURE 20Q

Alignment Report of Ai-2_alignment, using J. Hein method with Weighted residue weight table.
Thursday, July 29, 2004 6:47 PM

```
      A C A A C T T T T A A A A T T T T T G A T C A C G A A T G A T T C A G G C A G G T T A C C T T T A A Majority
                        10410           10420           10430           10440           10450
10268 A C A A C T T T T A A A A T T T T T G A T C A C G A A T G A T T C A G G C A G G T T A C C T T T A A 2603_ai2.seq
10267 A C A A C T T T T A A A A T T T T T G A T C A C G A A T G A T T C A G G C A G G T T A C C T T T A A nem316_ai2.seq

      C T T A C T T T A G T G A A A A A T T T G G A C T A T C T T G T G C A A C T G C T T A T C G C A T A Majority
                        10460           10470           10480           10490           10500
10318 C T T A C T T T A G T G A A A A A T T T G G A C T A T C T T G T G C A A C T G C T T A T C G C A T A 2603_ai2.seq
10317 C T T A C T T T A G T G A A A A A T T T G G A C T A T C T T G T G C A A C T G C T T A T C G C A T A nem316_ai2.seq

      C G A A A A C A T A T T A G T C C G T T A C T A G A A A A A C T T G G A T T T C A G A T T T T C A A Majority
                        10510           10520           10530           10540           10550
10368 C G A A A A C A T A T T A G T C C A T T A C T A G A A A A A C T T G G A T T T C A G A T T G T C A A 2603_ai2.seq
10367 C G A A A A C A T A T T A G T C C G T T A C T A G A A A A A C T T G G A T T T A A G A T T T T C A A nem316_ai2.seq

      A A A T A C T A T T A C C G G T G A C G A G T A T C G A A T T C G C T A T T T A A T C G C A T T T T Majority
                        10560           10570           10580           10590           10600
10418 A A A T A C T A T T A C C G G T G A C G A G T A T C G A A T T C G C T A T T T A A T C G C A T T T T 2603_ai2.seq
10417 A A A T A C T A T T A C C G G T G A C G A G T A T C G A A T T C G C T A T T T A A T C G C A C A T T nem316_ai2.seq

      T A A A T G C T C G A T T T G G T A T A G A A G T T T A T C C C T T G T C T A A G A T G G A T A A A Majority
                        10610           10620           10630           10640           10650
10468 T A A A T G C T C A A T T T G G T A T A G A A G T T T A T C C C A T G T C T A A G A T G G A T A A A 2603_ai2.seq
10467 T A A A T G C T C G A T T T G G T A T A G A A G T T T A T C C C T T A T C T A A G A T G G A T A A A nem316_ai2.seq

      T T G C T T A T C A A A C G A T T G T T A T T A G A A T A C T C A A C T A C T T T T A C T G C T T C Majority
                        10660           10670           10680           10690           10700
10518 T T G C T C A T C A A A C G A T T G T T A T T A G A A C A C T C A A C T A C T T T T A C T G C T T C 2603_ai2.seq
10517 T T G C T T A T C A A A C G A T T G T T A T T A G A A T A C T C A A C T A C T T T T A C T G C T T C nem316_ai2.seq

      T C A T T A C T T C C C A A A T A C A T T T A T T T T C T T T G A T A C A T T G T T G T C T C T A T Majority
                        10710           10720           10730           10740           10750
10568 T C A T T A C T T C C C A A A T A C A T T T A T T T T C T T T G A T A C A T T G T T G T C T C T A T 2603_ai2.seq
10567 T C A T T A C T T C C C A A A T A C A T T T A T T T T C T T T G A T A C A T T A T T G T C T C T A T nem316_ai2.seq

      C A T G G A A A C G T A T T A A T T A T A A T G T A G T T G T C C C T T A C T C A T C C C T T T T C Majority
                        10760           10770           10780           10790           10800
10618 C A T G G A A A C G T A T T A A T T A T A A T G T A G T T G T C C C T T A C T C A T C C C T T T T C 2603_ai2.seq
10617 C A T G G A A A C G T A T T A A T T A T A A T G T A G T T G T C C C T T A C T C A C C C C T T T T C nem316_ai2.seq

      A T T G A A C T A C A A A A T A T A T T T A T C T A T G A T A C A T T A C A A T A T T G T G T C A A Majority
                        10810           10820           10830           10840           10850
10668 A C T G A A C T A C A A A A T A T A T T T A T C T A T G A T A C A T T A C A A T A T T G T G T C A A 2603_ai2.seq
10667 A T T G A A C T A C A A A A T A T A T T T A T C T A T G A T A C A T T A C A A T A T T G T G T C A A nem316_ai2.seq

      A A A T G T T A T T A T A G A T T C C T T T A A A A T T A A T T T A A A A A A A G A C G A T A T A G Majority
                        10860           10870           10880           10890           10900
10718 A A A T G T T A T T A T A G A T T C C T T T A A A A T T A A T T T A A A A A A A G A C G A T A T A G 2603_ai2.seq
10717 A A A T G T T A T T A T A G A T T C C T T T A A A A T T A A T T T A A A A A A A G A C G A T A T A G nem316_ai2.seq

      A C T A T A T T T T T C T T G C T T A C C T T A C T T C C C A T A A C T C T T T T T C T A A T C C A Majority
                        10910           10920           10930           10940           10950
10768 A C T A T A T T T T T C T T G C T T A C C T T A C T T C C C A T A A C T C T T T T T C T A A T C C A 2603_ai2.seq
10767 A C T A T A T T T T T C T T G C T T A C C T T A C T T C C C A T A A C T C T T T T T C T A A T C C A nem316_ai2.seq

      A A T T G G A C T G A G A A G C G T A T C G A T A A T G T A A T A G C T A T T T T C G A A A A T T A Majority
                        10960           10970           10980           10990           11000
10818 A A T T G G A C T G A G A A G C G T A T C G A T A A T G T A A T A G C T A T T T T C G A A A A T T A 2603_ai2.seq
10817 A A T T G G A C T G A G A A G C G T A T C G A T A A T G T A A T A G C T A T T T T C G A A A A T T A nem316_ai2.seq

      T C C C A A A T T C C A A A A A T T A T T A C A G C C A C T C A A A G A T G C T C T T C C C T T A T Majority
                        11010           11020           11030           11040           11050
10868 T C C C A A A T T C C A A A A A T T A T T A C A G C C A C T C A A A G A T G C T C T T C C C T T A T 2603_ai2.seq
10867 T C C C A A A T T C C A A A A A T T A T T A C A G C C A C T C A A A G A T G C C C T T C C C T T A T nem316_ai2.seq
```

FIGURE 20R

Alignment Report of Ai-2_alignment, using J. Hein method with Weighted residue weight table.
Thursday, July 29, 2004 6:47 PM

```
      CTGGCTCCTATCATGATGAGTTGGTAAAAGTTGCTATCATTTTTTTCCGA Majority
               11060     11070     11080     11090     11100
10918 CTGGCTCCTATCATGATGAGTTGGTAAAAGTTGCTATC-TTTTTTTCCGA 2603_ai2.seq
10917 CTGACTCCTATCATGACGAGTTGGTAAAAGTTGCTATCATTTTTTCCCGA nem316_ai2.seq

      ACATTTATTTTAGGATTAAATCAATTAATCCCTGAAACAATTTCATTTCC Majority
               11110     11120     11130     11140     11150
10967 ACATTTATTTTAGGATTAAATCAATTAATCCCTGAAACAATTTCATTTCC 2603_ai2.seq
10967 ACATTTATTTTAGGATTAAATCAATTAATCCCTGAAACAATTTCATTTCC nem316_ai2.seq

      TTCATGGAACTATCATAGACATGATAAATTAACTACTATTCTCCGACCGA Majority
               11160     11170     11180     11190     11200
11017 TTCATGGAACTATCATAGACATGATAAATTAACTACTATTCTCCGACCGA 2603_ai2.seq
11017 TTCATGGAACTATCATAGACATGATAAATTAACTACTATTCTCCGACCGA nem316_ai2.seq

      TAATTACAAATTGGTTAAGTGAAATTGGAGAATACACGTTTAAGGAACAA Majority
               11210     11220     11230     11240     11250
11067 TAATTACAAATTGGTTAAGTAAAATTGGAGAATACACGTTTAAAGAACAA 2603_ai2.seq
11067 TAATTACAAATTGGTTAAGTGAAATTGGAGAATACACGTTTAAGGAACAA nem316_ai2.seq

      CATTTTCTTCTCCTTTGTGCTCATCTAGAAAGAATTATCAAAAATCATAT Majority
               11260     11270     11280     11290     11300
11117 CATTTTCTTCTCCTTTGTACTCATCTAGAAAGAATCATCAAAAATCATAT 2603_ai2.seq
11117 CATTTTCTTCTCCTTTGTGCTCACCTAGAAAGAATTATCAAAAATCACAT nem316_ai2.seq

      TCCTCCGATACAGATAGCCGTACTAACTACAGACTTTATTAATAACCAAA Majority
               11310     11320     11330     11340     11350
11167 TCCTCCGATACAGATAGCCGTACTAACTACAGACTTTATTAATAACCAAA 2603_ai2.seq
11167 TCCTCCGATACAAATAGCCGTACTAACTACAGACTTTATTAATAACAAAA nem316_ai2.seq

      TTTTAACAGAATGTTTATTACAGAGGTTTTCTTCTAAACAGATTCATTTC Majority
               11360     11370     11380     11390     11400
11217 TTTTAACAGAATGCTTATTACAGAGATTTTCTTCTAAAAAGATTCATTTC 2603_ai2.seq
11217 TTTTAACAGAATGTTTATCACAGAGGTTTTCTTCTAAACAGATTCATTTC nem316_ai2.seq

      CACCCTTACTATTTATTAACTGATGATCTTTCCAATATTACTAATCTTAA Majority
               11410     11420     11430     11440     11450
11267 CACCCTTACTATTTATTAACTGATGATCTTTCCAATATTACTAATCTTAA 2603_ai2.seq
11267 CACCCTTACTATTTATTAACTGATGATCTTTCCAATATTACTAATCTTAA nem316_ai2.seq

      TCCAGATATTATTATTACCAATCCAAAGCTTTCTTCCTTTATCAAACATG Majority
               11460     11470     11480     11490     11500
11317 TCCAGACATTATTATTACCAATAAAAAGCTTTCTCCCTTTATCAAACATG 2603_ai2.seq
11317 TCCAGATATTATTATTACCAACCCAAAGCTTTCTTCCTTTATAAAACATG nem316_ai2.seq

      AGATTTCTTCAGAGAGTTTAATTACATATATTGATTTGATTCATACTTCA Majority
               11510     11520     11530     11540     11550
11367 AGATTTCTTCAGAGAGTTTAATTACATATATTGATCTGATTAATACTTCA 2603_ai2.seq
11367 AGATTTCTTCAGAGAGTTTAATTACATATATTGATTTGATTCATACTCCA nem316_ai2.seq

      GACCAGATCAATCAAATCCAAGAAATTATTTCATCAATACAGGAAGAAAA Majority
               11560     11570     11580     11590     11600
11417 GACCAAATCAATCAAATCCAAAAAATTATTTCATCAATACAGGAAGAAAA 2603_ai2.seq
11417 GACCAGATCAATCAAATCCAAGAAATTATTTCATCAATACAAGAAGAAAA nem316_ai2.seq

      ATATTGTAAACTTTTTGCAAAAACTAATGAAATAACTACTCGTAGCTCCT Majority
               11610     11620     11630     11640     11650
11467 ATATTGCAAACTTTTTGCAAAAACTAATGAAATAACTAATCGTAGCTCCT 2603_ai2.seq
11467 ATATTGTAAACTTTTTGCAAAAAACAATGAAATAACTACCCGTAGCTCCT nem316_ai2.seq

      ATAACTCTTAAAAATTAACATTAAAAAGCTAGAGCATTGTGTAATGCTCT Majority
               11660     11670     11680     11690     11700
11517 ATAACTCTTAAAAATTAACATTAAAAAGCTAGAGCATTGTGTAATGCTCT 2603_ai2.seq
11517 ATAACTCTTAAAAATTAACATTAAAAAGCTAGAGCATTGTGTAATGCTCT nem316_ai2.seq
```

FIGURE 20S

Alignment Report of Ai-2_alignment, using J. Hein method with Weighted residue weight table.
Thursday, July 29, 2004 6:47 PM

```
      AGCTTTTTAATGTTAATTTTTTTGAATAATATAATCCAACTTTTCAACTG Majority
                11710     11720     11730     11740     11750
11567 AGCTTTTTAATGTTAATTTTTTTGAATAATATAATCCAACTTTTCAACTG 2603_ai2.seq
11567 AGCTTTTTAATGTTAATTTTTTTGAATAATATAATCCAACTTTTCAACTG nem316_ai2.seq

      TTTTTTCCCATGTGAAATGTTCTTTAATTCTTTTAGCAATATTCTGTTGT Majority
                11760     11770     11780     11790     11800
11617 TTTTTTCCCATGTGAAATGTTCTTTAATTCTTTTAGCAATATTCTGTTGT 2603_ai2.seq
11617 TTTTTTCCCATGTGAAATGTTCTTTAATTCTTTTAGCAATATTCTGTTGT nem316_ai2.seq

      AGTTTCTCTCTTAATGCCTTATCTTTTACTAATAAATCAAGAGATTCATG Majority
                11810     11820     11830     11840     11850
11667 AGTTTCTCTCTTAATGCCTTATCTTTTACTAATAAATCAAGAGATTCATG 2603_ai2.seq
11667 AGTTTCTCTCTTAATGCCTTATCTTTTACTAATAAATCAAGAGATTCATG nem316_ai2.seq

      GAGTGACTGAGTATTTTCTTCCATGATGATTCCTAACTCAGGGCTATCAA Majority
                11860     11870     11880     11890     11900
11717 GAGTGACTGAGTATTTTCTTCCATGATGATTCCTAACTCAGGGCTATCAA 2603_ai2.seq
11717 GAGTGACTGAGTATTTTCTTCCATGATGATTCCTAACTCAGGGCTATCAA nem316_ai2.seq

      TAACTTCAACTGTTCCACCGCGATCTGTTGCAATAATAGCACTTGAAAGT Majority
                11910     11920     11930     11940     11950
11767 TAACTTCAACTGTTCCACCGCGATCTGTTGCAATAATAGCACTTGAAAGT 2603_ai2.seq
11767 TAACTTCAACTGTTCCACCGCGATCTGTTGCAATAATAGCACTTGAAAGT nem316_ai2.seq

      AGACCAGCTTCTAAAATAGAGGTTGGTAATCCCTCTGGATACATTGAAGG Majority
                11960     11970     11980     11990     12000
11817 AGACCAGCTTCTAAAATAGAGGTTGGTAATCCCTCTGGATACATTGAAGG 2603_ai2.seq
11817 AGACCAGCTTCTAAAATAGAGGTTGGTAATCCCTCTGGATACATTGAAGG nem316_ai2.seq

      GTAAACAAAGATATCAGTCTGTGCCATTAAAGACATAGTCTGTTCAAAGT Majority
                12010     12020     12030     12040     12050
11867 GTAAACAAAGATATCAGTCTGTGCCATTAAAGACATAGTCTGTTCAAAGT 2603_ai2.seq
11867 GTAAACAAAGATATCAGTCTGTGCCATTAAAGACATAGTCTGTTCAAAGT nem316_ai2.seq

      TTAATTTCCCCAAAAAGTTAATCTGTTTGGACTGATATTTCTCTTTCAAA Majority
                12060     12070     12080     12090     12100
11917 TTAATTTCCCCAAAAAGTTAATCTGTTTGGACTGATATTTCTCTTTCAAA 2603_ai2.seq
11917 TTAATTTCCCCAAAAAGTTAATCTGTTTGGACTGATATTTCTCTTTCAAA nem316_ai2.seq

      TGTGCTAATTCAGGTCCGTCTCCTGCAATCTGTAAATAAACATTTTCAGA Majority
                12110     12120     12130     12140     12150
11967 TGTGCTAATTCAGGTCCGTCTCCTGCAATCTGTAAATAAACATTTTCAGA 2603_ai2.seq
11967 TGTGCTAATTCAGGTCCGTCTCCTGCAATCTGTAAATAAACATTTTCAGA nem316_ai2.seq

      GTACTGTGACATCGAAAATGCTTCTAAGAGCAATTCAATGCCTTTTTCTT Majority
                12160     12170     12180     12190     12200
12017 GTACTGTGACATCGAAAATGCTTCTAAGAGCAATTCAATGCCTTTTTCTT 2603_ai2.seq
12017 GTACTGTGACATCGAAAATGCTTCTAAGAGCAATTCAATGCCTTTTTCTT nem316_ai2.seq

      TAATAATTCTACCAGCATAAGTGATGAAAATATCATCAGCAGATTTTTCA Majority
                12210     12220     12230     12240     12250
12067 TAATAATTCTACCAGCATAAGTGATGAAAATATCATCAGCAGATTTTTCA 2603_ai2.seq
12067 TAATAATTCTACCAGCATAAGTGATGAAAATATCATCAGCAGATTTTTCA nem316_ai2.seq

      AGGTAAGCCGTACCAGCAAAATCAGAGCCTAGACTTTCAGATACCGAATT Majority
                12260     12270     12280     12290     12300
12117 AGGTAAGCCGTACCAGCAAAATCAGAGCCTAGACTTTCAGATACCGAATT 2603_ai2.seq
12117 AGGTAAGCCGTACCAGCAAAATCAGAGCCTAGACTTTCAGATACCGAATT nem316_ai2.seq

      ATAAATAACTCCTTTAGCTTCTATATTAAAATGTTTTAACCATTCAACGC Majority
                12310     12320     12330     12340     12350
12167 ATAAATAACTCCTTTAGCTTCTATATTAAAATGTTTTAACCATTCAACGC 2603_ai2.seq
12167 ATAAATAACTCCTTTAGCTTCTATATTAAAATGTTTTAACCATTCAACGC nem316_ai2.seq
```

FIGURE 20T

Alignment Report of Ai-2_alignment, using J. Hein method with Weighted residue weight table.
Thursday, July 29, 2004 6:47 PM T T C T C T T G G A T A C C G C A T A A A A A T C T G G A C G A T A A T G C T T A A C A C G C G C T Majority
12360 12370 12380 12390 12400
12217 T T C T C T T G G A T A C C G C A T A A A A A T C T G G A C G A T A A T G C T T A A C A C G C G C T 2603_ai2.seq
12217 T T C T C T T G G A T A C C G C A T A A A A A T C T G G A C G A T A A T G C T T A A C A C G C G C T nem316_ai2.seq G T G A G A A G A T G T T C A T A G A T A G C T C C A A A G A A A T C T A A A A A A C G A T T A T T Majority
12410 12420 12430 12440 12450
12267 G T G A G A A G A T G T T C A T A G A T A G C T C C A A A G A A A T C T A A A A A A C G A T T A T T 2603_ai2.seq
12267 G T G A G A A G A T G T T C A T A G A T A G C T C C A A A G A A A T C T A A A A A A C G A T T A T T nem316_ai2.seq G A C A G A A A A A T G A C T T G A C C C A T G G T C T A A A A C A A T A C T A G G T A A A T G G T Majority
12460 12470 12480 12490 12500
12317 G A C A G A A A A A T G A C T T G A C C C A T G G T C T A A A A C A A T A C T A G G T A A A T G G T 2603_ai2.seq
12317 G A C A G A A A A A T G A C T T G A C C C A T G G T C T A A A A C A A T A C T A G G T A A A T G G T nem316_ai2.seq G A T T C T T T G C A A A A G A T A G C C C T T C T A G C G T T G T T A A C T G A A A A C G T G T A Majority
12510 12520 12530 12540 12550
12367 G A T T C T T T G C A A A A G A T A G C C C T T C T A G C G T T G T T A A C T G A A A A C G T G T A 2603_ai2.seq
12367 G A T T C T T T G C A A A A G A T A G C C C T T C T A G C G T T G T T A A C T G A A A A C G T G T A nem316_ai2.seq T T A C A A A T C A C A A A A T C A A T A T T T T C A T C T G A A A C A T A T T T C A T C A G C G T Majority
12560 12570 12580 12590 12600
12417 T T A C A A A T C A C A A A A T C A A T A T T T T C A T C T G A A A C A T A T T T C A T C A G C G T 2603_ai2.seq
12417 T T A C A A A T C A C A A A A T C A A T A T T T T C A T C T G A A A C A T A T T T C A T C A G C G T nem316_ai2.seq G T T G T A T T C T C G A T T T T T G T T A A T A A T A G G A T A G C G C T G C T T G A C A A T A T Majority
12610 12620 12630 12640 12650
12467 G T T G T A T T C T C G A T T T T T G T T A A T A A T A G G A T A G C G C T G C T T G A C A A T A T 2603_ai2.seq
12467 G T T G T A T T C T C G A T T T T T G T T A A T A A T A G G A T A G C G C T G C T T G A C A A T A T nem316_ai2.seq T T T T G G T C G G T A A A C G G T A A A T T T T T C T A C C C T T G T C T T C A T C T A T A A T C Majority
12660 12670 12680 12690 12700
12517 T T T T G G T C G G T A A A C G G T A A A T T T T T C T A C C C T T G T C T T C A T C T A T A A T C 2603_ai2.seq
12517 T T T T G G T C G G T A A A C G G T A A A T T T T T C T A C C C T T G T C T T C A T C T A T A A T C nem316_ai2.seq G G T A A A T C A C C A T G A T T A G T T G T T A C A A T A A C A A C A C G G T A G C C A C G C T T Majority
12710 12720 12730 12740 12750
12567 G G T A A A T C A C C A T G A T T A G T T G T T A C A A T A A C A A C A C G G T A G C C A C G C T T 2603_ai2.seq
12567 G G T A A A T C A C C A T G A T T A G T T G T T A C A A T A A C A A C A C G G T A G C C A C G C T T nem316_ai2.seq A A C C A A A T C T G C T G T C A T T T T A T C T G T A T A A C G T T C A A T A C C T C C G A G G A Majority
12760 12770 12780 12790 12800
12617 A A C C A A A T C T G C T G T C A T T T T A T C T G T A T A A C G T T C A A T A C C T C C G A G G A 2603_ai2.seq
12617 A A C C A A A T C T G C T G T C A T T T T A T C T G T A T A A C G T T C A A T A C C T C C G A G G A nem316_ai2.seq A G G G T A G A T A A T A T C C T G A G A A A A C A G C A A C T G T T T T T A C C T T A T T T T C C Majority
12810 12820 12830 12840 12850
12667 A G G G T A G A T A A T A T C C T G A G A A A A C A G C A A C T G T T T T T A C C T T A T T T T C C 2603_ai2.seq
12667 A G G G T A G A T A A T A T C C T G A G A A A A C A G C A A C T G T T T T T A C C T T A T T T T C C nem316_ai2.seq A T A T T T A T C C A C T T T C A T C A A T A A G C C A T C T T T T A A G C C T T T A A T C A T A G Majority
12860 12870 12880 12890 12900
12717 A T A T T T A T C C A C T T T C A T C A A T A A G C C A T C T T T T A A G C C T T T A A T C A T A G 2603_ai2.seq
12717 A T A T T T A T C C A C T T T C A T C A A T A A G C C A T C T T T T A A G C C T T T A A T C A T A G nem316_ai2.seq C A A C T A T T T T T T T G C T C T T T T G C T C T T C T G C T A C C A A C A C T C G A A C A A A T Majority
12910 12920 12930 12940 12950
12767 C A A C T A T T T T T T T G C T C T T T T G C T C T T C T G C T A C C A A C A C T C G A A C A A A T 2603_ai2.seq
12767 C A A C T A T T T T T T T G C T C T T T T G C T C T T C T G C T A C C A A C A C T C G A A C A A A T nem316_ai2.seq T C A T T T C G C A T A A A T A C T A A A T A T T T G T A T C G C T T C T T C T T A C C A T A T T T Majority
12960 12970 12980 12990 13000
12817 T C A T T T C G C A T A A A T A C T A A A T A T T T G T A T C G C T T C T T C T T A C C A T A T T T 2603_ai2.seq
12817 T C A T T T C G C A T A A A T A C T A A A T A T T T G T A T C G C T T C T T C T T A C C A T A T T T nem316_ai2.seq

FIGURE 20U

Alignment Report of Ai-2_alignment, using J. Hein method with Weighted residue weight table.
Thursday, July 29, 2004 6:47 PM

```
      T T T T A T A A T A T A G A T C G C A T T G C G T A T C A T G T A A T A T T T T C G A A A T G G T G Majority
                          13010               13020               13030               13040               13050
12867 T T T T A T A A T A T A G A T C G C A T T G C G T A T C A T G T A A T A T T T T C G A A A T G G T G 2603_ai2.seq
12867 T T T T A T A A T A T A G A T C G C A T T G C G T A T C A T G T A A T A T T T T C G A A A T G G T G nem316_ai2.seq

      A A T G A T T C A A T A C A T G A A A A A C A T G G C C A A A T T T T T T A A C T C G T G A A G A G Majority
                          13060               13070               13080               13090               13100
12917 A A T G A T T C A A T A C A T G A A A A A C A T G G C C A A A T T T T T T A A C T C G T G A A G A G 2603_ai2.seq
12917 A A T G A T T C A A T A C A T G A A A A A C A T G G C C A A A T T T T T T A A C T C G T G A A G A G nem316_ai2.seq

      T G T C C A A T T T C G T G T A A C A G A C C A A T A A A A T T A A C C T G A T A A G T C T T A T A Majority
                          13110               13120               13130               13140               13150
12967 T G T C C A A T T T C G T G T A A C A G A C C A A T A A A A T T A A C C T G A T A A G T C T T A T A 2603_ai2.seq
12967 T G T C C A A T T T C G T G T A A C A G A C C A A T A A A A T T A A C C T G A T A A G T C T T A T A nem316_ai2.seq

      T C C C A T C T C T G A C A G A C G A T A A T T C A T T T C A G A G T C A A C A A A A T C A A T A A Majority
                          13160               13170               13180               13190               13200
13017 T C C C A T C T C T G A C A G A C G A T A A T T C A T T T C A G A G T C A A C A A A A T C A A T A A 2603_ai2.seq
13017 T C C C A T C T C T G A C A G A C G A T A A T T C A T T T C A G A G T C A A C A A A A T C A A T A A nem316_ai2.seq

      A C A T C T C T T C T G C A A A G C C A G A T G T T T C T T C G A A A A C G C T C G T T T T C A T T Majority
                          13210               13220               13230               13240               13250
13067 A C A T C T C T T C T G C A A A G C C A G A T G T T T C T T C G A A A A C G C T C G T T T T C A T T 2603_ai2.seq
13067 A C A T C T C T T C T G C A A A G C C A G A T G T T T C T T C G A A A A C G C T C G T T T T C A T T nem316_ai2.seq

      A A A G C A G C C G A A G T A A T A C A C T C T T C A A T T T C T T T A T A G T C A A A T T C T T G Majority
                          13260               13270               13280               13290               13300
13117 A A A G C A G C C G A A G T A A T A C A C T C T T C A A T T T C T T T A T A G T C A A A T T C T T G 2603_ai2.seq
13117 A A A G C A G C C G A A G T A A T A C A C T C T T C A A T T T C T T T A T A G T C A A A T T C T T G nem316_ai2.seq

      C A T C A C T A A A T T T T C A C G G T T C A T A T C T T G A T A C A A A C A A G A T A A C A T A C Majority
                          13310               13320               13330               13340               13350
13167 C A T C A C T A A A T T T T C A C G G T T C A T A T C T T G A T A C A A A C A A G A T A A C A T A C 2603_ai2.seq
13167 C A T C A C T A A A T T T T C A C G G T T C A T A T C T T G A T A C A A A C A A G A T A A C A T A C nem316_ai2.seq

      C G A C C T T A G G T A A A T G A A G G T A A T T T T C A T A A T T A T C T A T C A A A T C A C C T Majority
                          13360               13370               13380               13390               13400
13217 C G A C C T T A G G T A A A T G A A G G T A A T T T T C A T A A T T A T C T A T C A A A T C A C C T 2603_ai2.seq
13217 C G A C C T T A G G T A A A T G A A G G T A A T T T T C A T A A T T A T C T A T C A A A T C A C C T nem316_ai2.seq

      A G G A C A A C C G A A T C T T G A T C T A A A G T C A A G A A C C A A T C A A A T T C T T G T G C Majority
                          13410               13420               13430               13440               13450
13267 A G G A C A A C C G A A T C T T G A T C T A A A G T C A A G A A C C A A T C A A A T T C T T G T G C 2603_ai2.seq
13267 A G G A C A A C C G A A T C T T G A T C T A A A G T C A A G A A C C A A T C A A A T T C T T G T G C nem316_ai2.seq

      T A C T G C A A A T T G A C C G A T A C A G T T C A A A G C A T A T G C A A T C C C T T T A T T T T Majority
                          13460               13470               13480               13490               13500
13317 T A C T G C A A A T T G A C C G A T A C A G T T C A A A G C A T A T G C A A T C C C T T T A T T T T 2603_ai2.seq
13317 T A C T G C A A A T T G A C C G A T A C A G T T C A A A G C A T A T G C A A T C C C T T T A T T T T nem316_ai2.seq

      C T G T T A A A T A A T C A A C A G T T A G G T G C C C C T C T T C A T T A T A A T C G G C T A C T Majority
                          13510               13520               13530               13540               13550
13367 C T G T T A A A T A A T C A A C A G T T A G G T G C C C C T C T T C A T T A T A A T C G G C T A C T 2603_ai2.seq
13367 C T G T T A A A T A A T C A A C A G T T A G G T G C C C C T C T T C A T T A T A A T C G G C T A C T nem316_ai2.seq

      A A T T G A G A A A T T T C T T C C T T A T T T T T C G A G C C A T T A T C T A C G A T A T A G A T Majority
                          13560               13570               13580               13590               13600
13417 A A T T G A G A A A T T T C T T C C T T A T T T T T C G A G C C A T T A T C T A C G A T A T A G A T 2603_ai2.seq
13417 A A T T G A G A A A T T T C T T C C T T A T T T T T C G A G C C A T T A T C T A C G A T A T A G A T nem316_ai2.seq

      G T G G C T T A C T T G A G G A T A A A T T G C T C G A A T G T T C T G A T C T A A G C G T T C A A Majority
                          13610               13620               13630               13640               13650
13467 G T G G C T T A C T T G A G G A T A A A T T G C T C G A A T G T T C T G A T C T A A G C G T T C A A 2603_ai2.seq
13467 G T G G C T T A C T T G A G G A T A A A T T G C T C G A A T G T T C T G A T C T A A G C G T T C A A nem316_ai2.seq
```

FIGURE 20V

Alignment Report of Ai-2_alignment, using J. Hein method with Weighted residue weight table.
Thursday, July 29, 2004 6:47 PM

```
      TATTGGGGTTAAAGGTGACAATACCCGCTAAATATTTCATGTTCTATGCT Majority
                13660     13670     13680     13690     13700
13517 TATTGGGGTTAAAGGTGACAATACCCGCTAAATATTTCATGTTCTATGCT 2603_ai2.seq
13517 TATTGGGGTTAAAGGTGACAATACCCGCTAAATATTTCATGTTCTATGCT nem316_ai2.seq

      CTTTTCTAAAATCTCTAAATAACTGAATGACTGGTGCTTTGGTTATAAAA Majority
                13710     13720     13730     13740     13750
13567 CTTTTCTAAAATCTCTAAATAACTGAATGACTGGTGCTTTGGTTATAAAA 2603_ai2.seq
13567 CTTTTCTAAAATCTCTAAATAACTGAATGACTGGTGCTTTGGTTATAAAA nem316_ai2.seq

      ACGATACCGACATAGATAGTTACTGCTACTAAACTTTGAATGACATAATT Majority
                13760     13770     13780     13790     13800
13617 ACGATACCGACATAGATAGTTACTGCTACTAAACTTTGAATGACATAATT 2603_ai2.seq
13617 ACGATACCGACATAGATAGTTACTGCTACTAAACTTTGAATGACATAATT nem316_ai2.seq

      TACCAATGATACTGACATTTGAGTATTGATATAATAGAGTACAGCTCCAC Majority
                13810     13820     13830     13840     13850
13667 TACCAATGATACTGACATTTGAGTATTGATATAATAGAGTACAGCTCCAC 2603_ai2.seq
13667 TACCAATGATACTGACATTTGAGTATTGATATAATAGAGTACAGCTCCAC nem316_ai2.seq

      TAAGAGTAGCAGCAATTAAATAGCGCAGCATTCCTCTTGTTAATTCTTTA Majority
                13860     13870     13880     13890     13900
13717 TAAGAGTAGCAGCAATTAAATAGCGCAGCATTCCTCTTGTTAATTCTTTA 2603_ai2.seq
13717 TAAGAGTAGCAGCAATTAAATAGCGCAGCATTCCTCTTGTTAATTCTTTA nem316_ai2.seq

      AAAGTAAATACATCTCTTAAAGAGATAGCTTGATATAGGGAGACAATAAA Majority
                13910     13920     13930     13940     13950
13767 AAAGTAAATACATCTCTTAAAGAGATAGCTTGATATAGGGAGACAATAAA 2603_ai2.seq
13767 AAAGTAAATACATCTCTTAAAGAGATAGCTTGATATAGGGAGACAATAAA nem316_ai2.seq

      TTCAGTAATAACTGTAGAGATAATAGCTCCCATAGCACCTAAAATTGGTA Majority
                13960     13970     13980     13990     14000
13817 TTCAGTAATAACTGTAGAGATAATAGCTCCCATAGCACCTAAAATTGGTA 2603_ai2.seq
13817 TTCAGTAATAACTGTAGAGATAATAGCTCCCATAGCACCTAAAATTGGTA nem316_ai2.seq

      TTAAAAGTATATTAAGCACAACATTTGCCACAAGTCCAATAACTGCAGAC Majority
                14010     14020     14030     14040     14050
13867 TTAAAAGTATATTAAGCACAACATTTGCCACAAGTCCAATAACTGCAGAC 2603_ai2.seq
13867 TTAAAAGTATATTAAGCACAACATTTGCCACAAGTCCAATAACTGCAGAC nem316_ai2.seq

      ATTGTGTAAGCTTTTGTACGTCTTGAAGCCAGTAGATACTGTGTCCCTAA Majority
                14060     14070     14080     14090     14100
13917 ATTGTGTAAGCTTTTGTACGTCTTGAAGCCAGTAGATACTGTGTCCCTAA 2603_ai2.seq
13917 ATTGTGTAAGCTTTTGTACGTCTTGAAGCCAGTAGATACTGTGTCCCTAA nem316_ai2.seq

      AGCGTTACCATAAGAAATGCAAATGATCATCAAA                 Majority
                14110     14120     14130
13967 AGCGTTACCATAAGAAATGCAAATGATCATCAAA                 2603_ai2.seq
13967 AGCGTTACCATAAGAAATGCAAATGATCATCAAA                 nem316_ai2.seq
```

Decoration 'Decoration #1': Shade (with solid black) residues that differ from the Consensus.

FIGURE 21A

Alignment Report of ai-2_variant_2, using J. Hein method with Weighted residue weight table.
Thursday, July 29, 2004 6:49 PM

```
         T C C A C A T C G G T C C A A T T A A C A T A T G A C G T G G C G C A T C A C C A G T A A T T C G G  Majority
                   10          20          30          40          50
  1      T C C A C A T C G G T C C A A T T A A C A T A T G A C G T G G C G C A T C A C C A G T A A T T C G G  coh1_ai2.seq
  1      T C C A C A T C G G T C C A A T T A A C A T A T G A C G T G G C G C A T C A C C A G T A A T T C G G  a909_ai2.seq

         T G A A T A A C A A T A T G T T T T G G A A T A A T C T C C A G T T G G T C A C A A A T A A T C G A  Majority
                   60          70          80          90         100
 51      T G A A T A A C A A T A T G T T T T G G A A T A A T C T C C A G T T G G T C A C A A A T A A T C G A  coh1_ai2.seq
 51      T G A A T A A C A A T A T G T T T T G G A A T A A T C T C C A G T T G G T C A C A A A T A A T C G A  a909_ai2.seq

         A A T A T A G T C T T C T T G A C T T A A C A A A C G T A A A C G A C C T T C A T G G T A A T C T C  Majority
                  110         120         130         140         150
101      A A T A T A G T C T T C T T G A C T T A A C A A A C G T A A A C G A C C T T C A T G G T A A T C T C  coh1_ai2.seq
101      A A T A T A G T C T T C T T G A C T T A A C A A A C G T A A A C G A C C T T C A T G G T A A T C T C  a909_ai2.seq

         T C T G C A T T C T T G T A T T A G T C A T A A G A T G C A G A A G G T G T A A T T T T A T A C C C  Majority
                  160         170         180         190         200
151      T C T G C A T T C T T G T A T T A A T C A T A A G A T G C A G A A G G T G T A A T T T T A T A C C C  coh1_ai2.seq
151      T C T G C A T T C T T G T A T T A G T C A T A A G A T G C A G A A G G T G T A A T T T T A T A C C C  a909_ai2.seq

         T G A A T A T C A T T A T C C G T A A C A C A T C G A C G A A C A T T T T C C A C C A T C A T A T C  Majority
                  210         220         230         240         250
201      T G A A T A T C A T T A T C C G T A A C A C A T C G A C G A A C A T T T T C C A C C A T C A T A T C  coh1_ai2.seq
201      T G A A T A T C A T T A T C C G T A A C A C A T C G A C G A A C A T T T T C C A C C A T C A T A T C  a909_ai2.seq

         A T G T G T C T C C C C T G G G A G A C C A T T T A T T A G G T G A G A A A C G A T T T C T A C T T  Majority
                  260         270         280         290         300
251      A T G T G T C T C C C C T G G G A G A C C A T T T A T T A G G T G A G A A A C G A T T T C T A C T T  coh1_ai2.seq
251      A T G T G T C T C C C C T G G G A G A C C A T T T A T T A G G T G A G A A A C G A T T T C T A C T T  a909_ai2.seq

         T A G G A G C T A A T T C T C G T A T T C T C T T A A C A G T T T T T T T G T A A A G G T C A T A T  Majority
                  310         320         330         340         350
301      T A G G A G C T A A T T C T C G T A C T C T C T T A A C A G T T T T T T T G T A A A G G T C A T A T  coh1_ai2.seq
301      T A G G A G C T A A T T C T C G T A T T C T C T T A A C A G T T T T T T T G T A A A G G T C A T A T  a909_ai2.seq

         G A A T G T G C T C T A T T T A T T A A T G C A G A A G T T G C T T C A T A A G T T G T C T G A A G  Majority
                  360         370         380         390         400
351      G A A T G T G C T C T A T T T A T T A A T G C A G A A G T T G C T T C A T A A G T T G T C T G A A G  coh1_ai2.seq
351      G A A T G T G C T C T A T T T A T T A A T G C A G A A G T T G C T T C A T A A G T T G T C T G A A G  a909_ai2.seq

         G C C T A A T T C T A A A G T C A C A T G C A T T C T T T C A G A A A G T T C A G C G A G A T A G T  Majority
                  410         420         430         440         450
401      G C C T A A T T C T A A A G T C A C A T G C A T T C T T T C A G A A A G T T C A G C G A G A T A G T  coh1_ai2.seq
401      G C C T A A T T C T A A A G T C A C A T G C A T T C T T T C A G A A A G T T C A G C G A G A T A G T  a909_ai2.seq

         A T A T A G T T T C A T C A G G T A A G C A A T C C G G C C T T G T T C C G A T G T T G A T C C C G  Majority
                  460         470         480         490         500
451      A T A T A G T T T C A T C A G G T A A G C A A T C C G G C C T T G T T C C G A T G T T G A T C C C G  coh1_ai2.seq
451      A T A T A G T T T C A T C A G G T A A G C A A T C C G G C C T T G T T C C G A T G T T G A T C C C G  a909_ai2.seq

         A T A A C T C C T G G C T C A T T A A T A G C C T G T T C G T A A C G C T C T T T A A T T A T C T C  Majority
                  510         520         530         540         550
501      A T A A C T C C T G G C T C A T T A A T A G C C T G T T C G T A A C G C T C T T T A A T T A T C T C  coh1_ai2.seq
501      A T A A C T C C T G G C T C A T T A A T A G C C T G T T C G T A A C G C T C T T T A A T T A T C T C  a909_ai2.seq

         T A A C T T A G C A T G G G T A T T G G T A A A A T T T T G A A A A T A G A C T A A G T A T T T A T  Majority
                  560         570         580         590         600
551      T A A C T T A G C A T G G G T A T T G G T A A A A T T T T G A A A A T A G A C T A A G T A T T T A T  coh1_ai2.seq
551      T A A C T T A G C A T G G G T A T T G G T A A A A T T T T G A A A A T A G A C T A A G T A T T T A T  a909_ai2.seq

         T A A C C T C A G G C C A C T T T C T A T G C A T G A A A T C A A T T T C T T T A T A G A A T T G T  Majority
                  610         620         630         640         650
601      T A A C C T C A G G C C A C T T T C T A T G C A T G A A A T C A A T T T C T T T A T A G A A T T G T  coh1_ai2.seq
601      T A A C C T C A G G C C A C T T T C T A T G C A T G A A A T C A A T T T C T T T A T A G A A T T G T  a909_ai2.seq
```

FIGURE 21B

Alignment Report of ai-2_variant_2, using J. Hein method with Weighted residue weight table.
Thursday, July 29, 2004 6:49 PM

```
     TCACGAATAGGAGCTTCTGGAGCAACTATAGCATCCCCTGAACCAGAAAC Majority
              660       670       680       690       700
651  TCACGAATAGGAGCTTCTGGAGCAACTATAGCATCCCCTGAACCAGAAAC cohl_ai2.seq
651  TCACGAATAGGAGCTTCTGGAGCAACTATAGCATCCCCTGAACCAGAAAC a909_ai2.seq

     TGTGCAAAAAGTGCACCCTCCTCTAGCAACTGTTCCATCTCTGTTAGGAC Majority
              710       720       730       740       750
701  TGTGCAAAAAGTGCACCCTCCTCTAGCAACTGTTCCATCTCTGTTAGGAC cohl_ai2.seq
701  TGTGCAAAAAGTGCACCCTCCTCTAGCAACTGTTCCATCTCTGTTAGGAC a909_ai2.seq

     AGTCAAAACCAGCATCTATAGGTAATTTAAATATTTTTTCTCCAAAGAGT Majority
              760       770       780       790       800
751  AGTCAAAACCAGCATCTATAGGTAATTTAAATATTTTTTCTCCAAAGAGT cohl_ai2.seq
751  AGTCAAAACCAGCATCTATAGGTAATTTAAATATTTTTTCTCCAAAGAGT a909_ai2.seq

     TCTCGATAATAATCATTAATCGCACGATAACGTTTTTTCATAGGATAATT Majority
              810       820       830       840       850
801  TCTCGATAATAATCATTAATCGCACGATAACGTTTTTTCATAGGATAATT cohl_ai2.seq
801  TCTCGATAATAATCATTAATCGCACGATAACGTTTTTTCATAGGATAATT a909_ai2.seq

     GTATCACAATTTTAACTAAAATAACCTCACTACTACAATAAAACTAAAAA Majority
              860       870       880       890       900
851  GTATCACAATTTTAACTAAAATAACCTCACTACTACAATAAAACTAAAAA cohl_ai2.seq
851  GTATCACAATTTTAACTAAAATAACCTCACTACTACAATAAAACTAAAAA a909_ai2.seq

     AGATTGGAACGTCAGTTAGTTCCAATCTTTTATTTACTTCACTTTCTTTA Majority
              910       920       930       940       950
901  AGATTGGAACGTCAGTTAGTCCCAATCTTTTATTTACTTCACTTTCTTTA cohl_ai2.seq
901  AGATTGGAACGTCAGTTAGTTCCAATCTTTTATTTACTTCACTTTCTTTA a909_ai2.seq

     ACCAATCCTTGGCTAAAAAGATATACGCAGTTAGATTCAAAATACCATAA Majority
              960       970       980       990      1000
951  ACCAATCCTTGGATAAAAAGATATACGCAGTTAGATTCAAAATACCATAA cohl_ai2.seq
951  ACCAATCCTTGGCTAAAAAGATATACGCAGTTAGATTCAAAATACCATAA a909_ai2.seq

     GCAAGTATAAAACCAGCTAAAACATCTGTCGGAAAATGAACCCCTAGGTA Majority
             1010      1020      1030      1040      1050
1001 GCAAGTATAAAACCAGCTAAAACATCTGTCGGAAAATGAACCCCTAGGTA cohl_ai2.seq
1001 GCAAGTATAAAACCAGCTAAAACATCTGTCGGAAAATGAACCCCTAGGTA a909_ai2.seq

     AATACGAGATAACCCAATTAAAAAAATGAGCAAACCCAATGTACCTTGGC Majority
             1060      1070      1080      1090      1100
1051 AATACGAGATAACCCAATTAAAAAAATGAGCAAACCCAATGTACCTTGGC cohl_ai2.seq
1051 AATACGAGATAACCCAATTAAAAAAATGAGCAAACCCAAAATACCTTGGC a909_ai2.seq

     ACAACAGTTTCCATATACTCTTAGGCATATAGTACTGCAATAAAATAATA Majority
             1110      1120      1130      1140      1150
1101 ACAACAGTTTCCATATACTCTTAGGCATATAGTACTGCAATAAAATAATA cohl_ai2.seq
1101 ACAACAGTTTCCATATACTCTTAGGCATATAGTACTGCAATAAAATAATA a909_ai2.seq

     CTACTCCCAAATATCATAAATGTTCCCATCGAGTGCCCACTGGGAAACGA Majority
             1160      1170      1180      1190      1200
1151 CTACTCCCAAATATCATAAATGTTCCCATCGAGTGCCCACTGGGAAACGA cohl_ai2.seq
1151 ATACTCCCAAATATCATAAATGTTCCCATCGAGTGCCCACTGGGAAACGA a909_ai2.seq

     ATAGCCACCTGCAAATACTAAATGGGTTAAAGTTGGTCTCACTCTTTGAA Majority
             1210      1220      1230      1240      1250
1201 ATAGCCACCTGCAAATACTAAATGGGTTAAAGTTGGTCTCACTCTTTGAA cohl_ai2.seq
1201 ATAGCCACCTGCAAATACTAAATGGGTTAAAGTTGGTCTCACTCTTTGAA a909_ai2.seq

     AAATAAGTTTTAAAGAAAGTATACATATACCAGAGATAATAGCATTTACT Majority
             1260      1270      1280      1290      1300
1251 AAATAAGTTTTAAAGAAAGTATACATATACCAGAGATAATAGCATTTACT cohl_ai2.seq
1251 AAATAAGTTTTAAAGAAAGTATACATATACCAGAGATAATAGCATTTACT a909_ai2.seq
```

FIGURE 21C

Alignment Report of ai-2_variant_2, using J. Hein method with Weighted residue weight table.
Thursday, July 29, 2004 6:49 PM

```
     GCGATAAATCTAGCTTGAGGATACCACTTCTTAAGGTAACAGAAAGTGAC Majority
               1310      1320      1330      1340      1350
1301 GCGATAAATCTAGCTTGAGGATACCACTTCTTAAGGTAACAGAAAGTGAC coh1_ai2.seq
1301 GCGATAAATCTAGCTTGAGGATACCACTTCTTAAGGTAACAGAAAGTGAC a909_ai2.seq

     GCTCATAATCGCAATAGCTATCTGGCTTACAGTATTACCAACCACAGTGA Majority
               1360      1370      1380      1390      1400
1351 GCTCATAATCGCAATAGCTATCTGGCTTACAGTATTACCAACCACAGTGA coh1_ai2.seq
1351 GCTCATAATCGCAATAGCTATCTGGCTTACAGTATTACCAACCACAGTGA a909_ai2.seq

     TTAACTTGAAAAATCTTGTAGAAAGATTTGGCAACTGTCCTCTAACACTT Majority
               1410      1420      1430      1440      1450
1401 TTAACTTAAAAAATCTTGTAGAAAGATTTGGCAACTGTCCTCTAACACTT coh1_ai2.seq
1401 TTAACTTGAAAAATCTTGTAGAAAGATTTGGCAACTGTCCTCTAACACTT a909_ai2.seq

     TCTTGAATAGTTTGGTCAAATGCGATTACAGTGTCGGGCCAATATTTGAT Majority
               1460      1470      1480      1490      1500
1451 TCTTGAATAGTTTGGTCAAATGCGATTACAGTGTCGGGCCAATATTTGAT coh1_ai2.seq
1451 TCTTGAATAGTTTGGTCAAATGCGATTACAGTGTCGGGCCAATATTTGAT a909_ai2.seq

     GACCAATCCTAAACTGAAAAATAAGATAATAGCAATAAATGCTTGAATAA Majority
               1510      1520      1530      1540      1550
1501 GACCAATCCTAAACTGAAAAATAAGATAATAGCAATAAATGCTTGAATAA coh1_ai2.seq
1501 GACCAATCCTAAACTGAAAAATAAGATAATAGCAATAAATGCTTGAATAA a909_ai2.seq

     GTTTACTATTTTGACGAGATAACATTAGTCTTTTTATATCTTTCTAATAT Majority
               1560      1570      1580      1590      1600
1551 GTTTACTATTTTGACGAGATAACATTAGTCTTTTTATATCTTTCTAATAT coh1_ai2.seq
1551 GTTTACTATTTTGACGAGATAACATTAGTCTTTTTATATCTTTCTAATAT a909_ai2.seq

     TGGCAAACAAGCCACGTAAGTTAGATAGAAAACAATCGAAATTAAAATTC Majority
               1610      1620      1630      1640      1650
1601 TGGCAAACAAGCCACGTAAGTTAGATAGAAAACAATCGAAATTAAAATTC coh1_ai2.seq
1601 TGGCAAACAAGCCACGTAAGTTAGATAGAAAACAATCGAAATTAAAATTC a909_ai2.seq

     CCTCAACGATATTAAATGGAATAACCATTGTTAAAAGGTAATTGCCTACA Majority
               1660      1670      1680      1690      1700
1651 CCTCAACGATATTAAATGGAATAACCATTGTTAAAAGGTAATTGCCTACA coh1_ai2.seq
1651 CCTCAACGATATTAAATGGAATAACCATTGTTAAAAGGTAATTGCCTACA a909_ai2.seq

     CCAATAAATGTTCTGATATCAAAGTTAGCAAATATAGCATACAAAGGAAT Majority
               1710      1720      1730      1740      1750
1701 CCAATAAATGTTCTGATATCAAAGTTAGCAAATATAGCATACAAAGGAAT coh1_ai2.seq
1701 CCAATAAATGTTCTGATATCAAAGTTAGCAAATATAGCATACAAAGGAAT a909_ai2.seq

     CGCAAAGACATAGTTGAGAGCTACCATAGATACAGTCAAGCTAACTGTAC Majority
               1760      1770      1780      1790      1800
1751 CGCAAAGACATAGTTGAGAGCTACCATAGATACAGTCAAGCTAACTGTAC coh1_ai2.seq
1751 CGCAAAGACATAGTTGAGAGCTACCATAGATACAGTCAAGCTAACTGTAC a909_ai2.seq

     CAAATAAACTAGCTTTAATAAAATCTTTTGCACTCTCTCTATTTTTCCAG Majority
               1810      1820      1830      1840      1850
1801 CAAATAAACTAGCTTTAATAAAATCTTTTGCACTCTCTCTATTTTTCCAG coh1_ai2.seq
1801 CAAATAAACTAGCTTTAATAAAATCTTTTGCACTCTCTCTATTTTTCCAG a909_ai2.seq

     AAAATAGCGAAACTTGCTAAAAATAGAGCTAGAGCAACCATATTCATCGG Majority
               1860      1870      1880      1890      1900
1851 AAAATAGCGAAACTTGCTAAAAATAGAGCTAGAGCAACCATATTCATCGG coh1_ai2.seq
1851 AAAATAGCGAAACTTGCTAAAAATAGAGCTAGAGCAACCATATTCATCGG a909_ai2.seq

     TAAACCGATAAAGGTTTCTGGACCACGATTAGCAAGTATAACTTTTAAAA Majority
               1910      1920      1930      1940      1950
1901 TAAACCGATAAAGGTTTCTGGACCACGATTAGCAAGTATAACTTTTAAAA coh1_ai2.seq
1901 TAAACCGATAAAGGTTTCTGGACCACGATTAGCAAGTATAACTTTTAAAA a909_ai2.seq
```

FIGURE 21D

Alignment Report of ai-2_variant_2, using J. Hein method with Weighted residue weight table.
Thursday, July 29, 2004 6:49 PM

```
     G T G A T C T T A A T A A G A G T A C A C C A T A A C T T G A T T T C A A A T C A A A T A A A A T A  Majority
                        1960                1970                1980                1990                2000
1951 G T G A T C T T A A T A A G A G T A C A C C A T A A C T T G A T T T C A A A T C A A A T A A A A T A  coh1_ai2.seq
1951 G T G A T C T T A A T A A G A G T A C A C C A T A A C T T G A T T T C A A A T C A A A T A A A A T A  a909_ai2.seq

     A A A G C A A C T A A C A T C G G A A G G A T T G A A A A A T C A A C C T T T A A A A A T T C T G C  Majority
                        2010                2020                2030                2040                2050
2001 A A A G C A A C T A A C A T C G G A A G G A T T G A A A A A T C A A C C T T T A A A A A T T C T G C  coh1_ai2.seq
2001 A A A G C A A C T A A C A T C G G A A G G A T T G A A A A A T C A A C C T T T A A A A A T T C T G C  a909_ai2.seq

     T C C T G G T A T T A A T G G A A A T G A A A C C A T C A T C A A T A C A A A A G A T A A G G C A G  Majority
                        2060                2070                2080                2090                2100
2051 T C C T G G T A T T A A T G G A A A T G A A A C C A T C A T C A A T A C A A A A G A T A A G G C A G  coh1_ai2.seq
2051 T C C T G G T A T T A A T G G A A A T G A A A C C A T C A T C A A T A C A A A A G A T A A G G C A G  a909_ai2.seq

     A A A G A A T G G C G A T T G T C A C C A T T T T A C G T G T A T T T G T C A T A A A A A A A T T C  Majority
                        2110                2120                2130                2140                2150
2101 A A A G A A T G G C G A T T G T C A C C A T T T T A C G T G T A T T T G T C A T A A A A A A A T T C  coh1_ai2.seq
2101 A A A G A A T G G C G A T T G T C A C C A T T T T A C G T G T A T T T G T C A T A A A A A A A T T C  a909_ai2.seq

     C T C C A A T T T A A A T A A A T T G A A A G A A G C T C C A A A G G T A A G C G T A G G T A C G C  Majority
                        2160                2170                2180                2190                2200
2151 C T C C A A T T T A A A T A A A T T G A A A G A A G C T C C A A A G G T A A G C G T A G G T A C G C  coh1_ai2.seq
2151 C T C C A A T T T A A A T A A A T T G A A A G A A G C T C C A A A G G T A A G C G T A G G T A C G C  a909_ai2.seq

     G A A A A A A A C C T T T G T C T T C T C C C A T C C A G A C T T T A C T G T C G G T T G T G G A A  Majority
                        2210                2220                2230                2240                2250
2201 G A A A A A A A C C T T T G T C T T C T C C C A T C C A G A C T T T A C T G T C G G T T G T G G A A  coh1_ai2.seq
2201 G A A A A A A A C C T T T G T C T T C T C C C A T C C A G A C T T T A C T G T C G G T T G T G G A A  a909_ai2.seq

     T C T C A C C A C A T C A G C T T T C G C T C G C G G A C T G A T G C T T C A C A A C T G A C A A A  Majority
                        2260                2270                2280                2290                2300
2251 T C T C A C C A C A T C A G C T T T C G C T C G C G G A C T G A T G C T T C A C A A C T G A C A A A  coh1_ai2.seq
2251 T C T C A C C A C A T C A G C T T T C G C T C G C G G A C T G A T G C T T C A C A A C T G A C A A A  a909_ai2.seq

     T A A G T T G G A A G C G A T T A C C G C C G G T C G G G A A T T A C A C C C T G C C C T G A A G A  Majority
                        2310                2320                2330                2340                2350
2301 T A A G T T G G A A G C G A T T A C C G C C G G T C G G G A A T T A C A C C C T G C C C T G A A G A  coh1_ai2.seq
2301 T A A G T T G G A A G C G A T T A C C G C C G G T C G G G A A T T A C A C C C T G C C C T G A A G A  a909_ai2.seq

     C A C C T A T A G C A T A A C A A A A A A A A C T T G C A A T T G C A A G T T T T T T A A T C A C T  Majority
                        2360                2370                2380                2390                2400
2351 C A C C T A T A G C A T A A C A A A A A A A A C T T G C A A T T G C A A G T T T T T T A A T C A C T  coh1_ai2.seq
2351 C A C C T A T A G C A T A A C A A A A A A A A C T T G C A A T T G C A A G T T T T T T A A T C A C T  a909_ai2.seq

     A A T T A G T A G T A G A T T G T A T A A T A T T A A T T T T T A A C A T C A A T T A A T T G A C A  Majority
                        2410                2420                2430                2440                2450
2401 A A T T A G T A G T A G A T T G T A T A A T A T T A A T T T T T A A C A T C A A T T A A T T G A C A  coh1_ai2.seq
2401 A A T T A G T A G T A G A T T G T A T A A T A T T A A T T T T T A A C A T C A A T T A A T T G A C A  a909_ai2.seq

     G C G C A C T A A T A C T C T A G C T A C T C C T G C C T T T G T A C A A G T A A A C A A G C T T A  Majority
                        2460                2470                2480                2490                2500
2451 G C G C A C T A A T A C T C T A G C T A C T C C T G C C T T T G T A C A A G T A A A C A A G C T T A  coh1_ai2.seq
2451 G C G C A C T A A T A C T C T A G C T A C T C C T G C C T T T G T A C A A G T A A A C A A G C T T A  a909_ai2.seq

     A G T C C C A A T C A T T G T C T G A T G T G G C A G T T T T A T A A A C T T T T T C A A T C G C T  Majority
                        2510                2520                2530                2540                2550
2501 A G T C C C A A T C A T T G T C T G A T G T G G C A G T T T T A T A A A C T T T T T C A A T C G C T  coh1_ai2.seq
2501 A G T C C C A A T C A T T G T C T G A T G T G G C A G T T T T A T A A A C T T T T T C A A T C G C T  a909_ai2.seq

     G T T G G T T C A A T A A T T T C T C T A T T A C T G A T T T T G T A G T G A T A G A T T T G C C C  Majority
                        2560                2570                2580                2590                2600
2551 G T T G G T T C A A T A A T T T C T C T A T T A C T G A T T T T G T A G T G A T A G A T T T G C C C  coh1_ai2.seq
2551 G T T G G T T C A A T A A T T T C T C T A T T A C T G A T T T T G T A G T G A T A G A T T T G C C C  a909_ai2.seq
```

FIGURE 21E

Alignment Report of ai-2_variant_2, using J. Hein method with Weighted residue weight table.
Thursday, July 29, 2004 6:49 PM

```
            T G T T G T A G T T G T A A A A T A A A C A T C C G T T C C C A T A T C T A C A T T T T T T A A A G  Majority
                         2610              2620              2630              2640              2650
2601        T G T T G T A G T T G T A A A A T A A A C A T C C G T T C C C A T A T C T A C A T T T T T T A A A G  coh1_ai2.seq
2601        T G T T G T A G T T G T A A A A T A A A C A T C C G T T C C C A T A T C T A C A T T T T T T A A A G  a909_ai2.seq

            C A T C A A A A T G A T A A G G A A A A T T A T G C G C A C A A A T C A C C A T G T T A T T A G T T  Majority
                         2660              2670              2680              2690              2700
2651        C A T C A A A A T G A T A A G G A A A A T T A T G C G C A C A A A T C A C C A T G T T A T T A G T T  coh1_ai2.seq
2651        C A T C A A A A T G A T A A G G A A A A T T A T G C G C A C A A A T C A C C A T G T T A T T A G T T  a909_ai2.seq

            A A A T A A G A A C C A T A A T A C C T T G T A G G C G T T T T A G A C A G T T G T T C A A A A C T  Majority
                         2710              2720              2730              2740              2750
2701        A A A T A A G A A C C A T A A T A C C T T G T A G G C G T C T T A G A C A G T T G T T C A A A A C T  coh1_ai2.seq
2701        A A A T A A G A A C C A T A A T A C C T T G T A G G C G T T T T A G A C A G T T G T T C A A A A C T  a909_ai2.seq

            A T A A T T A G C A G C T A C C G G T A A A T G C A G T T T T A A G T T C G G A A T A T C C A G A G  Majority
                         2760              2770              2780              2790              2800
2751        A T A A T T A G C A G C T A C C G G T A A A T G C A G T T T T A A G T T C G G A A T A T C C A G A G  coh1_ai2.seq
2751        A T A A T T A G C A G C T A C C G G T A A A T G C A G T T T T A A G T T C G G A A T A T C C A G A G  a909_ai2.seq

            T T C C C A A G T A A T C T G T T T T A T C C A A C T T T T T T A C A G G T A A T T C T C C A T T T  Majority
                         2810              2820              2830              2840              2850
2801        T T C C C A A G T A A T C T G T T T T A T C C A A C T T T T T T A C A G G T A A T T C T C C A T T T  coh1_ai2.seq
2801        T T C C C A A G T A A T C T G T T T T A T C C A A C T T T T T T A C A G G T A A T T C T C C A T T T  a909_ai2.seq

            T C T G A A C C C T T T A C T T G A T G C G T A A T A G A T T T A T C A A G C G C C T T G A C A A T  Majority
                         2860              2870              2880              2890              2900
2851        T C T G A A C C C T T T A C T T G A T G C G T A A T A G A T T T A T C A A G C A C C T T G A C A A T  coh1_ai2.seq
2851        T C T G A A C C C T T T A C T T G A T G C G T A A T A G A T T T A T C A A G C G C C T T G A C A A T  a909_ai2.seq

            A T G C T G A G A A G T T A A A T C A G C T T G A T G C G C C T G A T T A A T A T T A T A C C A A C  Majority
                         2910              2920              2930              2940              2950
2901        A T G C T G A G A A G T T A A A T C A G C T T G A T G C G C C T G A T T A A T A T T A T A C C A A C  coh1_ai2.seq
2901        A T A C T G A G A A G T T A A A T C A G C T T G A T G C G C C T G A T T A A T A T T A T A C C A A C  a909_ai2.seq

            C C C A A T A G A T T C C A G A A C T T A C C A G A A T G A T T C C G A G T A T C G C T A A A A A A  Majority
                         2960              2970              2980              2990              3000
2951        C C C A A T A G A T T C C A G A A C T T A C C A G A A T A A T T C C G A G T A T A G C T A A A A A A  coh1_ai2.seq
2951        C C C A A T A G A T T C C A G A A C T T A C C A G A A T G A T T C C A A G T A T C G C T A A A A A A  a909_ai2.seq

            T T T G C T G A A T A T C T T C T A A T C A C G T C T T C T T C T C C A T T T T A A G G C T A T T A  Majority
                         3010              3020              3030              3040              3050
3001        T T T G C T G A A T A T C T T C T A A T C A C G T C T T C T T C T C C A T T T T A A A G C T A T T A  coh1_ai2.seq
3001        T T T G C T G A A T A T C T T C T A A T C A C G T C T T C T T C T C C A T T T T A A G G C T A T T A  a909_ai2.seq

            T T A A A C A C A G A A G T C C T G A C A T A A T T A G T A T A G G T A T T G G C C A C C A T A C T  Majority
                         3060              3070              3080              3090              3100
3051        T T A A A C A C A G A A G T C C T G A C A T A A T T A G T A T A G G T A T T G G C C A C C A T A C T  coh1_ai2.seq
3051        T T A A A C A C A G A A G T C C T G A C A T A A T T A G T A T A G G T A T T G G C C A C C A T A C T  a909_ai2.seq

            T G T C C A G T A A A C G G G A G C T T T C C C T T T G T C T G A T G T G T T A C T G T A G G A G T  Majority
                         3110              3120              3130              3140              3150
3101        T G T C C A G T A A A C G G A A G C T T T C C C T T T G T C T G A T G T G T T A C T G T A G G A G T  coh1_ai2.seq
3101        T G T C C A G T A A A C G G G A G C T T T C C C T T T G T C T G A T G T G C T A C T G T A G G A G T  a909_ai2.seq

            A A T T G T C T C T T C T T T T T T A G G T T T A G C A T T T A A A G G G C T C A T T T T C T C A A  Majority
                         3160              3170              3180              3190              3200
3151        A A T T G T C T C T T C T T T T T T A G G T T T A G C A T T T A A A G G G C T C A T T T T C T C A A  coh1_ai2.seq
3151        A A T C G T C T C T T C T T T T T T A G G T T T A G C A T T T A A A G G G C T C A T T T T C T C A A  a909_ai2.seq

            A T G C T G T A A T A T C G T A C T T C C C A T C C T T A G G T A T T G A T A G T A T A A A G G G A  Majority
                         3210              3220              3230              3240              3250
3201        A T G C T G T A A T A T C G T A C T T C C C A T C C T T A G G T A T T G A T A G T A T A A A G G G A  coh1_ai2.seq
3201        A T G C T G T A A T A T C G T A C T T C C C A T C C T T A G G T A T T G A T A G T A T A A A G G G A  a909_ai2.seq
```

FIGURE 21F

Alignment Report of ai-2_variant_2, using J. Hein method with Weighted residue weight table.
Thursday, July 29, 2004 6:49 PM GACATTAGTTCATAACCTTGAGCTGTTTTAGTCTGAATAAATAGATAAAT Majority
3260 3270 3280 3290 3300
3251 GACATTAGTTCATAACCTTGAGCCGTTTTAGTCTGAATAAATAGATAAAT coh1_ai2.seq
3251 GACATTAGTTCATAACCTTGAGCTGTTTTAGTCTGAATAAATAGATAAAT a909_ai2.seq CCCTTGAGGAAGATTGTTCGCAACAATACCTTCAGCCGGTAAATTATCAA Majority
3310 3320 3330 3340 3350
3301 CCCTTGAGGAAGATTGTTCGCAACAATACCTTCAGCCGGTAAATTATCAA coh1_ai2.seq
3301 CCCTTGAGGAAGATTGTTCGCAACAATACCTTCAGCCGGTAAATTATCAA a909_ai2.seq ACGTTTGTAAAGGTTGAGTTTTATGAACAGCTTTTGTTAGTAGATTGACG Majority
3360 3370 3380 3390 3400
3351 ACGTTTGTAAAGGTTGAGTTTTATGAACAGCTTTTGTTAGTAGATTGACG coh1_ai2.seq
3351 ACGTTTGTAAAGGTTGAATTTTATGAACAGCTTTTGTTAGTAGATTGACA a909_ai2.seq TATTTGGCTTGGTTACTATCAAGGTTTACTTGTGTTAGATCATCGTCTTT Majority
3410 3420 3430 3440 3450
3401 TATTTGGCTTGGTTACTATCAAGGTTTACTTGTGTTAGATCATCGTCTTT coh1_ai2.seq
3401 TATTTGGCTTGGTTACTATCAAGGTTTACTTGTGTTAAATCATCGTCTTT a909_ai2.seq TATTCCAATACCTTGAAATGGGGTAGTTAGAGTAAAAACTTGGTTACCAT Majority
3460 3470 3480 3490 3500
3451 TATTCCAATACCTTGAAATGGGGTAGTTAGAGTAAAAACTTGATTACCAT coh1_ai2.seq
3451 TATTCCAATACCTTGAAATGGGGTAGTTAGAGTAAAAACTTGGTTACCAT a909_ai2.seq CAACATCTTTAGCTTGTGCTACTTGGTAAACAAGTAAATTACCGCCAGCG Majority
3510 3520 3530 3540 3550
3501 CAACATCTTTAGCTTGTGCTACTTGGTAAACAAGTAAATTACCGCCAGCG coh1_ai2.seq
3501 CAACATCTTTAGCTTGTGCTACTTGGTAAACAAGTAAATTACCGCCAGCG a909_ai2.seq ATACCTTGATTATTATACTTATTTTGTATAGTAATAGAACCCGTTTTCAT Majority
3560 3570 3580 3590 3600
3551 ATACCTTGATTATTATACTTATTTTGTATAGTAATAGAACCCGTTTTCAT coh1_ai2.seq
3551 ATACCTTGATTATTATACTTATTTTGTATAGTAATAGAACCCGTTTTCAT a909_ai2.seq CTGATCATTGGTATCAGCAGACACAAGTTGAGTACTTAGACTAAATAATA Majority
3610 3620 3630 3640 3650
3601 CTGATCATTGGTATCAGCAGACACAAGTTGAGTACTTAGACTAAATAATA coh1_ai2.seq
3601 CTGATCATTGGTATCAGCAGACACAAGTTGAGTACTTAGACTAAATAATA a909_ai2.seq AGAGAAGAGTTATCTTTAGGATCTTTTTATAAATCATTGTTCTCTTCCTT Majority
3660 3670 3680 3690 3700
3651 AGAGAAGAGTTATCTTTAGGATCTTTTTATAAATCATTGTTCTCTTCCTT coh1_ai2.seq
3651 AGAGAAGAGTTATATTTAGGATCTTTTTATAAATCATTGTTCTCTTCCTT a909_ai2.seq TCTCATTGCTTGTTTTAAAATTTTCTTACGTTGACGTGCTCTCCTAGTTA Majority
3710 3720 3730 3740 3750
3701 TCTCATTGCTTGTTTTAAAATTTTCTTACGTTGACGTGCTCTCCTAGTTA coh1_ai2.seq
3701 TCTCATTGCTTGTTTTAAAATTTTCTTACGTTGACGTGCTCTCCTAGTTA a909_ai2.seq CTTCTAAAGAGATTAAAAGTAAAATCAAAGTAAGGAAAATAGCGATAAAT Majority
3760 3770 3780 3790 3800
3751 CTTCTAAAGAGATTAAAAGTAAAATCAAAGTAAGGAAAATAGCGATAAAT coh1_ai2.seq
3751 CTTCTAAAAAGATTAAAAGTAAAATCAAAGTAAGGAAAATAGCGATAAAT a909_ai2.seq GGTGCGATATAAATAGGCTCTATTTGTATTGCCTCTGCTACTACCAAAGC Majority
3810 3820 3830 3840 3850
3801 GGTGCGATATAAATAGGCTCTATTTGTATTGCCTCTGCTACTACCAAAGC coh1_ai2.seq
3801 GGTGCGATATAAATAGGCTCTATTTGTATTGCCTCTGCTACCACCAAAGC a909_ai2.seq GTTACCATTATCGTTTGGTACACGATGTCCTCTCACTAGTAACCGATGGG Majority
3860 3870 3880 3890 3900
3851 GTTACCATTATCGTTTGGTACACGATGTCCTCTCACTAGTAACCGATGGG coh1_ai2.seq
3851 GTTACCATTATCGTTTGGTACACGATGTCCTCTCACTAGTAACCGATGGG a909_ai2.seq

FIGURE 21G

Alignment Report of ai-2_variant_2, using J. Hein method with Weighted residue weight table.
Thursday, July 29, 2004 6:49 PM

```
     TATTAACGCCATATGGTGTACACGTCACCAAAGTTTGGTAGTCTTTACCT Majority
              3910      3920      3930      3940      3950
3901 TATTAACGCCATATGGTGTACACGTCACCAAAGTTTGGTAGTCTTTACCT coh1_ai2.seq
3901 TATTAACACCATATGGTGTACACGTCACCAAAGTTTGGTAGTCTTTACCT a909_ai2.seq

     TTAACAATTTGTAAATCCCTCAAATCATCCGGTTTAACTGTTCTGATTTG Majority
              3960      3970      3980      3990      4000
3951 TTAACAATTTGTAAATCCCTCAAATCATCCGGTTTAACTGTTCTGATTTG coh1_ai2.seq
3951 TTAACAATTTGTAAATCCCTCAAATCATCCGGTTTAACTGTTCTGATTTG a909_ai2.seq

     ATCCACTTGATAAGTATATGTTTCATTTAAGATACTGACTGTCCAGTGGT Majority
              4010      4020      4030      4040      4050
4001 ATCCACTTGATAAGTATATGTTTCATTTAAGATACTGACTGTCCAGTGGT coh1_ai2.seq
4001 ATCCACTTGATAAGTATATGTTTCATTTAAGATACTGACTGTCCAGTGGT a909_ai2.seq

     CTCCAGCTTTTAACTTATCCAAATCAGAAAAAAGCCTTGAAGAGGGTAAA Majority
              4060      4070      4080      4090      4100
4051 CTCCAACTTTTAACTTATCCAAATCAGAAAAAAGCCTTGAAGAGGGTAAA coh1_ai2.seq
4051 CTCCAGCTTTTAACTTATCCAAATCAGAAAAAAGCCTTGAAGAGGGTAAA a909_ai2.seq

     CCTCTATGTCCTGATAAAATAGAATGAGTTGAGTCTCCTCCAATTGGAAG Majority
              4110      4120      4130      4140      4150
4101 CCTCTATGTCCTGATAAAATAGAATGAGTTGAGTCTCCTCCAATTGGAAG coh1_ai2.seq
4101 CCTCTATGTCCTGATAAAATAGAATGAGTTGAGTCTCCTCCAATTGGAAG a909_ai2.seq

     ACTACTTCCTTCTAAATGACCAATAGAAGTTTGAAGCACTTTTTCACTTG Majority
              4160      4170      4180      4190      4200
4151 ACTACTTCCTTCTAAATGACCAATAGAAGTTTGAAGCACTTTTTCACTTG coh1_ai2.seq
4151 ACTACTTCCTTCTAAATGACCAATAGAAGTTTGAAGCACCTTTTCACTTG a909_ai2.seq

     TACCATGATAAAGTGGTAATTTTATGTTTATCTTTGGAATTGAAATATAA Majority
              4210      4220      4230      4240      4250
4201 TACCATGATAAAGTGGTAATTTTATGTTTATCTTTGGAATTGAAATATAA coh1_ai2.seq
4201 TACCATGATAAAGTGGTAATTTTATATTTATCTTTGGAATTGAAATATAA a909_ai2.seq

     CCCATATTACCCGTTTTATCGATAGCCAGTTGTGAATTATAATCCAAACG Majority
              4260      4270      4280      4290      4300
4251 CCCATATTACCCGTTTTATCGATAGCCAGTTGTGAATTATAATCCAAACG coh1_ai2.seq
4251 CCCATATTACCCGTTTTATCGATAGCCAGTTGTGAATTATAATCCAAACG a909_ai2.seq

     CTCTTGGTTAGTCATGTGCCACTTCATTCCTGAAGTTTTAAATTGCTTAT Majority
              4310      4320      4330      4340      4350
4301 CTCTTGGCTAGTCATGTGCCACTTCATTCCTGAAGTTTTAAATTGCTTAT coh1_ai2.seq
4301 CTCTTGGTCAGTCATGTGCCACTTCATTCCTGAAGTTTTAAATTGCTTAT a909_ai2.seq

     TATATTCTTTGGCTCGGTTAATAATTTTTTTATAGTCGTTTTCATCCATA Majority
              4360      4370      4380      4390      4400
4351 TATATTCTTTGGCTCGGTTAATAATTTTTTTATAATCGTTTTCATCCATA coh1_ai2.seq
4351 TATATTCTTTGGCTCGGTTAATAATTTTTTTATAGTCGTTTTCATCCATA a909_ai2.seq

     TGCGTTACGCGGTCTTGGTAATCCATAATCGCTCGAGATTGGTGAAATGA Majority
              4410      4420      4430      4440      4450
4401 TGCGTTACGCGGTCTTGGTAATCCATAATCGCTCGAGATTGGTGAAATGA coh1_ai2.seq
4401 TGCGTTACGCGGTCTTGGTAATCCATAATCGCTCGAGATTGGTGAAATGA a909_ai2.seq

     ATTCCAATAATTAGCAAGTGAAGGATAAGCCATTAAGCCTACCCCCACTG Majority
              4460      4470      4480      4490      4500
4451 ATTCCAATAATTAGCAAGTGAAGGATAAGCCATTAAGCCTACCCCCACTG coh1_ai2.seq
4451 ATTCCAATAATTAGCAAGTGAAGGATAAGCCATTAAGCCTACCCCCACTG a909_ai2.seq

     CAATTATAGTGACAAGCAAAATGGATACTAAATGTTGTCTTATTTTTTTC Majority
              4510      4520      4530      4540      4550
4501 CAATTATAGTGACAAGCAAAATGGATACTAAATGTTGTCTTATTTTTTTC coh1_ai2.seq
4501 CAATTATAGTGACAAGCAAAATGGATACTAAATGTTGTCTTATTTTTTTC a909_ai2.seq
```

FIGURE 21H

Alignment Report of ai-2_variant_2, using J. Hein method with Weighted residue weight table.
Thursday, July 29, 2004 6:49 PM

```
     ATATATTTTAAATCTGTACCACTTTGCTAGCCCATCTTATTAAGAACGTA Majority
               4560      4570      4580      4590      4600
4551 ATATATTTTAAATCTGTACCACTTTGCTAGCCCATCTTATTAAGAACGTA coh1_ai2.seq
4551 ATATATTTTAAATCTGTACCACTTTGCTAGCCCATCTTATTAAGAACGTA a909_ai2.seq

     AACGACGACGAGCAACAAGCACGATACCTGCTCCTATTACTAAAATTGCA Majority
               4610      4620      4630      4640      4650
4601 AACGACGACGAGCAACAAGCACGATACCTGCTCCTATTACTAAAATTGCA coh1_ai2.seq
4601 AACGACGACGAGCAACAAGCACGATACCTGCTCCTATTACTAAAATTGCA a909_ai2.seq

     CCTATAATGTAGAAAATTGTTGTACCAATACCACCTGTTGAAGGCAACTC Majority
               4660      4670      4680      4690      4700
4651 CCTATAATGTAGAAAATTGTTGTACCAATACCACCTGTTGAAGGCAACTC coh1_ai2.seq
4651 CCTATAATGTAGAAAATTGTTGTACCAATACCACCTGTTGAAGGCAACTC a909_ai2.seq

     AGTACCTTTGTTATTTTCAACAGTTGGGTTAACTAAAAGGTTATCTGAAT Majority
               4710      4720      4730      4740      4750
4701 AGTACCTTTGTTATTTTCAACAGTTGGGTTAACTAAAAGGTTATCTGAAT coh1_ai2.seq
4701 AGTACCTTTGTTATTTTCAACAGTTGGGTTAACTAAAAGGTTATCTGAAT a909_ai2.seq

     TAGTCGTATCAGTGGCTCCATCTCCTAAAATAACCTTCTGAGAGTTATCT Majority
               4760      4770      4780      4790      4800
4751 TAGTCGTATCAGTGGCTCCATCTCCTAAAATAACCTTCTGAGAGTTATCT coh1_ai2.seq
4751 TAGTCGTATCAGTGGCTCCATCTCCTAAAATAACCTTCTGAGAGTTATCT a909_ai2.seq

     AACAAATTGTAACCTAAGGGAGCCTTTTTCTCAACTAGATAGTATGTACC Majority
               4810      4820      4830      4840      4850
4801 AACAAATTGTAACCTAAGGGAGCCTTTTTCTCAACTAGATAGTATGTACC coh1_ai2.seq
4801 AACAAATTGTAACCTAAGGGAGCCTTTTTCTCAACTAGATAGTATGTACC a909_ai2.seq

     TTCTTTCAAGCCTGTAATGGTAATTATACCATCTGCTCCTGTTGTATATT Majority
               4860      4870      4880      4890      4900
4851 TTCTTTCAAGCCTGTAATGGTAATTATACCATCTGCTCCTGTTGTATATT coh1_ai2.seq
4851 TTCTTTCAAGCCTGTAATGGTAATTATACCATCTGCTCCTGTTGTATATT a909_ai2.seq

     CTGTTGCATTAGCTTCTGTGCCCCATTCAACGTTATTTGTATCGTTAAAG Majority
               4910      4920      4930      4940      4950
4901 CTGTTGCATTAGCTTCTGTGCCCCATTCAACGTTATTTGTATCGTTAAAG coh1_ai2.seq
4901 CTGTTGCATTAGCTTCTGTGCCCCATTCAACGTTATTTGTATCGTTAAAG a909_ai2.seq

     TTTAGAAATTGACCCGTAGCATTCTTTAAAACAAATATAGCACCTTGTAA Majority
               4960      4970      4980      4990      5000
4951 TTTAGAAATTGACCCGTAGCATTCTTTAAAACAAATATAGCACCTTGTAA coh1_ai2.seq
4951 TTTAGAAATTGACCCGTAGCATTCTTTAAAACAAATATAGCACCTTGTAA a909_ai2.seq

     TGAAGCTTTTGTGGAACCATCAATTTTTTTTATAGTAATTTGACCATCCC Majority
               5010      5020      5030      5040      5050
5001 TGAAGCTTTTGTGGAACCATCAATTTTTTTTATAGTAATTTGACCATCCC coh1_ai2.seq
5001 TGAAGCTTTTGTGGAACCATCAATTTTTTTTATAGTAATTTGACCATCCC a909_ai2.seq

     TCACTGTTACTTTTTGACCTGGGTCATCATTGCTAGTATTGGGGTTGATG Majority
               5060      5070      5080      5090      5100
5051 TCACTGTTACTTTTTGACCTGGGTCATCATTGCTAGTATTGGGGTTGATG coh1_ai2.seq
5051 TCACTGTTACTTTTTGACCTGGGTCATCATTGCTAGTATTGGGGTTGATG a909_ai2.seq

     GTCGCAATGTTTGTATTTTCTGGTAAATCAGCTGAACCTGGTTTAGCTCC Majority
               5110      5120      5130      5140      5150
5101 GTCGCAATGTTTGTATTTTCTGGTAAATCAGCTGAACCTGGTTTAGCTCC coh1_ai2.seq
5101 GTCGCAATGTTTGTATTTTCTGGTAAATCAGCTGAACCTGGTTTAGCTCC a909_ai2.seq

     ACTCTTTAATACTCCTGTATAAGTGACTGTGATTGTATTTATTCCCTTAT Majority
               5160      5170      5180      5190      5200
5151 ACTCTTTAATACTCCTGTATAAGTGACTGTGATTGTATTTATTCCCTTAT coh1_ai2.seq
5151 ACTCTTTAATACTCCTGTATAAGTGACTGTGATTGTATTTATTCCCTTAT a909_ai2.seq
```

FIGURE 21I

Alignment Report of ai-2_variant_2, using J. Hein method with Weighted residue weight table.
Thursday, July 29, 2004 6:49 PM

```
     AAAAAAAGTCATCATTAGCTCCATTTTGAGTATTTCCGGTTGGAGTATTG Majority
               5210      5220      5230      5240      5250
5201 AAAAAAAGTCATCATTAGCTCCATTTTGAGTATTTCCGGTTGGAGTATTG coh1_ai2.seq
5201 AAAAAAAGTCATCATTAGCTCCATTTTGAGTATTTCCGGTTGGAGTATTG a909_ai2.seq

     GTAGCTGCCCACGGAATAGTAATCGTGAAATTATTATTTTCCTCTAACAG Majority
               5260      5270      5280      5290      5300
5251 GTAGCTGCCCACGGAATAGTAATCGTGAAATTATTATTTTCCTCTAACAG coh1_ai2.seq
5251 GTAGCTGCCCACGGAATAGTAATCGTGAAATTATTATTTTCCTCTAACAG a909_ai2.seq

     GTTATACTTCCCAGTTGCTTTTTCCGAACCTTGAGTTAGAGTTGTAATAT Majority
               5310      5320      5330      5340      5350
5301 GTTATACTTCCCAGTTGCTTTTTCCGAACCTTGAGTTAGAGTTGTAATAT coh1_ai2.seq
5301 GTTATACTTCCCAGTTGCTTTTTCCGAACCTTGAGTTAGAGTTGTAATAT a909_ai2.seq

     TCCCTGATCCATCAGTAATAGTTACTTCATAAGATCCTTCGTTCAAATCA Majority
               5360      5370      5380      5390      5400
5351 TCCCTGATCCATCAGTAATAGTTACTTCATAAGACCCTTCGTTCAAATCA coh1_ai2.seq
5351 TCCCTGATCCATCAGTAATAGTTACTTCATAAGATCCTTCGTTCAAATCA a909_ai2.seq

     ACTACAGAAGCAGATGGCATAGTATCCTTTATAACATATTGATACACTTT Majority
               5410      5420      5430      5440      5450
5401 ACTACAGAAGCAGATGGCATAGTATCCTTTATAACATATTGATACACTTT coh1_ai2.seq
5401 ACTACAGAAGCAGATGGCATAGTATCCTTTATAACATATTGATACACTTT a909_ai2.seq

     TTCTGTACCATGATAATTGACTGCATTCTTATAAGTAATAGTATATTTGA Majority
               5460      5470      5480      5490      5500
5451 TTCTGTACCATGATAATTGACTGCATTCTTATAAGTAATAGTATATTTGA coh1_ai2.seq
5451 TTCTGTACCATGATAATTGACTGCATTCTTATAAGTAATAGTATATTTGA a909_ai2.seq

     CTGTATCACCAACCGAGTACGTTTTTTGATCTACAGTTTTTCCACCACCA Majority
               5510      5520      5530      5540      5550
5501 CTGTATCACCAACCGAGTACGTTTTTTGATCTACAGTTTTTCCACCACCA coh1_ai2.seq
5501 CTGTATCACCAACCGAGTACGTTTTTTGATCTACAGTTTTTCCACCACCA a909_ai2.seq

     TCTCCCCATGTCGCATCAGTATTCTTTTCATGAATAGTAGCATTTGGAGT Majority
               5560      5570      5580      5590      5600
5551 TCTCCCCATGTCGCATCAGTATTCTTTTCATGAATAGTAGCATTTGGAGT coh1_ai2.seq
5551 TCTCCCCATGTCGCATCAGTATTCTTTTCATGAATAGTAGCATTTGGAGT a909_ai2.seq

     TACAGATGTAACCATAATTACAGCTCCATTATTAACAGTGCTAGAAACAT Majority
               5610      5620      5630      5640      5650
5601 TACAGATGTAACCATAATCACAGCTCCATTATTAACAGTGCTAGAAACAT coh1_ai2.seq
5601 TACAGATGTAACCATAATTACAGCTCCATTATTAACAGTGCTAGAAACAT a909_ai2.seq

     AATAATATCCATATTGGGAAACATTAATAACCTCAGTACCATCATTATTT Majority
               5660      5670      5680      5690      5700
5651 AATAATATCCATATTGGGAAACATTAATAACCTCAGTACCATCATTATTT coh1_ai2.seq
5651 AATAATATCCATATTGGGAAACATTAATAACCTCAGTACCATCATTATTT a909_ai2.seq

     GACTCAGTAACAGTGGAAACTGGTGTAGTATTAGCTGATATAGATTTAGC Majority
               5710      5720      5730      5740      5750
5701 GACTCAGTAACAGTGGAAACTGGTGTAGTATTAGCTGATATAGATTTAGC coh1_ai2.seq
5701 GACTCAGTAACAGTGGAAACTGGTGTAGTATTAGCTGATATAGATTTAGC a909_ai2.seq

     CCATGTCGCAATCTCATTTGCTGACGCAGTATCTTTTTTAGTTACATATG Majority
               5760      5770      5780      5790      5800
5751 CCATGTCGCAATCTCATTTGCTGACGCAGTATCTTTTTTAGTTACATATG coh1_ai2.seq
5751 CCATGTCGCAATCTCATTTGCTGACGCAGTATCTTTTTTAGTTACATATG a909_ai2.seq

     TTCTCCCTCCATTAGTAGTTGTCGTAAAAAGAGAATTAAAATCAGTTGAA Majority
               5810      5820      5830      5840      5850
5801 TTCTCCCTCCATTAGTAGTTGTCGTAAAAAGAGAATTAAAATCAGTTGAA coh1_ai2.seq
5801 TTCTCCCTCCATTAGTAGTTGTCGTAAAAAGAGAATTAAAATCAGTTGAA a909_ai2.seq
```

FIGURE 21J

Alignment Report of ai-2_variant_2, using J. Hein method with Weighted residue weight table.
Thursday, July 29, 2004 6:49 PM

```
     G C T T T A T A C T C A G C T T C T T T A C C T T G A G G A A T T A A A T A A G A A G C T C C A T C Majority
                    5860                5870                5880                5890                5900
5851 G C T T T A T A C T C A G C T T C T T T A C C T T G A G G A A T T A A A T A A G A A G C T C C A T C cohl_ai2.seq
5851 G C T T T A T A C T C A G C T T C T T T A C C T T G A G G A A T T A A A T A A G A A G C T C C A T C a909_ai2.seq

     T T T A T T C G A A T C A G A T A C A T T T G C A T T A T C T A T T T C T G C A T C A A A A A C T T Majority
                    5910                5920                5930                5940                5950
5901 T T T A T T C G A A T C A G A T A C A T T T G C A T T A T C T A T T T C T G C A T C A A A A A C T T cohl_ai2.seq
5901 T T T A T T C G A A T C A G A T A C A T T T G C A T T A T C T A T T T C T G C A T C A A A A A C T T a909_ai2.seq

     T G T A T G C T T T A T A G G T T G C G C C T T T T T G A G T A T C T T G A A C T G T A A T T G T C Majority
                    5960                5970                5980                5990                6000
5951 T A T A T G C T T T A T A G G T T G C G C C T T T T T G A G T A T C T T G A A C T G T A A T T G T C cohl_ai2.seq
5951 T G T A T G C T T T A T A G G T T G C G C C T T T T T G A G T A T C T T G A A C T G T A A T T G T C a909_ai2.seq

     C C T G T C T C A G C G G C A A A A G C T A T C G G C G T A A C T G G T G A T A C A G C C A T A C C Majority
                    6010                6020                6030                6040                6050
6001 C C T G T C T C A G C G G C A A A A G C T A T C G G C G T A A C T G G T G A T A C A G C C A T A C C cohl_ai2.seq
6001 C C T G T C T C A G C G G C A A A A G C T A T C G G C G T A A C T G G T G A T A C A G C C A T A C C a909_ai2.seq

     A A A T G C T A A A C T C G C C A C T A A C A G C G A T T G A A T C A T T T T C T T T T T C A T T G Majority
                    6060                6070                6080                6090                6100
6051 A A A T G C T A A A C T C G C C A C T A A C A G C G A T T G A A T C A T T T T C T T T T T C A T T G cohl_ai2.seq
6051 A A A T G C T A A A C T C G C C A C T A A C A G C G A T T G A A T C A T T T T C T T T T T C A T T G a909_ai2.seq

     A A A T C T T T C T C C T A A A A T C A T A T T G A T G A A T G A T T A A T T C A T A T T T T T T T Majority
                    6110                6120                6130                6140                6150
6101 A A A T C T T T C T C C T A A A A T C A T A T T G A T G A A T G A T T A A T T C A T A T T T T T T T cohl_ai2.seq
6101 A A A T C T T T C T C C T A A A A T C A T A T T G A T G A A T G A T T A A T T C A T A T T T T T T T a909_ai2.seq

     T C G A T A G T A T A A T A T T A A T C C T G A T G G T A G A G C T A A A G C T A A A C C A A C T A Majority
                    6160                6170                6180                6190                6200
6151 T C G A T A G T A T A A T A T T A A T C C T G A T G G T A G A G C T A A A G C T A A A C C A A C T A cohl_ai2.seq
6151 T C G A T A G T A T A A T A T T A A T C C T G A T G G T A G A G C T A A A G C T A A A C C A A C T A a909_ai2.seq

     G G A T A T A A A T G T G T G T T C C A A T A C C T C C A G T A C T A G G C A A T T C T G T T C C T Majority
                    6210                6220                6230                6240                6250
6201 G G A T A T A A A T G T G T G T T C C A A T A C C T C C A G T A C T A G G C A A T T C T G T T C C T cohl_ai2.seq
6201 G G A T A T A A A T G T G T G T T C C A A T A C C T C C A G T A C T A G G C A A T T C T G T T C C T a909_ai2.seq

     T T A C T G T T A G T A A T T T T A A A A G T A T A T A C T G T A C T T C C A T C T A C T A A A T T Majority
                    6260                6270                6280                6290                6300
6251 T T A C T G T T A G T A A T T T T A A A A G T A T A T A C T G T A C T T C C A T C C A C T A A A T T cohl_ai2.seq
6251 T T A C T G T T A G T A A T T T T A A A A G T A T A T A C T G T A C T T C C A T C T A C T A A A T T a909_ai2.seq

     C T C T T T T A T T G G T G T C G C A T T A T T A C C A T T T T G T T C A A A G G T A A C T C C C G Majority
                    6310                6320                6330                6340                6350
6301 C T C T T T T A T T G G T G T C G C A T T A T T A C C A T T T T G T T C A A A G G T A A C T C C C G cohl_ai2.seq
6301 C T C T T T T A T T G G T G T C G C A T T A T T A C C A T T T T G T T C A A A G G T A A C T C C C G a909_ai2.seq

     T A G A A A T C A C T A A T A C T G A T A T A T C A T T T T T A G G T A G T A G G T A C C C T G G A Majority
                    6360                6370                6380                6390                6400
6351 T A G A A A T C A C T A A T A C T G A T A T A T C A T T T T T A G G T A G T A G G T A C C C T G G A cohl_ai2.seq
6351 T A G A A A T C A C T A A T A C T G A C A T A T C A T T T T T A G G T A G T A G G T A C C C T G G A a909_ai2.seq

     G G G G C C T T T G T C T C T G T T A G G T A G T A T T T T C C T A C T G G C A A A C T G A G G T A Majority
                    6410                6420                6430                6440                6450
6401 G G G G C C T T T G T C T C T G T T A G G T A G T A T T T T C C T A C T G G C A A A C T G A G G T A cohl_ai2.seq
6401 G G G G C C T T T G T C T C T G T T A G G T A G T A T T T T C C T A C T G G C A A A C T G A G G T A a909_ai2.seq

     G T T A T T A G C A T C C A C T A A T A A C A A G C C T T T A T C G T T T G T C A C C A G C C C T G Majority
                    6460                6470                6480                6490                6500
6451 G T T A T T A G C A T C C A C T A A T A A C A A G C C T T T A T C G T T T G T C A C C A G C C C T G cohl_ai2.seq
6451 G T T A T T A G C A T C C A C T A A T A A C A A G C C T T T A T C G T T T G T C A C C A G C C C T G a909_ai2.seq
```

FIGURE 21K

Alignment Report of ai-2_variant_2, using J. Hein method with Weighted residue weight table.
Thursday, July 29, 2004 6:49 PM

```
     AATACATAGGATGTGAAGCTTTATTCCCATTAGCATCTGATTCATAAATA Majority
              6510      6520      6530      6540      6550
6501 AATACATAGGATGTGAAGCTTTATTCCCATTAGCATCTGATTCATAAATA cohl_ai2.seq
6501 AATACATAGGATGTGAAGCTTTATTCCCATTAGCATCTGATTCATAAATA a909_ai2.seq

     TCAAAAACTGCACCTGCTAAAAAATTATTATCATTTTCGACATTAACTTT Majority
              6560      6570      6580      6590      6600
6551 TCAAAAACTGCACCTGCTAAAAAATTATTATCATTTTCGACATTAACTTT cohl_ai2.seq
6551 TCAAAAACTGCACCTGCTAAAAAATTATTATCATTTTCGACATTAACTTT a909_ai2.seq

     CTGTAGTCGTACTTTTTGCTTGATACGTGTATTGGTAAAGCTAATATCTA Majority
              6610      6620      6630      6640      6650
6601 CTGTAGTCGTACTTTTTGCTTGATACGTGTATTGGTAAAGCTAATATCTA cohl_ai2.seq
6601 CTGTAGTCGTACTTTTTGCTTGATACGTGTATTGGTAAAGCTAATATCTA a909_ai2.seq

     CGTCTCCTGAAACTGTCAGGGATTGTAAGCCGGTAGCATCATAAGTTTTA Majority
              6660      6670      6680      6690      6700
6651 CGTCTCCTGAAACTGTCAGGGATTGTAAGCCGGTAGCATCATAAGTTTTA cohl_ai2.seq
6651 CGTCTCCTGAAACTGTAAGGGATTGTAAGCCGGTAGCATCATAAGTTTTA a909_ai2.seq

     TCAGCTTCACCAGTTGCTAGATTTTTTTCTGTAATTGACTCAGATACTTT Majority
              6710      6720      6730      6740      6750
6701 TCAGCTTCACCAGTTGCTAGATTTTTTTCTGTAATTGACTCAGATACTTT cohl_ai2.seq
6701 TCAGCTTCACCAGTTGCTAGATTTTTTTCTGTAATTGACTCAGATACTTT a909_ai2.seq

     AAATTCATCGTAGGCTTGTTCATCTATTGATATAGAAGTTCCATAAGGTA Majority
              6760      6770      6780      6790      6800
6751 AAATTCATCGTAGGCTTGTTCATCTATTGATATAGAAGTTCCATAAGGTA cohl_ai2.seq
6751 AAATTCATCGTAGGCTTGTTCATCTATTGATATAGAAGTTCCATAAGGTA a909_ai2.seq

     CTTTAAATTCCTTAGTCTGACCATCTCTCAGCGGAAAATTCTCTTGTTGC Majority
              6810      6820      6830      6840      6850
6801 CTTTAAATTCCTTAGTCTGACCATCTCTCAGCGGAAAATTCTCTTGTTGC cohl_ai2.seq
6801 CTTTAAATTCCTTAGTCTGACCATCTCTCAGCGGAAAATTCTCTTGTTGC a909_ai2.seq

     AACGTTTCACTTGGATTAAACAAGAAGTCTTTCGTCTTATCTTCATCTAG Majority
              6860      6870      6880      6890      6900
6851 AACGTTTCACTTGGATTAAACAAGAAGTCTTTCGTCTTATCTTCATCTAG cohl_ai2.seq
6851 AACGTTTCACTTGGATTAAACAAGAAGTCTTTCGTCTTATCTTCATCTAG a909_ai2.seq

     TCCAACGACAGTTTTACTTACTCTGACGGTGTATTCTTTAGGTTGCCAAA Majority
              6910      6920      6930      6940      6950
6901 TCCAACGACAGTTTTACTTACTCTGACGGTGTATTCTTTAGGTTGCCAAA cohl_ai2.seq
6901 TCCAACGACAGTTTTACTTACTCTGACGGTGTATTCTTTAGGTTGCCAAA a909_ai2.seq

     CAGCATATAAGGTATTTGTTGCATCAGGGTTGTTATCAATACCTATTGAT Majority
              6960      6970      6980      6990      7000
6951 CAGCATATAAGGTATTTGTTGCATCAGGGTTGTTATCAATACCTATTGAT cohl_ai2.seq
6951 CAGCATATAAGGTATTTGTTGCATCAGGGTTGTTATCAATACCTATTGAT a909_ai2.seq

     TGACCTGCTGTAAATTCCACACGTCCTGTATCAGCTAAATCCTTATCATG Majority
              7010      7020      7030      7040      7050
7001 TGACCTGCTGTAAATTCCACACGTCCTGTATCAGCTAAATCCTTATCATG cohl_ai2.seq
7001 TGACCTGCTGTAAATTCCACACGTCCTGTATCAGCTAAATCCTTATCATG a909_ai2.seq

     ATGCCAACCAATAAGGTTGTAACCTGTCCTTGTAAAGTATTGGTTTTCAG Majority
              7060      7070      7080      7090      7100
7051 ATGCCAACCAATAAGGTTGTAACCTGTCCTTGTAAAGTATTGGTTTTCAG cohl_ai2.seq
7051 ATGCCAACCAATAAGGTTGTAACCTGTCCTTGTAAAGTATTGGTTTTCAG a909_ai2.seq

     GAATTGTAGTTGTGCTATTCAACTCCATACGCGGTGTCTCTACTTGTGTT Majority
              7110      7120      7130      7140      7150
7101 GAATTGTAGTTGTGCTATTCAACTCCATACGCGGTGTCTCCACTTGTGTT cohl_ai2.seq
7101 GAATTGTAGTTGTGCTATTCAACTCCATACGCGGTGTCTCTACTTGTGTT a909_ai2.seq
```

FIGURE 21L

Alignment Report of ai-2_variant_2, using J. Hein method with Weighted residue weight table.
Thursday, July 29, 2004 6:49 PM A C C A C A T T A C C A T T T T C T A C T C T A G T A C C A C C G T T A C C A T T G T A T T T G A T Majority
7160 7170 7180 7190 7200
7151 A C C A C A T T A C C A T T T T C T A C T C T A G T A C C A C C G T T A C C A T T G T A T T T G A T coh1_ai2.seq
7151 A C C A C A T T A C C A T T T T C T A C T C T A G T A C C A C C G T T A C C A T T A T A T T T G A T a909_ai2.seq T G A G G T A T C T T C T A A T T T G A T A T C T C C T A C T G G A A T A A T G A C A G G T T T T A Majority
7210 7220 7230 7240 7250
7201 G G A G G T A T C T T C T A A T T T G A T A T C T C C T A C T G G A A T A A T G A C A G G T T T T A coh1_ai2.seq
7201 T G A G G T A T C T T C T A A T T T G A T A T C T C C T A C T G G A A T A A T G A C A G G T T T T A a909_ai2.seq T G G T G A T A T T T T T A T T A G C A T C T G C T A A A T G G G C G T C A A T A T C A A T G G A A Majority
7260 7270 7280 7290 7300
7251 T G G T G A T A T T T T T A T T A G C A T C T G C T A A A T G G G C G T C A A T A T C A A T G G A A coh1_ai2.seq
7251 T G G T G A T A T T T T T A T T A G C A T C T G C T A A A T G G G C G T C A A T A T C A A T G G A A a909_ai2.seq T C A T A T G G G T T A T A A A T T T T A C C A T T G T A C C A C C A G C C A C G G A A A C G A T A Majority
7310 7320 7330 7340 7350
7301 T C A T A T G G G T T A T A A A T T T T A C C A T T G T A C C A C C A G C C A C G G A A A C G A T A coh1_ai2.seq
7301 T C A T A T G G G T T A T A A A T T T T A C C A T T G T A C C A C C A G C C A C G G A A A C G A T A a909_ai2.seq G C C A T C T G G C A T T G T C G G A C G T C T C A G T A A G G C T G A A T G G G A G C C A T C G T Majority
7360 7370 7380 7390 7400
7351 G C C A T C T G G C A T T G T C G G A C G T C T C A G T A A G G C T G A A T G G G A G C C A T C G T coh1_ai2.seq
7351 G C C A T C T G G C A T T G T C G G A C G T C T C A G T A A G G C T G A A T G G G A G C C A T C G T a909_ai2.seq C A T A G G A A T C A G G G T C A G T A G G C T C A T T A C T T G T T T G T A A T T G C T G A C C A Majority
7410 7420 7430 7440 7450
7401 C A T A G G A A T C A G G G T C A G T A G G C T C A T T A C T T G T T T G T A A T T G C T G A C C A coh1_ai2.seq
7401 C A T A G G A A T C A G G G T C A G T A G G C T C A T T A C T T G T T T G T A A T T G C T G A C C A a909_ai2.seq G A A G C A T C C A A T G C T G G C T T T C C A T C T G T A C C A A C A G C A T C A T T G C T G T A Majority
7460 7470 7480 7490 7500
7451 G A A G C A T C C A A T G C T G G C T T T C C A T C T G T A C C A A C A G C A T C A T T G C T G T A coh1_ai2.seq
7451 G A A G C A T C C A A T G C T G G C T T T C C A T C T G T A C C A A C A G C A T C A T T G C T G T A a909_ai2.seq T A T A A T A T G A T A A T C T C C A G C C T T T C G C C A A A T A G C T C T T A A A T T G A T A T Majority
7510 7520 7530 7540 7550
7501 T A T A A T A T G A T A A T C T C C A G C C T T T C G C C A A A T A G C T C T T A A A T T G A T A T coh1_ai2.seq
7501 T A T A A T A T G A T A A T C T C C A G C C T T T C G C C A A A T A G C T C T T A A A T T G A T A T a909_ai2.seq C T T G A G T T A C A G C A C C T G A A A A G T T A T A A G G T C T A A T A C T A C C A T C T G G A Majority
7560 7570 7580 7590 7600
7551 C T T G A G T T A C A G C A C C T G A A A A G T T A T A A G G T C T A A T A C T A C C A T C T G G A coh1_ai2.seq
7551 C T T G A G T T A C A G C A C C T G A A A A G T T A T A A G G T C T A A T A C T A C C A T C T G G A a909_ai2.seq T T A A C A T A A T A C C A A C C G A C T A A T T T G T A A G C G T C T T T T A C G T A C T T G T A Majority
7610 7620 7630 7640 7650
7601 T T A A C A T A A T A C C A A C C G A C T A A T T T G T A A G C G T C T T T T A C G T A C T T G T A coh1_ai2.seq
7601 T T A A C A T A A T A C C A A C C G A C T A A T T T G T A A G C G T C T T T T A C G T A C T T G T A a909_ai2.seq C T T A G T T G T T G T A T C A A C A T T T G A G A G A C T A G T A T C T G T C G T A T A A T A G G Majority
7660 7670 7680 7690 7700
7651 C T T A G T T G T T G T A T C A A C A T T T G A G A G A C T A G T A T C T G T C G T A T A A T A G G coh1_ai2.seq
7651 C T T A G T T G T T G T A T C A A C A T T T G A G A G A C T A G T A T C T G T C G T A T A A T A G G a909_ai2.seq C A T C T T T A G T T G A G T C G G G A T C T T T A T C T C G T G A A T C A T A C T T A T A A T A A Majority
7710 7720 7730 7740 7750
7701 C A T C T T T A G T T G A G T C G G G A T C T T T A T C T C G T G A A T C A T A C T T A T A A T A A coh1_ai2.seq
7701 C A T C T T T A G T T G A G T C G G G A T C T T T A T C T C G T G A A T C A T A C T T A T A A T A A a909_ai2.seq T A T G T A C C T G A A G G A T C T T G G A T A T A A T C C C T T G T A A T A T C T G T A T A A T C Majority
7760 7770 7780 7790 7800
7751 T A T G T A C C T G A A G G A T C T T G G A T A T A A T C C C T T G T A A T A T C T G T A T A A T C coh1_ai2.seq
7751 T A T G T A C C T G A A G G A T C T T G G A T A T A A T C C C T T G T A A T A T C T G T A T A A T C a909_ai2.seq

FIGURE 21M

Alignment Report of ai-2_variant_2, using J. Hein method with Weighted residue weight table.
Thursday, July 29, 2004 6:49 PM

```
           C G G A A T A C G A T C A C C A T A A T G C A A G T C T A A A T A G G T A T C A T C T G T T T T T G  Majority
                        7810              7820              7830              7840              7850
7801       C G G A A T A C G A T C A C C A T A A T G C A A A T C T A A A T A G G T A T C A T C T G T T T T T G  coh1_ai2.seq
7801       C G G A A T A C G A T C A C C A T A A T G C A A G T C T A A A T A G G T A T C A T C T G T T T T T G  a909_ai2.seq

           A T A A T T G G C C T C C G T T T G G A T C A A T A T T G A C A C G A T A T G T T A C C T T T T G C  Majority
                        7860              7870              7880              7890              7900
7851       A T A A T C G G C C T C C G T T T G G A T C A A T A T T G A C A C G A T A T G T T A C C T T T T G C  coh1_ai2.seq
7851       A T A A T T G G C C T C C G T T T G G A T C A A T A T T G A C A C G A T A T G T T A C C T T T T G C  a909_ai2.seq

           C A A C C T G C A T A G A C T T T A A C A T C A T G A G G A G G C A T A G T C G T G T T A A A G T C  Majority
                        7910              7920              7930              7940              7950
7901       C A A C C T G C A T A G A C T T T A A C A T C A T G A G G A G G C A T A G T C G T G T T A A A G T C  coh1_ai2.seq
7901       C A A C C T G C A T A G A C T T T A A C A T C A T G A G G A G G C A T A G T C G T G T T A A A G T C  a909_ai2.seq

           A A A T A C T T G T G T T T G T G C T T G G T C T T T A T A C C A T T T A C C A T C C C A A A C A T  Majority
                        7960              7970              7980              7990              8000
7951       A A A T A C T T G T G T T T G T G C T T G G T C T T T A T A C C A T T T A C C A T C C C A A A C A T  coh1_ai2.seq
7951       A A A T A C T T G T G T T T G T G C T T G G T C T T T A T A C C A T T T A C C A T C C C A A A C A T  a909_ai2.seq

           A C C C T G G T C G A C T A G G T T T A G G T T G A A C C G T T G T C G T A T C G G G G G C A T A A  Majority
                        8010              8020              8030              8040              8050
8001       A C C C T G G T C G A C T A G G T T T A G G T T G A A C A G T T G T C G T A T C G G G G G C A T A A  coh1_ai2.seq
8001       A C C C T G G T C G A C T A G G T T T A G G T T G A A C C G T T G T C G T A T C G G G G G C A T A A  a909_ai2.seq

           G A G G A C A A A T T T T G C T C A T A T A G A A C A T C C T T T A C T G G A A A A T T A G G A A G  Majority
                        8060              8070              8080              8090              8100
8051       G A G G A C A A A T T T T G C T C A T A T A G A A C A T C C T T T A C T G G A A A A T T A G G A A G  coh1_ai2.seq
8051       G A G G A C A A A T T T T G C T C A T A T A G A A C A T C C T T T A C T G G A A A A T T A G G A A G  a909_ai2.seq

           C T C T G T A T T A T C A A G C G G A T C T A A A T A T T T A A T C T T G T A T G A A T T A C G T T  Majority
                        8110              8120              8130              8140              8150
8101       C T C T G T A T T A T C A A G C G G A T C T A A A T A T T T A A T C T T G T A T G A A T T A C G T T  coh1_ai2.seq
8101       C T C T G T A T T A T C A A G C G G A T C T A A A T A T T T A A T C T T G T A T G A A T T A C G T T  a909_ai2.seq

           C A T A C C A T A C C A C T A A G T T C A A A T A A T C T T T G T G G T A G T C T C C A T A T T T A  Majority
                        8160              8170              8180              8190              8200
8151       C A T A C C A T A C C A C T A A G T T C A A A T A A T C T T T G T G G T A G G C A C C A T A T C T A  coh1_ai2.seq
8151       C A T A C C A T A C C A C T A A G T C C A A A T A A T C T T T G T G A T A A T A T C C A T A C T G A  a909_ai2.seq

           T C G T A G T A T T C A T C T G C G A T T G G C A C T T T T G T T T T T G C A C T C G T T T G T C T  Majority
                        8210              8220              8230              8240              8250
8201       T C A T A G T A T T C A T C T G A A A T A G G A A C T T T T A C T C C T G C A C T C G T T T G A C T  coh1_ai2.seq
8201       T C G T A A T A T T C A T C A G C G A C T G G C A C A G T T G T A T T A G C A C T A G T T T G T A G  a909_ai2.seq

           T G G G T T C T G A T C A A A T A G G T A A T T A T C T G G A T A T A A G C T T T G A T A G T A T T  Majority
                        8260              8270              8280              8290              8300
8251       T G C G T A C T G A T C A A A A A G G T A A T T A T C A G G A T A T A A C G T T G A T A A T A T T  coh1_ai2.seq
8251       T G G C T T A C C A T C A A A T A A G T A A T T A T C T G G A T A C A A G C T T T G A T A G T A T T  a909_ai2.seq

           T A A C A T T A A A T C C T A G G T A T T T T T C T G T A A A G G T A A A T T C G T C T G C T C C A  Majority
                        8310              8320              8330              8340              8350
8301       T A A C A T T A A A C C C T A G A T A T T T T T C T G T A A A G G T A A A T T C A T C T G C C C C A  coh1_ai2.seq
8301       T A A C A T T A A A T C C T A A G T A T T T T T C T G T A A A G G T A A A C T C G T C T G C T C C A  a909_ai2.seq

           G C A C C T C C C C C T G T G T C T G C T A A A G A G T A T T T G C C A T C T A G T C C T T G T T T  Majority
                        8360              8370              8380              8390              8400
8351       G C A C C T C C A C C G G T A T C T G C T A A A G A A T A A G T G C C A T C A A A A C C T T G T T T  coh1_ai2.seq
8351       G C A C C T C C C C C T A C G T C T G A T A A A A A G T A T T T G C C A T C T A G T C C T T G T T T  a909_ai2.seq

           G T A G A A C G G A T A A T T T T G A A T T C T C T T C C C T T T T G G A T A G A G T T T T A T T T  Majority
                        8410              8420              8430              8440              8450
8401       G A A G A A C C G A T A A G T T T G A A C T A T A T T C C C T T T T G G A A A G A G T T T G A T A A  coh1_ai2.seq
8401       A T A G A A A G C A T A A T T T T G A A T T C G C T G A C C A A C A G G A T A C A A T T T T A T T T  a909_ai2.seq
```

FIGURE 21N

Alignment Report of ai-2_variant_2, using J. Hein method with Weighted residue weight table.
Thursday, July 29, 2004 6:49 PM

```
     CATCTGGATTTGCTGTATGTACTCCATTGGGTAGTATGAACTCACCCAAA Majority
              8460      8470      8480      8490      8500
8451 CATCTGAATCAACGGTAT------CATTAGGTAAAATGAACTCACCCAAA coh1_ai2.seq
8451 CATAAGGATTTGCTCCACGTACTCCACTGGGAAGTATAAACTCACCCAAA a909_ai2.seq

     TAACTCATTCCTTATGTTCCAGTTTGGTTATTTCCAACATTGGTTAGGTA Majority
              8510      8520      8530      8540      8550
8495 TAACTCATCCCATAGGTTCCAACTTGGTTATTTCCAACATTGGCTAAATA coh1_ai2.seq
8501 TAACTCATTCCTGATACTCCAGTTGAA---------------GTTAGGTA a909_ai2.seq

     ACGCCATGCACCTGTCTTCCATTGATAGCCATTCGCGGCTAAGGTTGTAC Majority
              8560      8570      8580      8590      8600
8545 ACCCCATGCACCCGTCTTCCATTGATAACCATTAGCGGCCAAGGTTGTAC coh1_ai2.seq
8536 ACGCCACGCACCTGTCTTCCACTGATAGCCATTCGCAGCTAAAGTCGTAC a909_ai2.seq

     CGTATAGTCCTGTGTAGGTTTCGGCATCTGATGCTCTAGTTCTAGGAATC Majority
              8610      8620      8630      8640      8650
8595 CGTAAAGTCCTGTGTAAGTATCAGCATCAGA-GCTCCAATTATACGAATA coh1_ai2.seq
8586 CATATAGTCCAGTATAGGTTTCGGCATATGATGCACTAGTCCAAGGAAAC a909_ai2.seq

     GTAGTATTTTGGTAATGAATCTCCGAGTAGCCCTTTTTTGCAAATTTTAT Majority
              8660      8670      8680      8690      8700
8644 GTAATATTCTGGCAAGGAATATCCG-----CCATATTTTGCAAATTTTAT coh1_ai2.seq
8636 GAAGAACTTTGATAATAAACCTCAGAGTAGCCCGTCTTCGCAAATCTCAT a909_ai2.seq

     TGTGATGAGTTTTCTATCATAATAAACATTAACGACACTTGAACCATCGT Majority
              8710      8720      8730      8740      8750
8689 TGTGATGAGTTTTCTATCATAATAAACATTAACAACACTTGAACCATCGT coh1_ai2.seq
8686 AGTCACAAGTTCTCTATCATAATAAACATTAACGACACTTGAACCATCGT a909_ai2.seq

     CTTTTATCATGACAGAAGTTTCTGTCCTCGTATTATTAACTTTAAAGCCA Majority
              8760      8770      8780      8790      8800
8739 CTTTTATCATGACAGAAGTTTCTGTCCTCGTATTATTAACTTTAAAGCCA coh1_ai2.seq
8736 CTTTTATCATGACAGAAGTTTCTGTCCTCGTATTATTAACTTTAAAGCCA a909_ai2.seq

     GTCGGTAGTTTTTCATTAATATCTTGTTGTGTTAGCGTCTGATTAGATAA Majority
              8810      8820      8830      8840      8850
8789 GTCGGTAGTTTATCATTAATATCTTGTTGTGTTAGCGTCTGATTAGATAA coh1_ai2.seq
8786 GTCGGCAATTTTGCATTAATATCTTGTTGTGTTAGCGTCTGATTAGATAA a909_ai2.seq

     AGATAGGCCTGATCGTGTTACTTGCCCTGCGTACTCATATGTCTTTTGCG Majority
              8860      8870      8880      8890      8900
8839 AGATAGGCCTGATCGTGTTACTTGCCCTGCGTACTCATATGTCTTTTGCG coh1_ai2.seq
8836 AGATAGGCCTGATCGTGTTACTTGCCCTGCGTACTCATATGTCTTTTGCG a909_ai2.seq

     CATCAGTAGCATTTTTATTATCCGTTGCTGATTGTTGCCAGTAGTTTATC Majority
              8910      8920      8930      8940      8950
8889 CATCAGTAGCATTTTTATTATCCGTTGCTGATTGTTGCCAGTAGTTTATC coh1_ai2.seq
8886 CATCAGTAGCATTTTTATTATCCGTTGCTGATTGTTGCCAGTAGTTTATC a909_ai2.seq

     GTGTAGGTTGTTTGTGCGGGCGACCAATGTGCATATAGCGTCGTATCCTT Majority
              8960      8970      8980      8990      9000
8939 GTGTAGGTTGTTTGTGCGGGCGACCAATGTGCATATAGCGTCGTATCCTT coh1_ai2.seq
8936 GTGTAGGTTGTTTGTGCGGGCGACCAATGTGCATATAGCGTCGTATCCTT a909_ai2.seq

     GGTCAAGACTTGATTAAAATCAAAGGCTGTCCCACCACTAGCAGCTGTGT Majority
              9010      9020      9030      9040      9050
8989 GGTCAAGACTTGATTAAAATCAAAGGCTGCCCCACCACTAGCAGCTGTGT coh1_ai2.seq
8986 GGTCAAGACTTGATTAAAATCAAAGGCTGTCCCACCACTAGCAGCTGTGT a909_ai2.seq

     ACCACCCTGCAAAAGTATAACCTGGCCTTGTTGGATCATTAGGCTTAATT Majority
              9060      9070      9080      9090      9100
9039 ACCACCCTGCAAAAGTATAACCTGGCCTCGTTGGATCATTAGGCTTAATT coh1_ai2.seq
9036 ACCACCCTGCAAAAGTATAACCTGGCCTTGTTGGATCATTAGGCTTAATT a909_ai2.seq
```

FIGURE 21O

Alignment Report of ai-2_variant_2, using J. Hein method with Weighted residue weight table.
Thursday, July 29, 2004 6:49 PM

```
     G T C G A A G C A G G T T G G T C T G T T A A C A C A C G A C G A G G T G C A A T A T A G G T A A C  Majority
                         9110                9120                9130                9140                9150
9089 G T C G A A G C A G G T T G G C C T G T T A A C A C A C G A C G A G G T G C A A T A T A G G T A A C  coh1_ai2.seq
9086 G T C G A A G C A G G T T G G T C T G T T A A C A C A C G A C G A G G T G C A A T A T A G G T A A C  a909_ai2.seq

     T C C T G T T G A T A A G T C G C C T G T G T T G A A T T C A A C A C C G T A C G A T T C T T T A A  Majority
                         9160                9170                9180                9190                9200
9139 T C C T G T T G A T A A G T C G C C T G T G T T G A A T T C A A C A C C G T A C G A T T C T T T A A  coh1_ai2.seq
9136 T C C T G T T G A T A A G T C G C C T G T G T T G A A T T C A A C A C C G T A C G A T T C T T T A A  a909_ai2.seq

     A G A C A G G A T A A A G A C T T A T G T C T G A A G A T A C A G G T A A T G C T T G A A T T T C T  Majority
                         9210                9220                9230                9240                9250
9189 A G A C A G G A T A A A G A C T T A T G T C T G A A G A T A C A G G T A A T G C T T G A A T T T C T  coh1_ai2.seq
9186 A G A C A G G A T A A A G A C T T A T G T C T G A A G A T A C A G G T A A T G C T T G A A T T T C T  a909_ai2.seq

     G A T T C A G A A A G T G G A G C T C C A T T T T G A G T T T T A G A C C A A C C T A C A A A T A A  Majority
                         9260                9270                9280                9290                9300
9239 G A T T C A G A A A G T G G A G C T C C A T T T T G A G T T T T A G A C C A A C C T A C A A A T A A  coh1_ai2.seq
9236 G A T T C A G A A A G T G G A G C T C C A T T T T G A G T T T T A G A C C A A C C T A C A A A T A A  a909_ai2.seq

     T A A T G T T G A A G T G G G T G G T G A A A C T T T A A A T G A A C T T A G A T C C G C G G T T C  Majority
                         9310                9320                9330                9340                9350
9289 C A A T G T T G A A G T G G G T G G T G A A A C T T T A A A T G A A C T T A A A T C C G C G G T T C  coh1_ai2.seq
9286 T A A T G T T G A A G T G G G T G G T G A A A C T T T A A A T G A A C T T A G A T C C G C G G T T C  a909_ai2.seq

     C G T T T C C T G A A C T A T C C A A T G G T A C T T G A T A A C G C T C C A A A A T A C T T T T A  Majority
                         9360                9370                9380                9390                9400
9339 C G T T T C C T G A A C T A T C C A A T G G T A C T T G A T A A C G C T C C A A A A T A C T T T T A  coh1_ai2.seq
9336 C G T T T C C T G A A C T A T C C A A T G G T A C T T G A T A A C G C T C C A A A A T A C T T T T A  a909_ai2.seq

     C C A G C A G A A T C A T C A T A T A A A G T T A C T G T C G C C A C T T T A C T C A T A A A T G G  Majority
                         9410                9420                9430                9440                9450
9389 C C A G C A G A A T C A T C A T A T A A A G T T A C T G T C G C C A C T T T A C T C A T A A A T G G  coh1_ai2.seq
9386 C C A G C A G A A T C A T C A T A T A A A G T T A C T G T C G C C A C T T T A C T C A T A A A T G G  a909_ai2.seq

     A C G A A C A T A A A T T T C T T T T G T C T C A G T T A C A G T T A T T G G C T C A C C A A A T T  Majority
                         9460                9470                9480                9490                9500
9439 A C G A A C A C A A A T T T C T T T T G T C T C A G T T A C A G T T A T T G G C T C A C C A A A T T  coh1_ai2.seq
9436 A C G A A C A T A A A T T T C T T T T G T C T C A G T T A C A G T T A T T G G C T C A C C A A A T T  a909_ai2.seq

     T A A C A G G G T C A C C A T A C T T T C C A G T A G T A G G A T C A T A G G T A T A C C A A C C A  Majority
                         9510                9520                9530                9540                9550
9489 T A A C A G G G T C A C C A T A C T T T C C A G T A G T A G G A T C A T A G G T A T A C C A A C C A  coh1_ai2.seq
9486 T A A C A G G G T C A C C A T A C T T T C C A G T A G T A G G A T C A T A G G T A T A C C A A C C A  a909_ai2.seq

     T T A A A A T G C T C T C C T G C T T T A A T C G T C G G A A T C C C A A C T T C T C C T A G A G A  Majority
                         9560                9570                9580                9590                9600
9539 T T A A A A T G C T C T C C T G C T T T A A T C G T C G G A A T C C C A A C T T C T C C T A G A G A  coh1_ai2.seq
9536 T T A A A A T G C T C T C C T G C T T T A A T C G T C G G A A T C C C A A C T T C T C C T A G A G A  a909_ai2.seq

     T T C T C C A T C T T T T A T A A T T T G A T G A T G A A C T T G C A T A C C T G A A G C T G T C A  Majority
                         9610                9620                9630                9640                9650
9589 T T C T C C A T C T T T T A T A A T T T G A T G A T G A A C T T G C A T A C C T G A A G C T G T C A  coh1_ai2.seq
9586 T T C T C C A T C T T T T A T A A T T T G A T G A T G A A C T T G C A T A C C T G A A G C T G T C A  a909_ai2.seq

     G G A A A T T A T A A T C A G T T C C G T C A T T A T T T T G A A A A T G G T A A G T T A A C C T A  Majority
                         9660                9670                9680                9690                9700
9639 G G A A A T C A T A A T C A G T T C C G T C A T T A T T T T G A A A A T G G T A A G T T A A C C T A  coh1_ai2.seq
9636 G G A A A T T A T A A T C A G T T C C G T C A T T A T T T T G A A A A T G G T A A G T T A A C C T A  a909_ai2.seq

     G G A A C T T C T G T A T T A T C C T C T T G A A C A A T T G C A T A A A T G G A G A A T G A A T C  Majority
                         9710                9720                9730                9740                9750
9689 G G A A C T T C T G T A T T A T C C T C T T G A A C A A T T G C A T A A A T G G A G A A T G A A T C  coh1_ai2.seq
9686 G G A A C T T C T G T A T T A T C C T C T T G A A C A A T T G C A T A A A T G G A G A A T G A A T C  a909_ai2.seq
```

FIGURE 21P

Alignment Report of ai-2_variant_2, using J. Hein method with Weighted residue weight table.
Thursday, July 29, 2004 6:49 PM

```
          T G T T T T A A A A G C A A C A T C A C T G C T A G T G T T C T T A G T T T C T G C A G T A T C T T  Majority
                    9760          9770          9780          9790          9800
9739      T G T T T T A A A A G C A A C A T C A C T G C T A G T G T T C T T A G T T T C T G C A G T A T C T T  coh1_ai2.seq
9736      T G T T T T A A A A G C A A C A T C A C T G C T A G T G T T C T T A G T T T C T G C A G T A T C T T  a909_ai2.seq

          T A G A T T T T A A T A C T T C T G T T T G A C C A T C A T C T T T A A A G T G A A C A A C T T T A  Majority
                    9810          9820          9830          9840          9850
9789      T A G A T T T T A A T A C T T C T G T T T G A C C A T C A T C T T T A A A G T G A A C A A C T T T A  coh1_ai2.seq
9786      T A G A T T T T A A T A C T T C T G T T T G A C C A T C A T C T T T A A A G T G A A C A A C T T T A  a909_ai2.seq

          A G G T T T T C A T C T G A A G C T T C T A A T G G C T T A T C A T A G T T G A C C T C T A C T T T  Majority
                    9860          9870          9880          9890          9900
9839      A G G T T T T C A T C T G A A G C T T C T A A T G G C T T A T C A T A G T T A A C C T C T A C T T T  coh1_ai2.seq
9836      A G G T T T T C A T C T G A A G C T T C T A A T G G C T T A T C A T A G T T G A C C T C T A C T T T  a909_ai2.seq

          T A C T G G G G C T T G G G G T T C T G C T T C T T T A C C A T T T G A C T C A A T A G T A A T G T  Majority
                    9910          9920          9930          9940          9950
9889      T A C T G G A G C T T G G G G T T C T G C T T C T T T A C C A T T T G A C T C A A T A G T A A T G T  coh1_ai2.seq
9886      T A C T G G G G C T T G G G G T T C T G C T T C T T T A C C A T T T G A C T C A A T A G T A A T G T  a909_ai2.seq

          C A T A G A G T T T G A A G T T T T T G A T T T C A C T A T C T T G T T T A G C A A C T T C T G T C  Majority
                    9960          9970          9980          9990          10000
9939      C A T A G A G T T T G A A A T T T T T G A T T T C A C T A T C T T G T T T A G C A A C C T C T G T C  coh1_ai2.seq
9936      C A T A G A G T T T G A A G T T T T T G A T T T C A C T A T C T T G T T T A G C A A C T T C T G T C  a909_ai2.seq

          A A T G C T T T T T T C T T A T A G T C T T T A A A A G T A G C T G A A T T G T C T T T T A A T T C  Majority
                    10010         10020         10030         10040         10050
9989      A A T G C T T T T T T C T T A T A A T C T T T A A A A G T A G C T G A A T T G T C T T T T A A T T C  coh1_ai2.seq
9986      A A T G C T T T T T T C T T A T A G T C T T T A A A A G T A G C T G A A T T G T C T T T T A A T T C  a909_ai2.seq

          C G T C A C C T T T A A A T C A G C A T T T T T A G G A A T C T T A G C T T C T T T G G T C A A A G  Majority
                    10060         10070         10080         10090         10100
10039     C G T C A C C T T T A A A T C A G C A T T T T T A G G A A T C T T A G C T T C T T T G G T C A A A G  coh1_ai2.seq
10036     C G T C A C C T T T A A A T C A G C A T T T T T A G G A A T C T T A G C T T C T T T G G T C A A A G  a909_ai2.seq

          T C A C T G T T A C A G T A T A G T C T G C A C C T C T A A A C A T C A A T G G T T C T T C A C G G  Majority
                    10110         10120         10130         10140         10150
10089     T C A C T G T T A C A G T A T A G T C T G C A C C T C T A A A C A T C A A T G G T T C T T C A C G A  coh1_ai2.seq
10086     T C A C T G T T A C A G T A T A G T C T G C A C C T C T A A A C A T C A A T G G T T C T T C A C G G  a909_ai2.seq

          T A A G C A G C T T C C T C A G A A G A T G A T G T T T C T G T T A C A C T A G A A G C A G G A G T  Majority
                    10160         10170         10180         10190         10200
10139     T A A G C A G C T T C C T C A G A A G A T G A T G T T T C T G T T A C A C T A G A A G C A G G A G T  coh1_ai2.seq
10136     T A A G C A G C T T C C T C A G A A G A T G A T G T T T C T G T T A C A C T A G A A G C A G G A G T  a909_ai2.seq

          C T G T G G C T T G C T C T G C T C A A C A C T T G A T T G A G A A C T A G A T G T T G A T G A A G  Majority
                    10210         10220         10230         10240         10250
10189     C T G G G G C T T G C T C T G C T C A A C A C T T G A T T G A G A A C T A G A T G T T G A T G A A G  coh1_ai2.seq
10186     C T G T G G C T T G C T C T G C T C A A C A C T T G A T T G A G A A C T A G A T G T T G A T G A A G  a909_ai2.seq

          T T A C C T G G C T A G A A T T T T T A T T T T C T A A A G T A A T C C C C A C A T C A T C T G T C  Majority
                    10260         10270         10280         10290         10300
10239     T T A C C T G G C T A G A A T T T T T A T T T T C T A A A G T A A T C C C C A C A T C A T C T G T C  coh1_ai2.seq
10236     T T A C C T G G C T A G A A T T T T T A T T T T C T A A A G T A A T C C C C A C A T C A T C T G T C  a909_ai2.seq

          T T A G T T T C T T C A A C T G T T A T T G C T G G T A G A A T T A A A A A A T A A G T C G T T A A  Majority
                    10310         10320         10330         10340         10350
10289     T T A G T T T C T T C A A C T G T T A T T G C T G G T A G A A T T A A A A A A T A A G T C G T T A A  coh1_ai2.seq
10286     T T A G T T T C T T C A A C T G T T A T T G C T G G T A G A A T T A A A A A A T A A G T C G T T A A  a909_ai2.seq

          A A A A G T T G T T A G G A T C A T C A A T G A C C A C A T G A T A A T T T T C C A C T C T T T A G  Majority
                    10360         10370         10380         10390         10400
10339     A A A A G T T G T T A G G A T C A T C A A T G A C C A C A T G A T A A T T T T C C A C T C T T T A G  coh1_ai2.seq
10336     A A A A G T T G T T A G G A T C A T C A A T G A C C A C A T G A T A A T T T T C C A C T C T T T A G  a909_ai2.seq
```

FIGURE 21Q

Alignment Report of ai-2_variant_2, using J. Hein method with Weighted residue weight table.
Thursday, July 29, 2004 6:49 PM

```
      G G T G T T T T T T C T T T T T T A A T G A T T C G A T T A T A A A A G T T T G A C A C T T C T T T Majority
                      10410               10420               10430               10440               10450
10389 G G T G T T T T T T C T T T T T T A A T G A T T C G A T T A T A A A A G T T T G A C A C T T C T T T cohl_ai2.seq
10386 G G T G T T T T T T C T T T T T T A A T G A T T C G A T T A T A A A A G T T T G A C A C T T C T T T a909_ai2.seq

      A G C A T T T T T G C A T C C T C C C T A A C C T T A A T T G A T A C T A C T A A T C T T A C C T A Majority
                      10460               10470               10480               10490               10500
10439 A G C A T T T T T G C A T C C T C C C T A A C C T T A A T T G A T A C T A C T A A T C T T A C C T A cohl_ai2.seq
10436 A G C A T T T T T - C A T C C T C C C T A A C C T T A A T T G A T A C T A C T A A T C T T A C C T A a909_ai2.seq

      G A G G C C A T A T T C T G A A A G A A A T T T T A C C T A C A A T T T G T T C T T C T G A A A C A Majority
                      10510               10520               10530               10540               10550
10489 G A G G C C A T A T T C T G A A A G A A A T T T T A C C T A C A A T T T G T T C T T C T G A A A C A cohl_ai2.seq
10485 G A G G C C A T A T T C T G A A A G A A A T T T T A C C T A C A A T T T G T T C T T C T G A A A C A a909_ai2.seq

      T C T C C T A C A G A A G T A T T T C G A G A A T C A A T T G A A G T T T T T C G G T T G T C T C C Majority
                      10560               10570               10580               10590               10600
10539 T C T C C T A C A G A A G T A C T T C G A G A A T C A A T T G A A G T T T T T C G G T T G T C T C C cohl_ai2.seq
10535 T C T C C T A C A G A A G T A T T T C G A G A A T C A A T T G A A G T T T T T C G G T T G T C T C C a909_ai2.seq

      T A A T A C A A A A A T T T T T T T A T C A G G T A C T T G A T A T G G G T A T T T T A T A T T A C Majority
                      10610               10620               10630               10640               10650
10589 T A A T A C A A A A A T T T T T T T A T C A G G T A C T T G A T A T G G G T A T T T T A T A T T A C cohl_ai2.seq
10585 T A A T A C A A A A A T T T T T T T A T C A G G T A C T T G A T A T G G G T A T T T T A T A T T A C a909_ai2.seq

      T A T T A C C G A G T G C T T T A T G A A T A A C A T A T G G T T C T T T C A A C T T A T G T T G A Majority
                      10660               10670               10680               10690               10700
10639 T A T T A C C G A G T G C T T T A T G A A T A A C A T A T G G T T C T T T C A A C T T A T G T T G A cohl_ai2.seq
10635 T A T T A C C G A G T G C T T T A T G A A T A A C A T A T G G T T C T T T C A A C T T A T G T T G A a909_ai2.seq

      T T C A C G T A A A C A T C C C C T T G A G A A T C A A T A T T A A C C C A G T C T C C T G A C T C Majority
                      10710               10720               10730               10740               10750
10689 T T C A C G T A A A C A T C C C C T T G A G A A T C A A T A T T A A C C C A G T C T C C T G A C T C cohl_ai2.seq
10685 T T C A C G T A A A C A T C C C C T T G A G A A T C A A T A T T A A C C C A G T C T C C T G A C T C a909_ai2.seq

      T G C A A T A A C C C G C T T G A C T A G G A C C T T A T T A T T G T A G T A A A A C G C G A C A A Majority
                      10760               10770               10780               10790               10800
10739 T G C A A T A A C C C G C T T G A C T A G G A C C T T A T T A T T G T A G T A A A A C G C G A C A A cohl_ai2.seq
10735 T G C A A T A A C C C G C T T G A C T A G G A C C T T A T T A T T G T A G T A A A A C G C A A C A A a909_ai2.seq

      C G T C T C C A G T T T T A A A A T T T G A A C C T T T T A C T G T A A A G A C T A C A T C A C C T Majority
                      10810               10820               10830               10840               10850
10789 C G T C T C C A G T T T T A A A A T T T G A A C C T T T T A C T G T A A A G A C T A C A T C A C C T cohl_ai2.seq
10785 C G T C T C C A G T T T T A A A A T T T G A A C C T T T T A C T G T A A A G A C T A C A T C A C C T a909_ai2.seq

      G C A C T T A A A G T C T T A T T C A T T G A A T G T C C G T A G A T T C T T A A T A C A G G C A A Majority
                      10860               10870               10880               10890               10900
10839 G C A C T T A A A G T C T T A T T C A T T G A A T G T C C G T A G A T T C T T A A T A C A G G C A A cohl_ai2.seq
10835 G C A C T T A A A G T C T T A T T C A T T G A A T G T C C G T A G A T T C T T A A T A C A G G C A A a909_ai2.seq

      C C A T A A A A C C G C A A T T A A A A T G G C T G T T G A G G C A A C C G C C A T C A A G A T G T Majority
                      10910               10920               10930               10940               10950
10889 C C A T A A A A C C G C A A T T A A A A T G G C T A T T G A G G C A A C C G C C A T C A A G A T G T cohl_ai2.seq
10885 C C A T A A A A C C G C A A T T A A A A T G G C T G T T G A G G C A A C C G C C A T C A A G A T G T a909_ai2.seq

      A T A T G G T A T T T T T A A T G A C A C T C C A A A A G C G T T T C T G A T A A G T T A C G C G A Majority
                      10960               10970               10980               10990               11000
10939 A T A T G G T A T T T T T A A T G A C A C T C C A A A A G C G T T T C T G A T A A G T T A C G C G A cohl_ai2.seq
10935 A T A T G G T A T T T T T A A T G A C A C T C C A A A A G C G T T T C T G A T A A G T T A C G C G A a909_ai2.seq

      T C C A G T T C T T G A G A T A A T T T A T C T G A A C T A A T C T G T C T T T T C A T T G T C T A Majority
                      11010               11020               11030               11040               11050
10989 T C C A G T T C T T G A G A T A A T T T A T C T G A A C T A A T C T G T C T T T T C A T T G T C T A cohl_ai2.seq
10985 T C C A G T T C T T G A G A T A A T T T A T C T G A A C T A A T C T G T C T T T T C A T T G T C T A a909_ai2.seq
```

FIGURE 21R

Alignment Report of ai-2_variant_2, using J. Hein method with Weighted residue weight table.
Thursday, July 29, 2004 6:49 PM

```
      C G C C T C T C T T A T C T A C T A A A T T C T T T A C G T T T T C T A A A T A G G T A T C T G C A  Majority
                      11060               11070               11080               11090               11100
11039 C G C C T C T C T T A T C T A C T A A A T T C T T T A C G T T T T C T A A A T A G G T A T C T G C A  cohl_ai2.seq
11035 C G C C T C T C T T A T C T A C T A A A T T C T T T A C G T T T T C T A A A T A G G T A T C T G C A  a909_ai2.seq

      G C T A A C T G A G C A G T C T C A A A A A T A C C A C T A A G C A T T A A G G A A G C T T C G G C  Majority
                      11110               11120               11130               11140               11150
11089 G C T A A C T G A G C A G T C T C A A A A A T A C C A C T A A G C A T T A A G G A A G C T T C G G C  cohl_ai2.seq
11085 G C T A A C T G A G C A G T C T C A A A A A T A C C A C T A A G C A T T A A G G A A G C T T C G G C  a909_ai2.seq

      A A T A G A A C C A G C T T T G C T A A T T T T G A T T T T T T T A T C A T C T A G C G C T T C T T  Majority
                      11160               11170               11180               11190               11200
11139 A A T A G A A C C A G C T T T G C T A A T T T T G A T T T T T T T A T C A T C T A G C G C T T C T T  cohl_ai2.seq
11135 A A T A G A A C C A G C T T T G C T A A T T T T G A T T T T T T T A T C A T C T A G C G C T T C T T  a909_ai2.seq

      T A A G T T G C T G A A T C T C T T T C T C T T G T T T T T C A A T A A G A A G T T G C T G T T C T  Majority
                      11210               11220               11230               11240               11250
11189 T A A G T T G C T G A A T C T C T T T C T C T T G T T T T T C A A T A A G A A G T T G C T G T T C T  cohl_ai2.seq
11185 T A A G T T G C T G A A T C T C T T T C T C T T G T T T T T C A A T A A G A A G T T G C T G T T C T  a909_ai2.seq

      A A C A T A A T T T C T A G C A A G T C T T T T C T T T T T A A T T T T T T T A A A T C T T C C A T  Majority
                      11260               11270               11280               11290               11300
11239 A A C A T A A T T T C T A G C A A G T C T T T T C T T T T T A A T T T T T T T A A A T C T T C C A T  cohl_ai2.seq
11235 A A C A T A A T T T C T A G C A A G T C T T T T C T T T T T A A T T T T T T T A A A T C T T C C A T  a909_ai2.seq

      C G C G A T T A C T T C C T T A A C T G A A C C T T A A A T T A T C G T T T A G A T A T T A T A T C  Majority
                      11310               11320               11330               11340               11350
11289 C G C G A T T A C T T C C T T A A C T G A A C C T T A A A T T A T C G T T T A G A T A T T A T A T C  cohl_ai2.seq
11285 C G C G A T T A C T T C C T T A A C T G A A C C T T A A A T T A T C G T T T A G A T A T T A T A T C  a909_ai2.seq

      A A A G T T C T A A C C T T T A A A C T C A T T T T T T G T C C T G T G T T T T T T C T C A A A A A  Majority
                      11360               11370               11380               11390               11400
11339 A A A G T T C T A A C C T T T A A A C T C A T T T T T T G T C C T G T G T T T T T T C T C A A A A A  cohl_ai2.seq
11335 A A A G T T C T A A C C T T T A A A C T C A T T T T T T G T C C T G T G T T T T T T C T C A A A A A  a909_ai2.seq

      A G T C T A T G C T A A A T T A A C A T T T T T G A T A A T T T T T T G A A A A A T C T C A T C G A  Majority
                      11410               11420               11430               11440               11450
11389 A G T C T A T G C T A A A T T A A C A T T T T T G A T A A T T T T T T G A A A A A T C T C A T C G A  cohl_ai2.seq
11385 A G T C T A T G C T A A A T T A A C A T T T T T G A T A A T T T T T T G A A A A A T C T C A T C G A  a909_ai2.seq

      A G T C A T T T T C T T T T T G A A A G C T C G A A T T C T A G G C A T T A A A A A G C C A T A T A  Majority
                      11460               11470               11480               11490               11500
11439 A G T C A T T T T C T T T T T G A A A G C T C G A A T T C T A G G C A T T A A A A A G C C A T A T A  cohl_ai2.seq
11435 A G T C A T T T T C T T T T T G A A A G C T C G A A T T C T A G G C A T T A A A A A - - - - - - - - -  a909_ai2.seq

      T C A A A T T G A T A T A T G G C T T T T T T T A T T A T T T A A A A C A A A A G A A T C A A T A G  Majority
                      11510               11520               11530               11540               11550
11489 T C A A A T T G A T A T A T G G C T T T T T T T A T T A T T T A A A A C A A A A G A A T C A A T A G  cohl_ai2.seq
11476 - - - - - - - - - - - - - - - - - - - - - - - - - - - - - - - - - - A C A A A A G A A T C A A T A G  a909_ai2.seq

      G A C A A T A G C G T C A A T T T A G T G A C A T A A T C T A T T A C A G A T T A A G T T C T T T T  Majority
                      11560               11570               11580               11590               11600
11539 G A C A A T A G C G T C A A T T T A G T G A C A T A A T C T A T T A C A G A T T A A G T T C T T T T  cohl_ai2.seq
11492 G A C A A T A G C A T C A A T T T A G T G A C A C A A T C T A T T A C A G A T T A A G T T C T T T T  a909_ai2.seq

      T G A A T A A T A T A A T C C A A C T T T T C A A C T G T T T T T T C C C A T G T G A A A T G T T C  Majority
                      11610               11620               11630               11640               11650
11589 T G A A T A A T A T A A T C C A A C T T T T C A A C T G T T T T T T C C C A T G T G A A A T G T T C  cohl_ai2.seq
11542 T G A A T A A T A T A A T C C A A C T T T T C A A C T G T T T T T T C C C A G G T G A A A T G T T C  a909_ai2.seq

      T T T A A T T C T T T T A G C A A T A T T C T G T T G T A G T T T C T C T C T T A A T G C C T T A T  Majority
                      11660               11670               11680               11690               11700
11639 T T T A A T T C T T T T A G C A A T A T T C T G T T G T A G T T T C T C T C T T A A T G C C T T A T  cohl_ai2.seq
11592 T T T A A T T C T T T T A G C A A T A T T C T G T T G T A A T T T C T C T C T T A A T G C C T T A T  a909_ai2.seq
```

FIGURE 21S

Alignment Report of ai-2_variant_2, using J. Hein method with Weighted residue weight table.
Thursday, July 29, 2004 6:49 PM

```
      CTTTTACTAATAAATCAAGAGATTCATGGAGTGACTGAGTATTTTCTTCC Majority
                11710     11720     11730     11740     11750
11689 CTTTTACTAATAAATCAAGAGATTCATGGAGTGACTGAGTATTTTCTTCC cohl_ai2.seq
11642 CTTTTACTAATAAATCAAGAGATTCATGGAGTGACTGAGTATTTTCTTCC a909_ai2.seq

      ATGATGATTCCTAACTCAGGGCTATCAATAACTTCAACTGTTCCACCGCG Majority
                11760     11770     11780     11790     11800
11739 ATGATGATTCCTAACTCAGGGCTATCAATAACTTCAACTGTTCCACCGCG cohl_ai2.seq
11692 ATGATGATTCCTAACTCAGGGCTATCAATAACTTCAACTGTTCCACCGCG a909_ai2.seq

      ATCTGTTGCAATAATAGCACTCGAAAGTAGACCAGCTTCTAAAATAGAGG Majority
                11810     11820     11830     11840     11850
11789 ATCTGTTGCAATAATAGCACTCGAAAGTAGACCAGCTTCTAAAATAGAGG cohl_ai2.seq
11742 ATCTGTTGCAATAATAGCACTCGAAAGTAGACCAGCTTCTAAAATAGAGG a909_ai2.seq

      TTGGTAATCCCTCTGGATACATTGATGGGTAAACAAAGATATCTGTCTGT Majority
                11860     11870     11880     11890     11900
11839 TTGGTAATCCCTCTGGATACATTGATGGGTAAACAAAGATATCTGTCTGT cohl_ai2.seq
11792 TTGGTAATCCCTCTGGATACATTGATGGGTAAACAAAGATATCTGTCTGT a909_ai2.seq

      GCCATTAAAGACATAGTCTGTTCAAAGTTTAATTTCCCCAAAAAGTTAAT Majority
                11910     11920     11930     11940     11950
11889 GCCATTAAAGACATAGTCTGTTCAAAGTTTAATTTCCCCAAAAAGTTAAT cohl_ai2.seq
11842 GCCATTAAAGACATAGTCTGTTCAAAGTTTAATTTCCCCAAAAAGTTAAT a909_ai2.seq

      CTGTTTGGACTGATATTTCTCTTTCAAATGTGCTAATTCAGGTCCGTCTC Majority
                11960     11970     11980     11990     12000
11939 CTGTTTGGACTGATATTTCTCTTTCAAATGTGCTAATTCAGGTCCGTCTC cohl_ai2.seq
11892 CTGTTTGGACTGATATTTCTCTTTCAAATGTGCTAATTCAGGTCCGTCTC a909_ai2.seq

      CTGCAATCTGTAAATAAACATTTTCAGAGTACTGTGACATCGAAAATGCT Majority
                12010     12020     12030     12040     12050
11989 CTGCAATCTGTAAATAAACATTTTCAGAGTACTGTGACATCGAAAATGCT cohl_ai2.seq
11942 CTGCAATCTGTAAATAAACATTTTCAGAGTACTGTGACATCGAAAATGCT a909_ai2.seq

      TCTAAGAGCAATTCAATGCCTTTTTCTTTAATAATTCTACCAGCATAAGT Majority
                12060     12070     12080     12090     12100
12039 TCTAAGAGCAATTCAATGCCTTTTTCTTTAATAATTCTACCAGCATAAGT cohl_ai2.seq
11992 TCTAAGAGCAATTCAATGCCTTTTTCTTTAATAATTCTACCAGCATAAGT a909_ai2.seq

      GATGAAAATATCATCAGCAGATTTTTCAAGGTAAGCCGTGTCAGCAAAAT Majority
                12110     12120     12130     12140     12150
12089 GATGAAAATATCATCAGCAGATTTTTCAAGGTAAGCCGTGTCAGCAAAAT cohl_ai2.seq
12042 GATGAAAATATCATCAGCAGATTTTTCAAGGTAAGCCGTACCAGCAAAAT a909_ai2.seq

      CAGAGCCTAGACTTTCAGATACCGAATTATAAATAACTCCTTTAGCTTCT Majority
                12160     12170     12180     12190     12200
12139 CAGAACCTAGACTTTCAGATACCGAATTATAAATAACTCCTTTAGCTTCT cohl_ai2.seq
12092 CAGAGCCTAGACTTTCAGATACCGAATTATAAATAACTCCTTTAGCTTCT a909_ai2.seq

      ATATTAAAATGTTTTAACCATTCAACGCTTCTCTTGGATACCGCATAAAA Majority
                12210     12220     12230     12240     12250
12189 ATATTAAAATGTTTTAACCACTCAACGCTTCTCTTAGATACCGCATAAAA cohl_ai2.seq
12142 ATATTAAAATGTTTTAACCATTCAACGCTTCTCTTGGATACCGCATAAAA a909_ai2.seq

      ATCTGGACGATAGTGCTTAACACGCGCTGTGAGAAGATGTTCATAGATAG Majority
                12260     12270     12280     12290     12300
12239 ATCTGGACGATAGTGCTTAACACGCGCTGTGAGAAGATGTTCATAGATAG cohl_ai2.seq
12192 ATCTGGACGATAGTGCTTAACACGCGCTGTGAGAAGATGTTCATAGATAG a909_ai2.seq

      CTCCAAAGAAATCTAAAAAACGATTATTGACAGAAAAATGACTTGACCCA Majority
                12310     12320     12330     12340     12350
12289 CTCCAAAGAAATCTAAAAAACGATTATTGACAGAAAAATGACTTGACCCA cohl_ai2.seq
12242 CTCCAAAGAAATCTAAAAAACGATTATTGACAGAAAAATGACTTGACCCA a909_ai2.seq
```

FIGURE 21T

Alignment Report of ai-2_variant_2, using J. Hein method with Weighted residue weight table.
Thursday, July 29, 2004 6:49 PM

```
      T G G T C T A A A A C A A T A C T A G G T A A A C G G T G C T T C T T T G C A A A A G A T A G C C C Majority
                12360               12370               12380               12390               12400
12339 T G G T C T A A A A C A A T A C T A G G T A A A C G G T G C T T C T T T G C A A A A G A T A G C C C coh1_ai2.seq
12292 T G G T C T A A A A C A A T A C T A G G T A A A C G G T G C T T C T T T G C A A A A G A T A G C C C a909_ai2.seq

      T T C T A G C G T T G T T A A C T G A A A A C G T G T A T T A C A A A T C A C A A A A T C A A T A T Majority
                12410               12420               12430               12440               12450
12389 T T C T A G C G T T G T T A A C T G A A A A C G T G T A T T A C A A A T C A C A A A A T C A A T A T coh1_ai2.seq
12342 T T C T A G C G T T G T T A A C T G A A A A C G T G T A T T A C A A A T C A C A A A A T C A A T A T a909_ai2.seq

      T T T C A T C T G A A A C A T G T T T C A T C A G C G T G T T G T A T T C T C G A T T T T T G T T A Majority
                12460               12470               12480               12490               12500
12439 T T T C A T C T G A A A C A T G T T T C A T C A G C G T G T T G T A T T C T C G A T T T T T G T T A coh1_ai2.seq
12392 T T T C A T C T G A A A C A T G T T T C A T C A G C G T G T T G T A T T C T C G A T T T T T G T T A a909_ai2.seq

      A T A A T A G G A T A G C G C T G C T T G A C A A T G T T T T T G G T C G G T A A A C G G T A A A T Majority
                12510               12520               12530               12540               12550
12489 A T A A T A G G A T A G C G C T G C T T G A C A A T A T T T T T G G T C G G T A A A C G G T A A A T coh1_ai2.seq
12442 A T A A T A G G A T A G C G C T G C T T G A C A A T G T T T T T G G T C G G T A A A C G G T A A A T a909_ai2.seq

      T T T T C T A C C C T T G T C T T C A T C T A T A A T C G G T A A A T C A T C A T G A T T A G T T G Majority
                12560               12570               12580               12590               12600
12539 T T T T C T A C C C T T G T C T T C A T C T A T A A T C G G T A A A T C A T C A T G A T T A G T T G coh1_ai2.seq
12492 T T T T C T A C C C T T G T C T T C A T C T A T A A T C G G T A A A T C A C C A T G A T T A G T T G a909_ai2.seq

      T T A C A A T A A C A A C A C G G T A G C C A C G C T T A A C C A A A T C T G C T G T C A T T T T A Majority
                12610               12620               12630               12640               12650
12589 T T A C A A T A A C A A C A C G G T A G C C A C G C T T A A C C A A A T C T G C T G T C A T T T T A coh1_ai2.seq
12542 T T A C A A T A A C A A C A C G G T A G C C A C G C T T A A C C A A A T C T G C T G T C A T T T T A a909_ai2.seq

      T C T G T A T A A C G T T C A A T A C C T C C G A G G A A G G G T A G A T A A T A T C C T G A G A A Majority
                12660               12670               12680               12690               12700
12639 T C T G T A T A A C G T T C A A T A C C T C C G A G G A A G G G T A G A T A A T A T C C T G A G A A coh1_ai2.seq
12592 T C T G T A T A A C G T T C A A T A C C T C C G A G G A A G G G T A G A T A A T A T C C T G A G A A a909_ai2.seq

      A A C A G C A A C T G T T T T T A C C T T A T T T T C C A T A T T T A T C C A C T T T C A T C A A T Majority
                12710               12720               12730               12740               12750
12689 A A C A G C A A C T G T T T T T A C C T T A T T T T C C A T A T T T A T C C A C T T T C A T C A A T coh1_ai2.seq
12642 A A C A G C A A C T G T T T T T A C C T T A T T T T C C A T A T T T A T C C A C T T T C A T C A A T a909_ai2.seq

      A A G C C A T C T T T T A A G C C T T T A A T C A T A G C A A C T A A T T T T T T G C T C T T T T G Majority
                12760               12770               12780               12790               12800
12739 A A G C C A T C T T T T A A G C C T T T A A T C A T A G C A A C T A A T T T T T T G C T C T T T T G coh1_ai2.seq
12692 A A G C C A T C T T T T A A G C C T T T A A T C A T A G C A A C T A A T T T T T T G C T C T T T T G a909_ai2.seq

      C T C T T C T G C T A C C A A C A C T C G A A C A A A T T C A T T T C G C A T A A A T A C T A A A T Majority
                12810               12820               12830               12840               12850
12789 C T C T T C T G C T A C C A A C A C T C G A A C A A A T T C A T T T C G C A T A A A T A C T A A A T coh1_ai2.seq
12742 C T C T T C T G C T A C C A A C A C T C G A A C A A A T T C A T T T C G C A T A A A T A C T A A A T a909_ai2.seq

      A T T T G T G C C G C T T C T T C T T A C C A T A T T T T T T T A T A A T A T A A A T C G C A T T G Majority
                12860               12870               12880               12890               12900
12839 A T T T G T G C C G C T T C T T C T T A C C A T A T T T T T T T A T A A T A T A A A T C G C A T T G coh1_ai2.seq
12792 A T T T G T G C C G C T T C T T C T T A C C A T A T T T T T T T A T A A T A T A A A T C G C A T T G a909_ai2.seq

      C G T A T C A T G T A A T A T T T T C G A A A T G G T G A A T G A T T C A A T A C A T G A A A A A C Majority
                12910               12920               12930               12940               12950
12889 C G T A T C A T G T A A T A T T T T C G A A A T G G T G A A T G A T T C A A T A C A T G A A A A A C coh1_ai2.seq
12842 C G T A T C A T G T A A T A T T T T C G A A A T G G T G A A T G A T T C A A T A C A T G A A A A A C a909_ai2.seq

      A T G G C C A A A T T T T T T A A C T C G T G A A G A G T G T C C A A T T T C G T G T A A A A G A C Majority
                12960               12970               12980               12990               13000
12939 A T G G C C A A A T T T T T T A A C T C G T G A A G A G T G T C C A A T T T C G T G T A A A A G A C coh1_ai2.seq
12892 A T G G C C A A A T T T T T T A A C T C G T G A A G A G T G T C C A A T T T C G T G T A A A A G A C a909_ai2.seq
```

FIGURE 21U

Alignment Report of ai-2_variant_2, using J. Hein method with Weighted residue weight table.
Thursday, July 29, 2004 6:49 PM

```
      CAATAAAATTAACCTGATAAGTCTTATATCCCATCTCTGACAGACGATAA Majority
                13010     13020     13030     13040     13050
12989 CAATAAAATTAACCTGATAAGTCTTATATCCCATCTCTGACAGACGATAA coh1_ai2.seq
12942 CAATAAAATTAACCTGATAAGTCTTATATCCCATCTCTGACAGACGATAA a909_ai2.seq

      TTCATTTCAGAGTCAACAAAATCAATAAACATCTCTTCTGCAAAGCCAGA Majority
                13060     13070     13080     13090     13100
13039 TTCATTTCAGAGTCAACAAAATCAATAAACATCTCTTCTGCAAAGCCAGA coh1_ai2.seq
12992 TTCATTTCAGAGTCAACAAAATCAATAAACATCTCTTCTGCAAAGCCAGA a909_ai2.seq

      TGTTTCTTCAAAAACGCTCGTTTTCATTAAAGCAGCCGAAGTAATACACT Majority
                13110     13120     13130     13140     13150
13089 TGTTTCTTCAAAAACGCTCGTTTTCATTAAAGCAGCCGAAGTAATACACT coh1_ai2.seq
13042 TGTTTCTTCAAAAACGCTCGTTTTCATTAAAGCAGCCGAAGTAATACACT a909_ai2.seq

      CTTCAATTTCTTTATAGTCAAATTCTTGCATCACTAAATCTTCACGGTTC Majority
                13160     13170     13180     13190     13200
13139 CTTCAATTTCTTTATAGTCAAATTCTTGCATAACTAAATCTTCACGGTTC coh1_ai2.seq
13092 CTTCAATTTCTTTATAGTCAAATTCTTGCATCACTAAATCTTCACGGTTC a909_ai2.seq

      ATATCTTGATACAAACAAGATAACATACCGACCTTAGGTAAATGAAGGTA Majority
                13210     13220     13230     13240     13250
13189 ATATCTTGATACAAACAAGATAACATACCGACCTTAGGTAAAAGAAGGTA coh1_ai2.seq
13142 ATATCTTGATACAAACAAGATAACATACCGACCTTAGGTAAATGAAGGTA a909_ai2.seq

      ATTTTCATAATTATCTATCAAATCACCTAGGACAACCGAATCTTGATCTA Majority
                13260     13270     13280     13290     13300
13239 ATTTTCATAATTATCTATCAAATCACCTAGGACAACCGAATCTTGATCTA coh1_ai2.seq
13192 ATTTTCATAATTATCTATCAAATCACCTAGGACAACCGAATCTTGATCTA a909_ai2.seq

      AAGTCAAGAACCAATCAAATTCTTGTGCTACTGCAAATTGACCGATACAG Majority
                13310     13320     13330     13340     13350
13289 AAGTCAAGAACCAATCAAATTCTTGTGCTACTGCAAATTGACCGATACAG coh1_ai2.seq
13242 AAGTCAAGAACCAATCAAATTCTTGTGCTACTGCAAATTGACCAATACAG a909_ai2.seq

      TTCAAAGCATATGCAATTCCTTTATTTTCTGTTAAATAATCAACAGTTAG Majority
                13360     13370     13380     13390     13400
13339 TTCAAAGCATATGCAATTCCTTTATTTTCTGTTAAATAATCAACAGTTAG coh1_ai2.seq
13292 TTCAAAGCATATGCAATTCCTTTATTTTCTGTTAAATAATCAACAGTTAG a909_ai2.seq

      GTGCCCCTCTTCATTATAATCGGCCACTAATTGAGAAATTTCTTCCTTAT Majority
                13410     13420     13430     13440     13450
13389 GTGCCCCTCTTCATTATAATCGGCCACTAATTGAGAAATTTCTTCCTTAT coh1_ai2.seq
13342 GTGCCCCTCTTCATTATAATCGGCCACTAATTGAGAAATTTCCTCCTTAT a909_ai2.seq

      TTTTCGAGCCATTATCTACGATGTAGATATGGCTTACTTGAGGATAAATT Majority
                13460     13470     13480     13490     13500
13439 TTTTCGAGCCATTATCTACGATGTAGATATGGCTTACTTGAGGATAAATT coh1_ai2.seq
13392 TTTTCGAGCCATTATCTACGATGTAGATATGGCTTACTTGAGGATAAATT a909_ai2.seq

      GCTCGAATGTTCTGATCTAAGCGTTCAATATTGGGGTTAAAGGTGACAAT Majority
                13510     13520     13530     13540     13550
13489 GCTCGAATGTTCTGATCTAAGCGTTCAATATTGGGGTTAAAGGTGACAAT coh1_ai2.seq
13442 GCTCGAATGTTCTGATCTAAGCGTTCAATATTGGGGTTAAAGGTGACAAT a909_ai2.seq

      ACCCGCTAAATATTTCATGTTCTATGCTCTTTTCTAAAATCTCTAAATAA Majority
                13560     13570     13580     13590     13600
13539 ACCCGCTAAATATTTCATGTTCTATGCTCTTTTCTAAAATCTCTAAATAA coh1_ai2.seq
13492 ACCCGCTAAATATTTCATGTTCTATGCTCTTTTCTAAAATCTCTAAATAA a909_ai2.seq

      CTGAATGACTGGTGCTTTGGTTATAAAAACGATACCGACATAGATAGTTA Majority
                13610     13620     13630     13640     13650
13589 CTGAATGACTGGTGCTTTGGTTATAAAAACGATACCGACATAGATAGTTA coh1_ai2.seq
13542 CTGAATGACTGGTGCTTTGGTTATAAAAACGATACCGACATAGATAGTTA a909_ai2.seq
```

FIGURE 21V

Alignment Report of ai-2_variant_2, using J. Hein method with Weighted residue weight table.
Thursday, July 29, 2004 6:49 PM

```
           C T G C T A C T A A A C T T T G A A T G A C A T A A T T T A C C A A T G A T A C T G A C A T T T G A   Majority
                    13660             13670             13680             13690             13700

13639      C T G C T A C T A A A C T T T G A A T G A C A T A A T T T A C C A A T G A T A C T G A C A T T T G A   coh1_ai2.seq
13592      C T G C T A C T A A A C T T T G A A T G A C A T A A T T T A C C A A T G A T A C T G A C A T T T G A   a909_ai2.seq

           G T A T T G A T A T A A T A G A G T A C A G C T C C A C T A A G A G T A G C A G C A A T T A A A T A   Majority
                    13710             13720             13730             13740             13750

13689      G T A T T G A T A T A A T A A A G T A C A G C T C C A C T A A G A G T A G C A G C A A T T A A A T A   coh1_ai2.seq
13642      G T A T T G A T A T A A T A G A G T A C A G C T C C A C T A A G A G T A G C A G C A A T T A A A T A   a909_ai2.seq

           G C G C A G C A T T C C T C T T G T T A A T T C T T T A A A A G T A A A T A C A T C T C T T A A A G   Majority
                    13760             13770             13780             13790             13800

13739      G C G C A G C A T T C C T C T T G T T A A T T C T T T A A A A G T A A A T A C A T C T C T T A A A G   coh1_ai2.seq
13692      G C G C A G C A T T C C T C T T G T T A A T T C T T T A A A A G T A A A T A C A T C T C T T A A A G   a909_ai2.seq

           A G A T A G C T T G A T A T A G G G A G A C A A T A A A T T C A G T A A T A A C T G T A G A G A T A   Majority
                    13810             13820             13830             13840             13850

13789      A G A T A G C T T G A T A G A G G G A G A C A A T A A A T T C A G T A A T A A C T G T A G A G A T A   coh1_ai2.seq
13742      A G A T A G C T T G A T A T A G A G A G A C A A T A A A T T C A G T A A T A A C T G T A G A G A T A   a909_ai2.seq

           A T A G C T C C C A T A G C A C C T A A A A T T G G T A T T A A A A G T A T A T T A A G C A C A A C   Majority
                    13860             13870             13880             13890             13900

13839      A T A G C T C C C A T A G C A C C T A A A A T T G G T A T T A A A A G T A T A T T A A G C A C A A C   coh1_ai2.seq
13792      A T A G C T C C C A T A G C A C C T A A A A T T G G T A T T A A A A G T A T A T T A A G C A C A A C   a909_ai2.seq

           A T T T G C C A C A A G T C C A A T A A C T G C A G A C A T T G T G T A A G C T T T T G T A C G T C   Majority
                    13910             13920             13930             13940             13950

13889      A T T T G C C A C A A G T C C A A T A A C T G C A G A C A T T G T G T A A G C T T T T G T A C G T C   coh1_ai2.seq
13842      A T T T G C C A C A A G T C C A A T A A C T G C A G A C A T T G T G T A A G C T T T T G T A C G T C   a909_ai2.seq

           T T G A A G C C A G T A G A T A C T G T G T C C C T A A A G C G T T A C C A T A A G A A A T G C A A   Majority
                    13960             13970             13980             13990             14000

13939      T T G A A G C C A G T A G A T A C T G T G T C C C T A A A G C G T T A C C A T A A G A A A T G C A A   coh1_ai2.seq
13892      T T G A A G C C A G T A G A T A C T G T G T C C C T A A A G C G T T A C C A T A A G A A A T G C A A   a909_ai2.seq

           A T G A T C A T C A A A                                                                               Majority
                    14010

13989      A T G A T C A T C A A A                                                                               coh1_ai2.seq
13942      A T G A T C A T C A A A                                                                               a909_ai2.seq
```

Decoration 'Decoration #1': Shade (with solid black) residues that differ from the Consensus.

FIGURE 22A

Alignment Report of gbs80_align, using Clustal method with PAM250 residue weight table.
Thursday, July 29, 2004 6:57 PM

```
    M K L S K K L L F S A A V L T M V A G S T V E P V A Q F A T G M S I V R A A E V S Q E R P A K T T V  Majority
                      10                  20                  30                  40                  50
1   M K L S K K L L F S A A V L T M V A G S T V E P V A Q F A T G M S I V R A A E V S Q E R P A K T T V  sag645_2603.pep
1   M K L S K K L L F S A A V L T I V A G S T V E P V A Q F A T G M S I V R A A E V S Q E R P A K T T V  sag645_a909.pep
1   M K L S K K L L F S A A V L T I V A G S T V E P V A Q F A T G M S I V R A A E V S Q E R P A K T T V  sag645_cjb111.pep
1   M K L S K K L L F S A A V L T M V A G S T V E P V A Q F A T G M S I V R A A E V S Q E R P A K T T V  sag645_coh1.pep
1   M K L S K K L L F S A A V L T M V A G S T V E P V A Q F A T G M S I V R A A E V S Q E R P A K T T V  sag645_nem316.pep

    N I Y K L Q A D S Y K S E I T S N G G I E N K D G E V I S N Y A K L G D N V K G L Q G V Q F K R Y K  Majority
                      60                  70                  80                  90                  100
51  N I Y K L Q A D S Y K S E I T S N G G I E N K D G E V I S N Y A K L G D N V K G L Q G V Q F K R Y K  sag645_2603.pep
51  N I Y K L Q A D S Y K S E I T S N G G I E N K D G E V I S N Y A K L G D N V K G L Q G V Q F K R Y K  sag645_a909.pep
51  N I Y K L Q A D S Y K S E I T S N G G I E N K D G E V I S N Y A K L G D N V K G L Q G V Q F K R Y K  sag645_cjb111.pep
51  N I Y K L Q A D S Y K S E I T S N G G I E N K D G E V I S N Y A K L G D N V K G L Q G V Q F K R Y K  sag645_coh1.pep
51  N I Y K L Q A D S Y K S E I T S N G G I E N K D G E V I S N Y A K L G D N V K G L Q G V Q F K R Y K  sag645_nem316.pep

    V K T D I S V D E L K K L T T V E A A D A K V G T I L E E G V S L P Q K T N A Q G L V V D A L D S K  Majority
                      110                 120                 130                 140                 150
101 V K T D I S V D E L K K L T T V E A A D A K V G T I L E E G V S L P Q K T N A Q G L V V D A L D S K  sag645_2603.pep
101 V K T D I S V D E L K K L T T V E A A D A K V G T I L E E G V S L P Q K T N A Q G L V V D A L D S K  sag645_a909.pep
101 V K T D I S V D E L K K L T T V E A A D A K V G T I L E E G V S L P Q K T N A Q G L V V D A L D S K  sag645_cjb111.pep
101 V K T D I S V D E L K K L T T V E A A D A K V G T I L E E G V S L P Q K T N A Q G L V V D A L D S K  sag645_coh1.pep
101 V K T D I S V D E L K K L T T V E A A D A K V G T I L E E G V S L P Q K T N A Q G L V V D A L D S K  sag645_nem316.pep

    S N V R Y L Y V E D L K N S P S N I T K A Y A V P F V L E L P V A N S T G T G F L S E I N I Y P K N  Majority
                      160                 170                 180                 190                 200
151 S N V R Y L Y V E D L K N S P S N I T K A Y A V P F V L E L P V A N S T G T G F L S E I N I Y P K N  sag645_2603.pep
151 S N V R Y L Y V E D L K N S P S N I T K A Y A V P F V L E L P V A N S T G T G F L S E I N I Y P K N  sag645_a909.pep
151 S N V R Y L Y V E D L K N S P S N I T K A Y A V P F V L E L P V A N S T G T G F L S E I N I Y P K N  sag645_cjb111.pep
151 S N V R Y L Y V E D L K N S P S N I T K A Y A V P F V L E L P V A N S T G T G F L S E I N I Y P K N  sag645_coh1.pep
151 S N V R Y L Y V E D L K N S P S N I T K A Y A V P F V L E L P V A N S T G T G F L S E I N I Y P K N  sag645_nem316.pep

    V V T D E P K T D K D V K K L G Q D D A G Y T I G E E F K W F L K S T I P A N L G D Y E K F E I T D  Majority
                      210                 220                 230                 240                 250
201 V V T D E P K T D K D V K K L G Q D D A G Y T I G E E F K W F L K S T I P A N L G D Y E K F E I T D  sag645_2603.pep
201 V V T D E P K T D K D V K K L G Q D D A G Y T I G E E F K W F L K S T I P A N L G D Y E K F E I T D  sag645_a909.pep
201 V V T D E P K T D K D V K K L G Q D D A G Y T I G E E F K W F L K S T I P A N L G D Y E K F E I T D  sag645_cjb111.pep
201 V V T D E P K T D K D V K K L G Q D D A G Y T I G E E F K W F L K S T I P A N L G D Y E K F E I T D  sag645_coh1.pep
201 V V T D E P K T D K D V K K L G Q D D A G Y T I G E E F K W F L K S T I P A N L G D Y E K F E I T D  sag645_nem316.pep

    K F A D G L T Y K S V G K I K I G S K T L N R D E H Y T I D E P T V D N Q N T L K I T F K P E K F K  Majority
                      260                 270                 280                 290                 300
251 K F A D G L T Y K S V G K I K I G S K T L N R D E H Y T I D E P T V D N Q N T L K I T F K P E K F K  sag645_2603.pep
251 K F A D G L T Y K S V G K I K I G S K T L N R D E H Y T I D E P T V D N Q N T L K I T F K P E K F K  sag645_a909.pep
251 K F A D G L T Y K S V G K I K I G S K T L N R D E H Y T I D E P T V D N Q N T L K I T F K P E K F K  sag645_cjb111.pep
251 K F A D G L T Y K S V G K I K I G S K T L N R D E H Y T I D E P T V D N Q N T L K I T F K P E K F K  sag645_coh1.pep
251 K F A D G L T Y K S V G K I K I G S K T L N R D E H Y T I D E P T V D N Q N T L K I T F K P E K F K  sag645_nem316.pep

    E I A E L L K G M T L V K N Q D A L D K A T A N T D D A A F L E I P V A S T I N E K A V L G K A I E  Majority
                      310                 320                 330                 340                 350
301 E I A E L L K G M T L V K N Q D A L D K A T A N T D D A A F L E I P V A S T I N E K A V L G K A I E  sag645_2603.pep
301 E I A E L L K G M T L V K N Q D A L D K A T A N T D D A A F L E I P V A S T I N E K A V L G K A I E  sag645_a909.pep
301 E I A E L L K G M T L V K N Q D A L D K A T A N T D D A A F L E I P V A S T I N E K A V L G K A I E  sag645_cjb111.pep
301 E I A E L L K G M T L V K N Q D A L D K A T A N T D D A A F L E I P V A S T I N E K A V L G K A I E  sag645_coh1.pep
301 E I A E L L K G M T L V K N Q D A L D K A T A N T D D A A F L E I P V A S T I N E K A V L G K A I E  sag645_nem316.pep

    N T F E L Q Y D H T P D K A D N P K P S N P P R K P E V H T G G K R F V K K D S T E T Q T L G G A E  Majority
                      360                 370                 380                 390                 400
351 N T F E L Q Y D H T P D K A D N P K P S N P P R K P E V H T G G K R F V K K D S T E T Q T L G G A E  sag645_2603.pep
351 N T F E L Q Y D H T P D K A D N P K P S N P P R K P E V H T G G K R F V K K D S T E T Q T L G G A E  sag645_a909.pep
351 N T F E L Q Y D H T P D K A D N P K P S N P P R K P E V H T G G K R F V K K D S T E T Q T L G G A E  sag645_cjb111.pep
351 N T F E L Q Y D H T P D K A D N P K P S N P P R K P E V H T G G K R F V K K D S T E T Q T L G G A E  sag645_coh1.pep
351 N T F E L Q Y D H T P D K A D N P K P S N P P R K P E V H T G G K R F V K K D S T E T Q T L G G A E  sag645_nem316.pep
```

FIGURE 22B

Alignment Report of gbs80_align, using Clustal method with PAM250 residue weight table.
Thursday, July 29, 2004 6:57 PM

```
    F D L L A S D G T A V K W T D A L I K A N T N K N Y I A G E A V T G Q P I K L K S H T D G T F E I K Majority
                      410                 420                 430                 440                 450
401 F D L L A S D G T A V K W T D A L I K A N T N K N Y I A G E A V T G Q P I K L K S H T D G T F E I K sag645_2603.pep
401 F D L L A S D G T A V K W T D A L I K A N T N K N Y I A G E A V T G Q P I K L K S H T D G T F E I K sag645_a909.pep
401 F D L L A S D G T A V K W T D A L I K A N T N K N Y I A G E A V T G Q P I K L K S H T D G T F E I K sag645_cjb111.pep
401 F D L L A S D G T A V K W T D A L I K A N T N K N Y I A G E A V T G Q P I K L K S H T D G T F E I K sag645_coh1.pep
401 F D L L A S D G T A V K W T D A L I K A N T N K N Y I A G E A V T G Q P I K L K S H T D G T F E I K sag645_nem316.pep

    G L A Y A V D A N A E G T A V T Y K L K E T K A P E G Y V I P D K E I E F T V S Q T S Y N T K P T D Majority
                      460                 470                 480                 490                 500
451 G L A Y A V D A N A E G T A V T Y K L K E T K A P E G Y V I P D K E I E F T V S Q T S Y N T K P T D sag645_2603.pep
451 G L A Y A V D A N A E G T A V T Y K L K E T K A P E G Y V I P D K E I E F T V S Q T S Y N T K P T D sag645_a909.pep
451 G L A Y A V D A N A E G T A V T Y K L K E T K A P E G Y V I P D K E I E F T V S Q T S Y N T K P T D sag645_cjb111.pep
451 G L A Y A V D A N A E G T A V T Y K L K E T K A P E G Y V I P D K E I E F T V S Q T S Y N T K P T D sag645_coh1.pep
451 G L A Y A V D A N A E G T A V T Y K L K E T K A P E G Y V I P D K E I E F T V S Q T S Y N T K P T D sag645_nem316.pep

    I T V D S A D A T P D T I K N N K R P S I P N T G G I G T A I F V A I G A A V M A F A V K G M K R R Majority
                      510                 520                 530                 540                 550
501 I T V D S A D A T P D T I K N N K R P S I P N T G G I G T A I F V A I G A A V M A F A V K G M K R R sag645_2603.pep
501 I T V D S A D A T P D T I K N N K R P S I P N T G G I G T A I F V A I G A A V M A F A V K G M K R R sag645_a909.pep
501 I T V D S A D A T P D T I K N N K R P S I P N T G G I G T A I F V A I G A A V M A F A V K G M K R R sag645_cjb111.pep
501 I T V D S A D A T P D T I K N N K R P S I P N T G G I G T A I F V A I G A A V M A F A V K G M K R R sag645_coh1.pep
501 I T V D S A D A T P D T I K N N K R P S I P N T G G I G T A I F V A I G A A V M A F A V K G M K R R sag645_nem316.pep

    T K D N                                                                                         Majority

551 T K D N                                                                                         sag645_2603.pep
551 T K D N                                                                                         sag645_a909.pep
551 T K D N                                                                                         sag645_cjb111.pep
551 T K D N                                                                                         sag645_coh1.pep
551 T K D N                                                                                         sag645_nem316.pep
```

Decoration 'Decoration #1': Shade (with solid black) residues that differ from the Consensus.

FIGURE 23A

Alignment Report of gbs104_align, using Clustal method with PAM250 residue weight table.
Thursday, July 29, 2004 7:05 PM

```
    M K K R Q K I W R G L S V T L L I L S Q I P F G I L V Q G E T Q D T N Q A L G K V I V K K T G D N A  Majority
                      10                  20                  30                  40                  50
1   M K K R Q K I W R G L S V T L L I L S Q I P F G I L V Q G E T Q D T N Q A L G K V I V K K T G D N A  sag649_2603.pep
1   M K K R Q K I W R G L S V T L L I L S Q I P F G I L V Q G E T Q D T N Q A L G K V I V K K T G D N A  sag649_coh1.pep
1   M K K R Q K I W R G L S V T L L I L S Q I P F G I L V Q G E T Q D T N Q A L G K V I V K K T G D N A  sag649_cjb111.pep
1   M K K R Q K I W R G L S V T L L I L S Q I P F G I L V Q G E T Q D T N Q A L G K V I V K K T G D N A  sag649_18rs21.pep
1   M K K R Q K I W R G L S V T L L I L S Q I P F G I L V Q G E T Q D T N Q A L G K V I V K K T G D N A  sag649_nem316.pep
1   M K K R Q K I W R G L S V T L L I L S Q I P F G I L V Q G E T Q D T N Q A L G K V I V K K T G D N A  sag649_cjb111.pep

    T P L G K A T F V L K N D N D K S E T S H E T V E G S G E A T F E N I K P G D Y T L R E E T A P I G  Majority
                      60                  70                  80                  90                 100
51  T P L G K A T F V L K N D N D K S E T S H E T V E G S G E A T F E N I K P G D Y T L R E E T A P I G  sag649_2603.pep
51  T P L G K A T F V L K N D N D K S E T S H E T V E G S G E A T F E N I K P G D Y T L R E E T A P I G  sag649_coh1.pep
51  T P L G K A T F V L K N D N D K S E T S H E T V E G S G E A T F E N I K P G D Y T L R E E T A P I G  sag649_cjb111.pep
51  T P L G K A T F V L K N D N D K S E T S H E T V E G S G E A T F E N I K P G D Y T L R E E T A P I G  sag649_18rs21.pep
51  T P L G K A T F V L K N D N D K S E T S H E T V E G S G E A T F E N I K P G D Y T L R E E T A P I G  sag649_nem316.pep
51  T P L G K A T F V L K N D N D K S E T S H E T V E G S G E A T F E N I K P G D Y T L R E E T A P I G  sag649_cjb111.pep

    Y K K T D K T W K V K V A D N G A T I I E G M D A D K A E K R K E V L N A Q Y P K S A I Y E D T K E  Majority
                     110                 120                 130                 140                 150
101 Y K K T D K T W K V K V A D N G A T I I E G M D A D K A E K R K E V L N A Q Y P K S A I Y E D T K E  sag649_2603.pep
101 Y K K T D K T W K V K V A D N G A T I I E G M D A D K A E K R K E V L N A Q Y P K S A I Y E D T K E  sag649_coh1.pep
101 Y K K T D K T W K V K V A D N G A T I I E G M D A D K A E K R K E V L N A Q Y P K S A I Y E D T K E  sag649_cjb111.pep
101 Y K K T D K T W K V K V A D N G A T I I E G M D A D K A E K R K E V L N A Q Y P K S A I Y E D T K E  sag649_18rs21.pep
101 Y K K T D K T W K V K V A D N G A T I I E G M D A D K A E K R K E V L N A Q Y P K S A I Y E D T K E  sag649_nem316.pep
101 Y K K T D K T W K V K V A D N G A T I I E G M D A D K A E K R K E V L N A Q Y P K S A I Y E D T K E  sag649_cjb111.pep

    N Y P L V N V E G S K V G E Q Y K A L N P I N G K D G R R E I A E G W L S K K I T G V N D L D K N K  Majority
                     160                 170                 180                 190                 200
151 N Y P L V N V E G S K V G E Q Y K A L N P I N G K D G R R E I A E G W L S K K I T G V N D L D K N K  sag649_2603.pep
151 N Y P L V N V E G S K V G E Q Y K A L N P I N G K D G R R E I A E G W L S K K N T G V N D L D K N K  sag649_coh1.pep
151 N Y P L V N V E G S K V G E Q Y K A L N P I N G K D G R R E I A E G W L S K K I T G V N D L D K N K  sag649_cjb111.pep
151 N Y P L V N V E G S K V G E Q Y K A L N P I N G K D G R R E I A E G W L S K K I T G V N D L D K N K  sag649_18rs21.pep
151 N Y P L V N V E G S K V G E Q Y K A L N P I N G K D G R R E I A E G W L S K K I T G V N D L D K N K  sag649_nem316.pep
151 N Y P L V N V E G S K V G E Q Y K A L N P I N G K D G R R E I A E G W L S K K I T G V N D L D K N K  sag649_cjb111.pep

    Y K I E L T V E G K T T V E T K E L N Q P L D V V V L L D N S N S M N N E R A N N S Q R A L K A G E  Majority
                     210                 220                 230                 240                 250
201 Y K I E L T V E G K T T V E T K E L N Q P L D V V V L L D N S N S M N N E R A N N S Q R A L K A G E  sag649_2603.pep
201 Y K I E L T V E G K T T V E T K E L N Q P L D V V V L L D N S N S M N N E R A N N S Q R A L K A G E  sag649_coh1.pep
201 Y K I E L T V E G K T T V E T K E L N Q P L D V V V L L D N S N S M N N E R A N N S Q R A L K A G E  sag649_cjb111.pep
201 Y K I E L T V E G K T T V E T K E L N Q P L D V V V L L D N S N S M N N E R A N N S Q R A L K A G E  sag649_18rs21.pep
201 Y K I E L T V E G K T T V E T K E L N Q P L D V V V L L D N S N S M N N E R A N N S Q R A L K A G E  sag649_nem316.pep
201 Y K I E L T V E G K T T V E T K E L N Q P L D V V V L L D N S N S M N N E R A N N S Q R A L K A G E  sag649_cjb111.pep

    A V E K L I D K I T S N K D N R V A L V T Y A S T I F D G T E A T V S K G V A D Q N G K A L N D S V  Majority
                     260                 270                 280                 290                 300
251 A V E K L I D K I T S N K D N R V A L V T Y A S T I F D G T E A T V S K G V A D Q N G K A L N D S V  sag649_2603.pep
251 A V E K L I D K I T S N K D N R V A L V T Y A S T I F D G T E A T V S K G V A D Q N G K A L N D S V  sag649_coh1.pep
251 A V E K L I D K I T S N K D N R V A L V T Y A S T I F D G T E A T V S K G V A D Q N G K A L N D S V  sag649_cjb111.pep
251 A V E K L I D K I T S N K D N R V A L V T Y A S T I F D G T E A T V S K G V A D Q N G K A L N D S V  sag649_18rs21.pep
251 A V E K L I D K I T S N K D N R V A L V T Y A S T I F D G T E A T V S K G V A D Q N G K A L N D S V  sag649_nem316.pep
251 A V E K L I D K I T S N K D N R V A L V T Y A S T I F D G T E A T V S K G V A D Q N G K A L N D S V  sag649_cjb111.pep

    S W D Y H K T T F T A T T H N Y S Y L N L T N D A N E V N I L K S R I P K E A E H I N G D R T L Y Q  Majority
                     310                 320                 330                 340                 350
301 S W D Y H K T T F T A T T H N Y S Y L N L T N D A N E V N I L K S R I P K E A E H I N G D R T L Y Q  sag649_2603.pep
301 S W D Y H K T T F T A T T H N Y S Y L N L T N D A N E V N I L K S R I P K E A E H I N G D R T L Y Q  sag649_coh1.pep
301 S W D Y H K T T F T A T T H N Y S Y L N L T N D A N E V N I L K S R I P K E A E H I N G D R T L Y Q  sag649_cjb111.pep
301 S W D Y H K T T F T A T T H N Y S Y L N L T N D A N E V N I L K S R I P K E A E H I N G D R T L Y Q  sag649_18rs21.pep
301 S W D Y H K T T F T A T T H N Y S Y L N L T N D A N E V N I L K S R I P K E A E H I N G D R T L Y Q  sag649_nem316.pep
301 S W D Y H K T T F T A T T H N Y S Y L N L T N D A N E V N I L K S R I P K E A E H I N G D R T L Y Q  sag649_cjb111.pep

    F G A T F T Q K A L M K A N E I L E T Q S S N A R K K L I F H V T D G V P T M S Y A I N F N P Y I S  Majority
                     360                 370                 380                 390                 400
351 F G A T F T Q K A L M K A N E I L E T Q S S N A R K K L I F H V T D G V P T M S Y A I N F N P Y I S  sag649_2603.pep
351 F G A T F T Q K A L M K A N E I L E T Q S S N A R K K L I F H V T D G V P T M S Y A I N F N P Y I S  sag649_coh1.pep
351 F G A T F T Q K A L M K A N E I L E T Q S S N A R K K L I F H V T D G V P T M S Y A I N F N P Y I S  sag649_cjb111.pep
351 F G A T F T Q K A L M K A N E I L E T Q S S N A R K K L I F H V T D G V P T M S Y A I N F N P Y I S  sag649_18rs21.pep
351 F G A T F T Q K A L M K A N E I L E T Q S S N A R K K L I F H V T D G V P T M S Y A I N F N P Y I S  sag649_nem316.pep
351 F G A T F T Q K A L M K A N E I L E T Q S S N A R K K L I F H V T D G V P T M S Y A I N F N P Y I S  sag649_cjb111.pep
```

FIGURE 23B

Alignment Report of gbs104_align, using Clustal method with PAM250 residue weight table.
Thursday, July 29, 2004 7:05 PM

```
    T S Y Q N Q F N S F L N K I P D R S G I L Q E D F I I N G D D Y Q I V K G D G E S F K L F S D R K V Majority
                      410                 420                 430                 440                 450
401 T S Y Q N Q F N S F L N K I P D R S G I L Q E D F I I N G D D Y Q I V K G D G E S F K L F S D R K V sag649_2603.pep
401 T S Y Q N Q F N S F L N K I P D R S G I L Q E D F I I N G D D Y Q I V K G D G E S F K L F S D R K V sag649_coh1.pep
401 T S Y Q N Q F N S F L N K I P D R S G I L Q E D F I I N G D D Y Q I V K G D G E S F K L F S D R K V sag649_cjb111.pep
401 T S Y Q N Q F N S F L N K I P D R S G I L Q E D F I I N G D D Y Q I V K G D G E S F K L F S D R K V sag649_18rs21.pep
401 T S Y Q N Q F N S F L N K I P D R S G I L Q E D F I I N G D D Y Q I V K G D G E S F K L F S D R K V sag649_nem316.pep
401 T S Y Q N Q F N S F L N K I P D R S G I L Q E D F I I N G D D Y Q I V K G D G E S F K L F S D R K V sag649_cjb111.pep

    P V T G G T T Q A A Y R V P Q N Q L S V M S N E G Y A I N S G Y I Y L Y W R D Y N W V Y P F D P K T Majority
                      460                 470                 480                 490                 500
451 P V T G G T T Q A A Y R V P Q N Q L S V M S N E G Y A I N S G Y I Y L Y W R D Y N W V Y P F D P K T sag649_2603.pep
451 P V T G G T T Q A A Y R V P Q N Q L S V M S N E G Y A I N S G Y I Y L Y W R D Y N W V Y P F D P K T sag649_coh1.pep
451 P V T G G T T Q A A Y R V P Q N Q L S V M S N E G Y A I N S G Y I Y L Y W R D Y N W V Y P F D P K T sag649_cjb111.pep
451 P V T G G T T Q A A Y R V P Q N Q L S V M S N E G Y A I N S G Y I Y L Y W R D Y N W V Y P F D P K T sag649_18rs21.pep
451 P V T G G T T Q A A Y R V P Q N Q L S V M S N E G Y A I N S G Y I Y L Y W R D Y N W V Y P F D P K T sag649_nem316.pep
451 P V T G G T T Q A A Y R V P Q N Q L S V M S N E G Y A I N S G Y I Y L Y W R D Y N W V Y P F D P K T sag649_cjb111.pep

    K K V S A T K Q I K T H G E P T T L Y F N G N I R P K G Y D I F T V G I G V N G D P G A T P L E A E Majority
                      510                 520                 530                 540                 550
501 K K V S A T K Q I K T H G E P T T L Y F N G N I R P K G Y D I F T V G I G V N G D P G A T P L E A E sag649_2603.pep
501 K K V S A T K Q I K T H G E P T T L Y F N G N I R P K G Y D I F T V G I G V N G D P G A T P L E A E sag649_coh1.pep
501 K K V S A T K Q I K T H G E P T T L Y F N G N I R P K G Y D I F T V G I G V N G D P G A T P L E A E sag649_cjb111.pep
501 K K V S A T K Q I K T H G E P T T L Y F N G N I R P K G Y D I F T V G I G V N G D P G A T P L E A E sag649_18rs21.pep
501 K K V S A T K Q I K T H G E P T T L Y F N G N I R P K G Y D I F T V G I G V N G D P G A T P L E A E sag649_nem316.pep
501 K K V S A T K Q I K T H G E P T T L Y F N G N I R P K G Y D I F T V G I G V N G D P G A T P L E A E sag649_cjb111.pep

    K F M Q S I S S K T E N Y T N V D D T N K I Y D E L N K Y F K T I V E E K H S I V D G N V T D P M G Majority
                      560                 570                 580                 590                 600
551 K F M Q S I S S K T E N Y T N V D D T N K I Y D E L N K Y F K T I V E E K H S I V D G N V T D P M G sag649_2603.pep
551 K F M Q S I S S K T E N Y T N V D D T N K I Y D E L N K Y F K T I V E E K H S I V D G N V T D P M G sag649_coh1.pep
551 K F M Q S I S S K T E N Y T N V D D T N K I Y D E L N K Y F K T I V E E K H S I V D G N V T D P M G sag649_cjb111.pep
551 K F M Q S I S S K T E N Y T N V D D T N K I Y D E L N K Y F K T I V E E K H S I V D G N V T D P M G sag649_18rs21.pep
551 K F M Q S I S S K T E N Y T N V D D T N K I Y D E L N K Y F K T I V E E K H S I V D G N V T D P M G sag649_nem316.pep
551 K F M Q S I S S K T E N Y T N V D D T N K I Y D E L N K Y F K T I V E E K H S I V D G N V T D P M G sag649_cjb111.pep

    E M I E F Q L K N G Q S F T H D D Y V L V G N D G S Q L K N G V A L G G P N S D G G I L K D V T V T Majority
                      610                 620                 630                 640                 650
601 E M I E F Q L K N G Q S F T H D D Y V L V G N D G S Q L K N G V A L G G P N S D G G I L K D V T V T sag649_2603.pep
601 E M I E F Q L K N G Q S F T H D D Y V L V G N D G S Q L K N G V A L G G P N S D G G I L K D V T V T sag649_coh1.pep
601 E M I E F Q L K N G Q S F T H D D Y V L V G N D G S Q L K N G V A L G G P N S D G G I L K D V T V T sag649_cjb111.pep
601 E M I E F Q L K N G Q S F T H D D Y V L V G N D G S Q L K N G V A L G G P N S D G G I L K D V T V T sag649_18rs21.pep
601 E M I E F Q L K N G Q S F T H D D Y V L V G N D G S Q L K N G V A L G G P N S D G G I L K D V T V T sag649_nem316.pep
601 E M I E F Q L K N G Q S F T H D D Y V L V G N D G S Q L K N G V A L G G P N S D G G I L K D V T V T sag649_cjb111.pep

    Y D K T S Q T I K I N H L N L G S G Q K V V L T Y D V R L K D N Y I S N K F Y N T N N R T T L S P K Majority
                      660                 670                 680                 690                 700
651 Y D K T S Q T I K I N H L N L G S G Q K V V L T Y D V R L K D N Y I S N K F Y N T N N R T T L S P K sag649_2603.pep
651 Y D K T S Q T I K I N H L N L G S G Q K V V L T Y D V R L K D N Y I S N K F Y N T N N R T T L S P K sag649_coh1.pep
651 Y D K T S Q T I K I N H L N L G S G Q K V V L T Y D V R L K D N Y I S N K F Y N T N N R T T L S P K sag649_cjb111.pep
651 Y D K T S Q T I K I N H L N L G S G Q K V V L T Y D V R L K D N Y I S N K F Y N T N N R T T L S P K sag649_18rs21.pep
651 Y D K T S Q T I K I N H L N L G S G Q K V V L T Y D V R L K D N Y I S N K F Y N T N N R T T L S P K sag649_nem316.pep
651 Y D K T S Q T I K I N H L N L G S G Q K V V L T Y D V R L K D N Y I S N K F Y N T N N R T T L S P K sag649_cjb111.pep

    S E K E P N T I R D F P I P K I R D V R E F P V L T I S N Q K K M G E V E F I K V N K D K H S E S L Majority
                      710                 720                 730                 740                 750
701 S E K E P N T I R D F P I P K I R D V R E F P V L T I S N Q K K M G E V E F I K V N K D K H S E S L sag649_2603.pep
701 S E K E P N T I R D F P I P K I R D V R E F P V L T I S N Q K K M G E V E F I K V N K D K H S E S L sag649_coh1.pep
701 S E K E P N T I R D F P I P K I R D V R E F P V L T I S N Q K K M G E V E F I K V N K D K H S E S L sag649_cjb111.pep
701 S E K E P N T I R D F P I P K I R D V R E F P V L T I S N Q K K M G E V E F I K V N K D K H S E S L sag649_18rs21.pep
701 S E K E P N T I R D F P I P K I R D V R E F P V L T I S N Q K K M G E V E F I K V N K D K H S E S L sag649_nem316.pep
701 S E K E P N T I R D F P I P K I R D V R E F P V L T I S N Q K K M G E V E F I K V N K D K H S E S L sag649_cjb111.pep

    L G A K F Q L Q I E K D F S G Y K Q F V P E G S D V T T K N D G K I Y F K A L Q D G N Y K L Y E I S Majority
                      760                 770                 780                 790                 800
751 L G A K F Q L Q I E K D F S G Y K Q F V P E G S D V T T K N D G K I Y F K A L Q D G N Y K L Y E I S sag649_2603.pep
751 L G A K F Q L Q I E K D F S G Y K Q F V P E G S D V T T K N D G K I Y F K A L Q D G N Y K L Y E I S sag649_coh1.pep
751 L G A K F Q L Q I E K D F S G Y K Q F V P E G S D V T T K N D G K I Y F K A L Q D G N Y K L Y E I S sag649_cjb111.pep
751 L G A K F Q L Q I E K D F S G Y K Q F V P E G S D V T T K N D G K I Y F K A L Q D G N Y K L Y E I S sag649_18rs21.pep
751 L G A K F Q L Q I E K D F S G Y K Q F V P E G S D V T T K N D G K I Y F K A L Q D G N Y K L Y E I S sag649_nem316.pep
751 L G A K F Q L Q I E K D F S G Y K Q F V P E G S D V T T K N D G K I Y F K A L Q D G N Y K L Y E I S sag649_cjb111.pep
```

FIGURE 23C

Alignment Report of gbs104_align, using Clustal method with PAM250 residue weight table.
Thursday, July 29, 2004 7:05 PM

```
    S P D G Y I E V K T K P V V T F T I Q N G E V T N L K A D P N A N K N Q I G Y L E G N G K H L I T N  Majority
                      810                 820                 830                 840                 850
801 S P D G Y I E V K T K P V V T F T I Q N G E V T N L K A D P N A N K N Q I G Y L E G N G K H L I T N  sag649_2603.pep
801 S P D G Y I E V K T K P V V T F T I Q N G E V T N L K A D P N A N K N Q I G Y L E G N G K H L I T N  sag649_coh1.pep
801 S P D G Y I E V K T K P V V T F T I Q N G E V T N L K A D P N A N K N Q I G Y L E G N G K H L I T N  sag649_cjb111.pep
801 S P D G Y I E V K T K P V V T F T I Q N G E V T N L K A D P N A N K N Q I G Y L E G N G K H L I T N  sag649_18rs21.pep
801 S P D G Y I E V K T K P V V T F T I Q N G E V T N L K A D P N A N K N Q I G Y L E G N G K H L I T N  sag649_nem316.pep
801 S P D G Y I E V K T K P V V T F T I Q N G E V T N L K A D P N A N K N Q I G Y L E G N G K H L I T N  sag649_cjb111.pep

    T P K R P P G V F P K T G G I G T I V Y I L V G S T F M I L T I C S F R R K Q L                      Majority
                      860                 870                 880                 890
851 T P K R P P G V F P K T G G I G T I V Y I L V G S T F M I L T I C S F R R K Q L                      sag649_2603.pep
851 T P K R P P G V F P K T G G I G T I V Y I L V G S T F M I L T I C S F R R K Q L                      sag649_coh1.pep
851 T P K R P P G V F P K T G G I G T I V Y I L V G S T F M I L T I C S F R R K Q L                      sag649_cjb111.pep
851 T P K R P P G V F P K T G G I G T I V Y I L V G S T F M I L T I C S F R R K Q L                      sag649_18rs21.pep
851 T P K R P P G V F P K T G G I G T I V Y I L V G S T F M I L T I C S F R R K Q L                      sag649_nem316.pep
851 T P K R P P G V F P K T G G I G T I V Y I L V G S T F M I L T I C S F R R K Q L                      sag649_cjb111.pep
```

Decoration 'Decoration #1': Shade (with solid black) residues that differ from the Consensus.

FIGURE 24A

Alignment Report of gbs67_align.pdf, using Clustal method with PAM250 residue weight table.
Thursday, July 29, 2004 7:08 PM

```
    M R K Y Q K F S K I L T L S L F C L S Q I P L N T N V L G E S T V P E N G A K G K L V V K K T D D Q Majority
                    10                  20                  30                  40                  50
1   M R K Y Q K F S K I L T L S L F C L S Q I P L N T N V L G E S T V P E N G A K G K L V V K K T D D Q sag1408_2603.pep
1   M R K Y Q K F S K I L T L S L F C L S Q I P L N T N V L G E S T V P E N G A K G K L V V K K T D D Q sag1408_515.pep
1   M R K Y Q K F S K I L T L S L F C L S Q I P L N T N V L G E S T V P E N G A K G K L V V K K T D D Q sag1408_18rs21.seq
1   M R K Y Q K F S K I L T L S L F C L S Q I P L N T N V L G E S T V P E N G A K G K L V V K K T D D Q sag1408_cjb111.pep
1   M R K Y Q K F S K I L T L S L F C L S Q I P L N T N V L G E S T V P E N G A K G K L V V K K T D D Q sag1408_h36b.pep
1   M R K Y Q K F S K I L T L S L F C L S Q I P L N T N V L G E S T V P E N G A K G K L V V K K T D D Q sag1408_nem316.pep

    N K P L S K A T F V L K T T A H P E S K I E K V T A E L T G E A T F D N L I P G D Y T L S E E T A P Majority
                    60                  70                  80                  90                  100
51  N K P L S K A T F V L K T T A H P E S K I E K V T A E L T G E A T F D N L I P G D Y T L S E E T A P sag1408_2603.pep
51  N K P L S K A T F V L K T T A H P E S K I E K V T A E L T G E A T F D N L I P G D Y T L S E E T A P sag1408_515.pep
51  N K P L S K A T F V L K T T A H P E S K I E K V T A E L T G E A T F D N L I P G D Y T L S E E T A P sag1408_18rs21.seq
51  N K P L S K A T F V L K T T A H P E S K I E K V T A E L T G E A T F D N L I P G D Y T L S E E T A P sag1408_cjb111.pep
51  N K P L S K A T F V L K P T S H S E S K V E K V T T E V T G E A T F D N L T P G D Y T L S E E T A P sag1408_h36b.pep
51  N K P L S K A T F V L K T T A H P E S K I E K V T A E L T G E A T F D N L I P G D Y T L S E E T A P sag1408_nem316.pep

    E G Y K K T N Q T W Q V K V E S N G K T T I Q N S G D K N S T I G Q N Q E E L D K Q Y P P T G I Y E Majority
                    110                 120                 130                 140                 150
101 E G Y K K T N Q T W Q V K V E S N G K T T I Q N S G D K N S T I G Q N Q E E L D K Q Y P P T G I Y E sag1408_2603.pep
101 E G Y K K T N Q T W Q V K V E S N G K T T I Q N S G D K N S T I G Q N Q E E L D K Q Y P P T G I Y E sag1408_515.pep
101 E G Y K K T N Q T W Q V K V E S N G K T T I Q N S G D K N S T I G Q N Q E E L D K Q Y P P T G I Y E sag1408_18rs21.seq
101 E G Y K K T N Q T W Q V K V E S N G K T T I Q N S G D K N S T I G Q N Q E E L D K Q Y P P T G I Y E sag1408_cjb111.pep
101 E G Y K K T T Q T W Q V K V E S N G K T T I Q N S E D K K S I I E Q R Q E E L D K Q Y P L T G A Y E sag1408_h36b.pep
101 E G Y K K T N Q T W Q V K V E S N G K T T I Q N S G D K N S T I G Q N H E E L D K Q Y P P T G I Y E sag1408_nem316.pep

    D T K E S Y K L E H V K G S V P N G K S E A K A V N P Y S S E G E H I R E I P E G T L S K R I S E V Majority
                    160                 170                 180                 190                 200
151 D T K E S Y K L E H V K G S V P N G K S E A K A V N P Y S S E G E H I R E I P E G T L S K R I S E V sag1408_2603.pep
151 D T K E S Y K L E H V K G S V P N G K S E A K A V N P Y S S E G E H I R E I P E G T L S K R I S E V sag1408_515.pep
151 D T K E S Y K L E H V K G S V P N G K S E A K A V N P Y S S E G E H I R E I P E G T L S K R I S E V sag1408_18rs21.seq
151 D T K E S Y K L E H V K G S V P N G K S E A K A V N P Y S S E G E H I R E I P E G T L S K R I S E V sag1408_cjb111.pep
151 D T K E S Y N L E H V K N S I P N G K L E A K A V N P Y S S E G E H I R E I Q E G T L S K R I S E V sag1408_h36b.pep
151 D T K E S Y K L E H V K G S V P N G K S E A K A V N P Y S S E G E H I R E I P E G T L S K R I S E V sag1408_nem316.pep

    G D L A H N K Y K I E L T V S G K T I V K P V D K Q K P L D V V F V L D N S N S M N N D G P N F Q R Majority
                    210                 220                 230                 240                 250
201 G D L A H N K Y K I E L T V S G K T I V K P V D K Q K P L D V V F V L D N S N S M N N D G P N F Q R sag1408_2603.pep
201 G D L A H N K Y K I E L T V S G K T I V K P V D K Q K P L D V V F V L D N S N S M N N D G P N F Q R sag1408_515.pep
201 G D L A H N K Y K I E L T V S G K T I V K P V D K Q K P L D V V F V L D N S N S M N N D G P N F Q R sag1408_18rs21.seq
201 G D L A H N K Y K I E L T V S G K T I V K P V D K Q K P L D V V F V L D N S N S M N N D G P N F Q R sag1408_cjb111.pep
201 N D L D H N K Y K I E L T V S G K S I I K T I N K D E P L D V V F V L D N S N S M K N N G - - - - K sag1408_h36b.pep
201 G D L A H N K Y K I E L T V S G K T I V K P V D K Q K P L D V V F V L D N S N S M N N D G P N F Q R sag1408_nem316.pep

    H N K A K K A A E A L G T A V K D I L G A N S D N R V A L V T Y G S D I F D G R S V D V V K G F K E Majority
                    260                 270                 280                 290                 300
251 H N K A K K A A E A L G T A V K D I L G A N S D N R V A L V T Y G S D I F D G R S V D V V K G F K E sag1408_2603.pep
251 H N K A K K A A E A L G T A V K D I L G A N S D N R V A L V T Y G S D I F D G R S V D V V K G F K E sag1408_515.pep
251 H N K A K K A A E A L G T A V K D I L G A N S D N R V A L V T Y G S D I F D G R S V D V V K G F K E sag1408_18rs21.seq
251 H N K A K K A A E A L G T A V K D I L G A N S D N R V A L V T Y G S D I F D G R S V D V V K G F K E sag1408_cjb111.pep
247 N N K A K K A G E A V E T I I K D V L G A N V E N R A A L V T Y G S D I F D G R T V K V I K G F K E sag1408_h36b.pep
251 H N K A K K A A E A L G T A V K D I L G A N S D N R V A L V T Y G S D I F D G R S V D V V K G F K E sag1408_nem316.pep

    D D K Y Y G L Q T K F T I Q T E N Y S H K Q L T N N A E E I I K R I P T E A P K A K W G S T T N G L Majority
                    310                 320                 330                 340                 350
301 D D K Y Y G L Q T K F T I Q T E N Y S H K Q L T N N A E E I I K R I P T E A P K A K W G S T T N G L sag1408_2603.pep
301 D D K Y Y G L Q T K F T I Q T E N Y S H K Q L T N N A E E I I K R I P T E A P K A K W G S T T N G L sag1408_515.pep
301 D D K Y Y G L Q T K F T I Q T E N Y S H K Q L T N N A E E I I K R I P T E A P K A K W G S T T Y G L sag1408_18rs21.seq
301 D D K Y Y G L Q T K F T I Q T E N Y S H K Q L T N N A E E I I K R I P T E A P K A K W G S T T N G L sag1408_cjb111.pep
297 D P - Y Y G L E T S F T V Q T N D Y S Y K K F T N I A A D I I K K I P K E A P E A K W G G T S L G L sag1408_h36b.pep
301 D D K Y Y G L Q T K F T I Q T E N Y S H K Q L T N N A E E I I K R I P T E A P R A K W G S T T N G L sag1408_nem316.pep

    T P E Q Q K E Y Y L S K V G E T F T M K A F M E A D D I L S Q V N R N S Q K I I V H V T D G V P T R Majority
                    360                 370                 380                 390                 400
351 T P E Q Q K E Y Y L S K V G E T F T M K A F M E A D D I L S Q V N R N S Q K I I V H V T D G V P T R sag1408_2603.pep
351 T P E Q Q K E Y Y L S K V G E T F T M K A F M E A D D I L S Q V N R N S Q K I I V H V T D G V P T R sag1408_515.pep
351 T P E Q Q K E Y Y L S K V G E T F T M K A F M E A D D I L S Q V N R N S Q K I I V H V T D G V P T R sag1408_18rs21.seq
351 T P E Q Q K E Y Y L S K V G E T F T M K A F M E A D D I L S Q V N R N S Q K I I V H V T D G V P T R sag1408_cjb111.pep
346 T P E K K R E Y D L S K V G E T F T M K A F M E A D T L L S S I Q R K S R K I I V H I T D G V P T R sag1408_h36b.pep
351 T P E Q Q K Q Y Y L S K V G E T F T M K A F M E A D D I L S Q V D R N S Q K I I V H I T D G V P T R sag1408_nem316.pep
```

FIGURE 24B

Alignment Report of gbs67_align.pdf, using Clustal method with PAM250 residue weight table.
Thursday, July 29, 2004 7:08 PM

```
    S Y A I N N F K L G A S Y E S Q F E Q M K K N G Y L N K S N F L L T D K P E D I K G N G E S Y F L F Majority
                      410                 420                 430                 440                 450
401 S Y A I N N F K L G A S Y E S Q F E Q M K K N G Y L N K S N F L L T D K P E D I K G N G E S Y F L F sag1408_2603.pep
401 S Y A I N N F K L G A S Y E S Q F E Q M K K N G Y L N K S N F L L T D K P D D I K G N G E S Y F L F sag1408_515.pep
401 S Y A I N N F K L G A S Y E S Q F E Q M K K N G Y L N K S N F L L T D K P E D I K G N G E S Y F L F sag1408_18rs21.seq
401 S Y A I N N F K L G A S Y E S Q F E Q M K K N G Y L N K S N F L L T D K P E D I K G N G E S Y F L F sag1408_cjb111.pep
396 S Y A I N S F V K G S T Y A N Q F E R I K E K G Y L D K N N Y F I T D D P E K I K G N G E S Y F L F sag1408_h36b.pep
401 S Y A I N N F K L G A S Y E S Q F E Q M K K N G Y L N K S N F L L T D K P E D I K G N G E S Y F L F sag1408_nem316.pep

    P L D S Y Q T Q I I S G N L Q K L H Y L D L N L N Y P K G T I Y R N G P V K E H G T P T K L Y I N S Majority
                      460                 470                 480                 490                 500
451 P L D S Y Q T Q I I S G N L Q K L H Y L D L N L N Y P K G T I Y R N G P V K E H G T P T K L Y I N S sag1408_2603.pep
451 P L D S Y Q T Q I I S G N L Q K L H Y L D L N L N Y P K G T I Y R N G P V K E H G T P T K L Y I N S sag1408_515.pep
451 P L D S Y Q T Q I I S G N L Q K L H Y L D L N L N Y P K G T I Y R N G P V K E H G T P T K L Y I N S sag1408_18rs21.seq
451 P L D S Y Q T Q I I S G N L Q K L H Y L D L N L N Y P K G T I Y R N G P V R E H G T P T K L Y I N S sag1408_cjb111.pep
446 P L D S Y Q T Q I I S G N L Q K L H Y L D L N L N Y P K G T I Y R N G P V R E H G T P T K L Y I N S sag1408_h36b.pep
451 P L D S Y Q T Q I I S G N L Q K L H Y L D L N L N Y P K G T I Y R N G P V R E H G T P T K L Y I N S sag1408_nem316.pep

    L K Q K N Y D I F N F G I D I S G F R Q V Y N E D Y K K N Q D G T F Q K L K E E A F E L S D G E I T Majority
                      510                 520                 530                 540                 550
501 L K Q K N Y D I F N F G I D I S G F R Q V Y N E E Y K K N Q D G T F Q K L K E E A F K L S D G E I T sag1408_2603.pep
501 L K Q K N Y D I F N F G I D I S G F R Q V Y N E E Y K K N Q D G T F Q K L K E E A F K L S D G E I T sag1408_515.pep
501 L K Q K N Y D I F N F G I D I S G F R Q V Y N E E Y K K N Q D G T F Q K L K E E A F K L S D G E I T sag1408_18rs21.seq
501 L K Q K N Y D I F N F G I D I S G F R Q V Y N E D Y K K N Q D G T F Q K L K E E A F E L S D G E I T sag1408_cjb111.pep
496 L K Q K N Y D I F N F G I D I S G F R Q V Y N E D Y K K N Q D G T F Q K L K E E A F E L S D G E I T sag1408_h36b.pep
501 L K Q K N Y D I F N F G I D I S A F R Q V Y N E D Y K K N Q D G T F Q K L K E E A F E L S D G E I T sag1408_nem316.pep

    E L M R S F S S K P E Y Y T P I V T S A D T S N N E I L S K I Q Q Q F E T I L T K E N S I V N G T I Majority
                      560                 570                 580                 590                 600
551 E L M R S F S S K P E Y Y T P I V T S A D T S N N E I L S K I Q Q Q F E T I L T K E N S I V N G T I sag1408_2603.pep
551 E L M R S F S S K P E Y Y T P I V T S A D T S N N E I L S K I Q Q Q F E T I L T K E N S I V N G T I sag1408_515.pep
551 E L M R S F S S K P E Y Y T P I V T S A D T S N N E I L S K I Q Q Q F E T I L T K E N S I V N G T I sag1408_18rs21.seq
551 E L M K S F S S K P E Y Y T P I V T S S D A S N N E I L S K I Q Q Q F E K I L T K E N S I V N G T I sag1408_cjb111.pep
546 E L M N S F S S K P E Y Y T P I V T S A D V S N N E I L S K I Q Q Q F E K I L T K E N S I V N G T I sag1408_h36b.pep
551 E L M K S F S S K P E Y Y T P I V T S S D A S N N E I L S K I Q Q Q F E K V L T K E N S I V N G T I sag1408_nem316.pep

    E D P M G D K I N L Q L G N G Q T L Q P S D Y T L Q G N D G S V M K D G I A T G G P N N D G G I L K Majority
                      610                 620                 630                 640                 650
601 E D P M G D K I N L Q L G N G Q T L Q P S D Y T L Q G N D G S V M K D G I A T G G P N N D G G I L K sag1408_2603.pep
601 E D P M G D K I N L Q L G N G Q I L Q P S D Y T L Q G N D G S V M K D G I A T G G P N N D G G I L K sag1408_515.pep
601 E D P M G D K I N L Q L G N G Q T L Q P S D Y T L Q G N D G S V M K D G I A T G G P N N D G G I L K sag1408_18rs21.seq
601 E D P M G D K I N L Q L G N G Q T L Q P S D Y T L Q G N D G S I M K D S I A T G G P N N D G G I L K sag1408_cjb111.pep
596 E D P M G D K I N L H L G N G Q T L Q P S D Y T L Q G N D G S I M K D S I A T G G P N N D G G I L K sag1408_h36b.pep
601 E D P M G D K I N L Q L G N G Q T L Q P S D Y T L Q G N D G S I M K D S I A T G G P N N D G G I L K sag1408_nem316.pep

    G V K L E Y I G N K L Y V R G L N L G E G Q K V T L T Y D V K L D D S F I S N K F Y D T N G R T T L Majority
                      660                 670                 680                 690                 700
651 G V K L E Y I G N K L Y V R G L N L G E G Q K V T L T Y D V K L D D S F I S N K F Y D T N G R T T L sag1408_2603.pep
651 G V K L E Y I G N K L Y V R G L N L G E G Q K V T L T Y D V K L D D S F I S N K F Y D T N G R T T L sag1408_515.pep
651 G V K L E Y I G N K L Y V R G L N L G E G Q K V T L T Y D V K L D D S F I S N K F Y D T N G R T T L sag1408_18rs21.seq
651 G V K L E Y I K N K L Y V R G L N L G E G Q K V T L T Y D V K L D D S F I S N K F Y D T N G R T T L sag1408_cjb111.pep
646 G V K L E Y I K N K L Y V R G L N L G E G Q K V T L T Y D V K L D D S F I S N K F Y D T N G R T T L sag1408_h36b.pep
651 G V K L E Y I K N K L Y V R G L N L G E G Q K V T L T Y D V K L D D S F I S N K F Y D T N G R T T L sag1408_nem316.pep

    N P K S E D P N T L R D F P I P K I R D V R E Y P T I T I K N E K K L G E I E F I K V D K D N N K L Majority
                      710                 720                 730                 740                 750
701 N P K S E D P N T L R D F P I P K I R D V R E Y P T I T I K N E K K L G E I E F I K V D K D N N K L sag1408_2603.pep
701 N P K S E D P N T L R D F P I P K I R D V R E Y P T I T I K N E K K L G E I E F I K V D K D N N K L sag1408_515.pep
701 N P K S E D P N T L R D F P I P K I R D V R E Y P T I T I K N E K K L G E I E F I K V D K D N N K L sag1408_18rs21.seq
701 N P K S E D P N T L R D F P I P K I R D V R E Y P T I T I K N E K K L G E I E F T K V D K D N N K L sag1408_cjb111.pep
696 N P K S E E P D T L R D F P I P K I R D V R E Y P T I T I K N E K K L G E I E F T K V D K D N N K L sag1408_h36b.pep
701 N P K S E D P N T L R D F P I P K I R D V R E Y P T I T I K N E K K L G E I E F T K V D K D N N K L sag1408_nem316.pep

    L L K G A T F E L Q E F N E D Y K L Y L P I K N N N S K V V T G E N G K I S Y K D L K D G K Y Q L I Majority
                      760                 770                 780                 790                 800
751 L L K G A T F E L Q E F N E D Y K L Y L P I K N N N S K V V T G E N G K I S Y K D L K D G K Y Q L I sag1408_2603.pep
751 L L K G A T F E L Q E F N E D Y K L Y L P I K N N N S K V V T G E N G K I S Y K D L K D G K Y Q L I sag1408_515.pep
751 L L K G A T F E L Q E F N E D Y K L Y L P I K N N N S K V V T G E N G K I S Y K D L K D G K Y Q L I sag1408_18rs21.seq
751 L L K G A T F E L Q E F N E D Y K L Y L P I K N N N S K V V T G E N G K I S Y K D L K D G K Y Q L I sag1408_cjb111.pep
746 L L K G A T F E L Q E F N E D Y K L Y L P I K N N N S K V V T G E N G K I S Y K D L K D G K Y Q L I sag1408_h36b.pep
751 L L K G A T F E L Q E F N E D Y K L Y L P I K N N N S K V V T G E N G K I S Y K D L K D G K Y Q L I sag1408_nem316.pep
```

FIGURE 24C

Alignment Report of gbs67_align.pdf, using Clustal method with PAM250 residue weight table.
Thursday, July 29, 2004 7:08 PM

```
    E A V S P E D Y Q K I T N K P I L T F E V V K G S I Q N I I A V N K Q I S E Y H E E G D K H L I T N Majority
                        810                 820                 830                 840                 850
801 E A V S P E D Y Q K I T N K P I L T F E V V K G S I K N I I A V N K Q I S E Y H E E G D K H L I T N sag1408_2603.pep
801 E A V S P E D Y Q K I T N K P I L T F E V V K G S I K N I I A V N K Q I S E Y H E E G D K H L I T N sag1408_515.pep
801 E A V S P E D Y Q K I T N K P I L T F E V V K G S I K N I I A V N K Q I S E Y H E E G D K H L I T N sag1408_18rs21.seq
801 E A V S P K D Y Q K I T N K P I L T F E V V K G S I Q N I I A V N K Q I S E Y H E E G D K H L I T N sag1408_cjb111.pep
796 E A V S P K D Y Q K I T N K P I L T F E V V K G S I Q N I I A V N K Q I S E Y H E E G D K H L I T N sag1408_h36b.pep
801 E A V S P K D Y Q K I T N K P I L T F E V V K G S I Q N I I A V N K Q I S E Y H E E G D K H L I T N sag1408_nem316.pep

    T H I P P K G I I P M T G G K G I L S F I L I G G A M M S I A G G I Y I W K R Y K K S S D M S I E K Majority
                        860                 870                 880                 890                 900
851 T H I P P K G I I P M T G G K G I L S F I L I G G A M M S I A G G I Y I W K R Y K K S S D M S I K K sag1408_2603.pep
851 T H I P P K G I I P K T G G K G I L S F I L I G G A M M S I A G G I Y I W K R Y K K S S D M S I K K sag1408_515.pep
851 T H I P P K G I I P M T G G K G I L S F I L I G G A M M S I A G G I Y I W K R Y K K S S D M S I K K sag1408_18rs21.seq
851 T H I P P K G I I P M T G G K G I L S F I L I G G S M M S I A G G I Y I W K R Y K K S S D I S R E K sag1408_cjb111.pep
846 T H I P P K G I I P M T G G K G I L S F I L I G G A M M S I A G G I Y I W K R H K K S S D A S I E K sag1408_h36b.pep
851 T H I P P K G I I P M T G G K G I L S F I L I G G S M M S I A G G I Y I W K R Y K K S S D I S R E K sag1408_nem316.pep

    D                                                                                                 Majority

901 D                                                                                                 sag1408_2603.pep
901 D                                                                                                 sag1408_515.pep
901 D                                                                                                 sag1408_18rs21.seq
901 D                                                                                                 sag1408_cjb111.pep
896 D                                                                                                 sag1408_h36b.pep
901 D                                                                                                 sag1408_nem316.pep
```

Decoration 'Decoration #1': Shade (with solid black) residues that differ from the Consensus.

Figure 25: GBS closely associate with tight junctions and cross the monolayer by a paracellular route
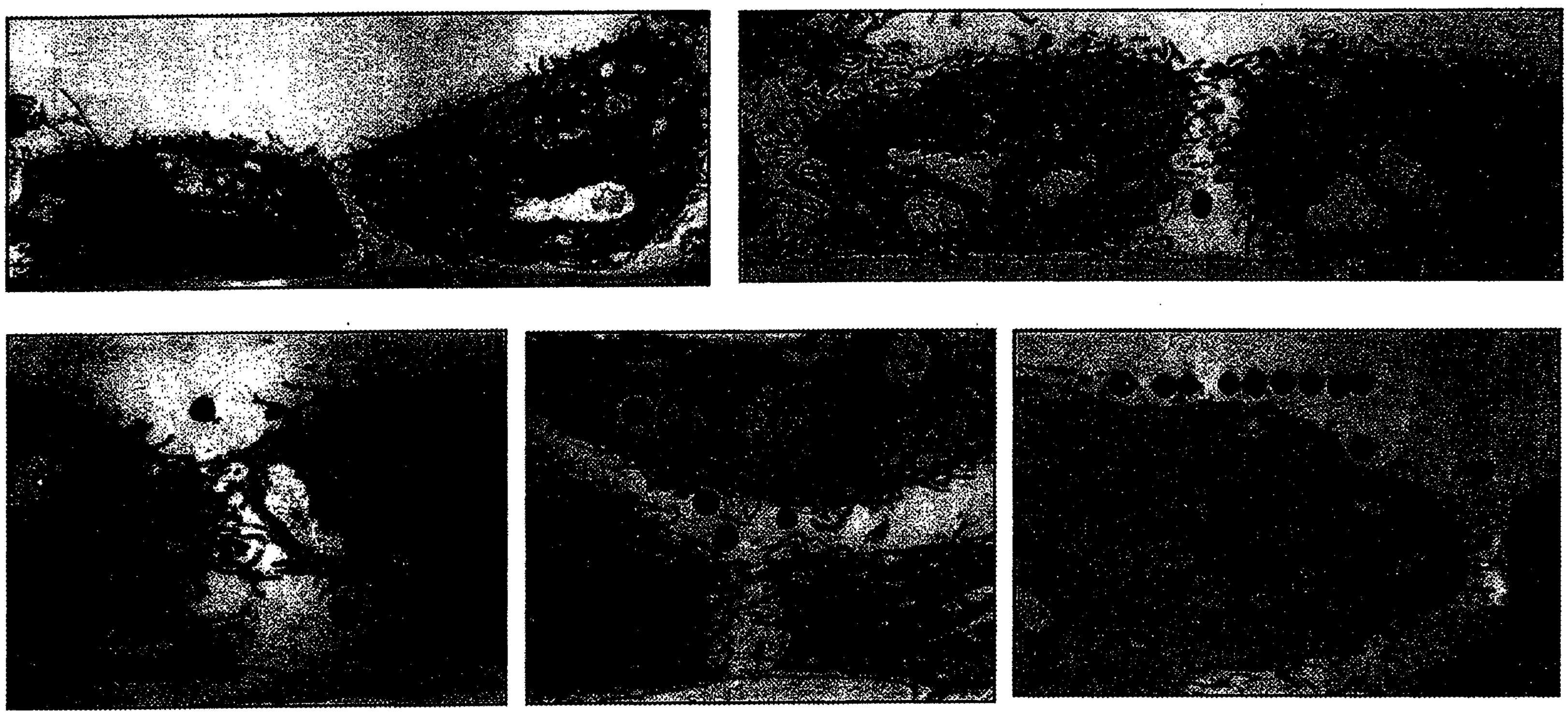
Transmission Electron Microscopy images of GBS infection of ME180 cervical epithelial cells.

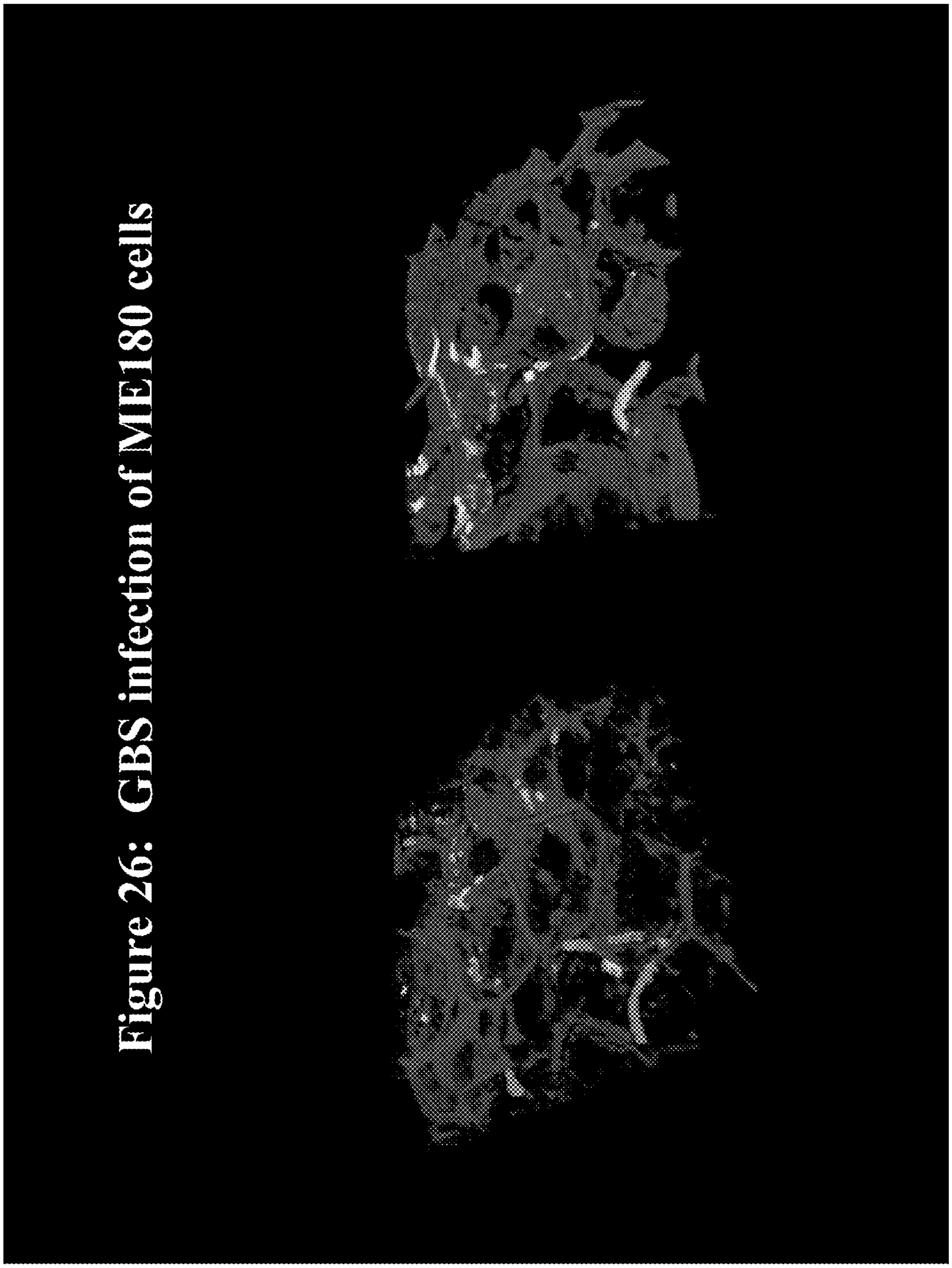
Figure 26: GBS infection of ME180 cells

Figure 34 GBS STRAIN COH1 over GBS80

Negative staining EM

Figure 35 GBS STRAIN COH1 over GBS80

IEM anti-GBS80 (gold particles 10nm)

Figure 36 GBS STRAIN COH1 over GBS80

IEM anti-GBS80 (gold particles 10nm)

Figure 37 GBS STRAIN COH1 over GBS80

IEM anti-GBS80 (gold particles 20nm)

GBS STRAIN COH1 over GBS80

IEM anti-GBS104 (gold particles 10nm)

GBS STRAIN COH1 over GBS80

IEM anti-GBS80 (gold particles 20nm) anti-GBS104 (gold particles 10nm)

**GBS STRAIN *COH1* over *GBS80***

IEM anti-*GBS80* (gold particles 20nm) anti-*GBS104* (gold particles 10nm)

Figure 41: GBS 80 is necessary for polymer formation, GBS104 and sortase SAG0648 are necessary for efficient assembly

Figure 42: Gbs67 is part of a second pilus; Gbs80 is polymerized in strain 515 (515 lacks sortase 647-8, but has AI-2 sortases)

Figure 43: Two macro-molecules are visible in Coh1 at >1000 kDa, one is the Gbs80 pilin Conservative size estimate:

240 kDa + 14 subunits of Gbs80 = ~ 1000 kDa

Figure 45: Gbs52 is a minor component of the GBS pilus

Figure 46: The pilus is found in the supernatant of the bacterial culture

Figure 47: The pilus is found in the supernatant of cultures in all growth phases TCA precipitation of 1 ml of THB culture supernatant run on 3-8% SDS-PAGE. OD600 nm are noted above samples, “f” indicates supernatant was filtered (0.2 μM syringe filter).

Left five samples: Coh1.

Right five samples: 179 (ΔGbs80/pGbs80).

Figure 48: In Coh1, only the gbs80 protein and one sortase (sag0647 *or* sag0648) is required for polymerization

```
GI-19224135    1 MNNKKLQKKQDAPR-VSNRKP-------KQLTVTLVGVFLMFLTLVSSMRGAQSIFGEEK
ORF78          1 -----LQKRDKTNYGSANNKR-------RQTTIGLLKVFLTFVALIG-------IVG---
GI-21909634    1 -----MQKRDKTNYGSANNKR-------RQTTIGLLKVFLTFVALIGIVGFSIRAFG---
GI-28810257    1 -----MQKRDKTNYGSANNKR-------RQTTIGLLKVFLTFVALIGIVGFSIRAFG---
GI-19745301    1 -----MQKRDKTNYGSANNKR-------RQTTIGLLKVFLTFVALIGIVGFSIRAFG---
GAS15          1 LRGEKMKKTRFPNKLNTLNTQRVLSKNSKRFTVTLVGVFLMIFALVTSMVGAKTVFG---

GI-19224135   53 RIEEVSVPKIKSPDD--AYPWYGYDSYDSSHPYYERFKVAHDLRVNLNGSKSYQVYCFNL
ORF78         39 ------------------------------------------------------------
GI-21909634   46 -AEEQSVPNKQSSVQ--DYPWYGYDSYSKGYPDYSPLKTYHNLKVNLDGSKEYQAYCFNL
GI-28810257   46 -AEEQSVPNKQSSVQ--DYPWYGYDSYSKGYPDYSPLKTYHNLKVNLDGSKEYQAYCFNL
GI-19745301   46 -AEEQST-----------------------------------------------------
GAS15         58 -LVESSTPNAINPDSSSEYRWYGYESYVRGHPYYKQFRVAHDLRVNLEGSRSYQVYCFNL

GI-19224135  111 NSHYPNKKNAFSKQWFKRVDGTGEVFTNYAQTPKIRGESLNNKLLSIMYNAYPKNANGYM
ORF78         39 ------------------------------------------------------------
GI-21909634  103 TKHFPSKSDSVRSQWYKKLEGTNENFIKLADKPRIEDGQLQQNILRILYNGYPNDRNGIM
GI-28810257  103 TKHFPSKSDSVRSQWYKKLEGTNENFIKLADKPRIEDGQLQQNILRILYNGYPNDRNGIM
GI-19745301   52 ------------------------------------------------------------
GAS15        117 KKAFPLGSDSSVKKWYKKHDGISTKFEDYAMSPRITGDELNQKLRAVMYNGHPQNANGIM

GI-19224135  171 DKIEPLNAILVTQQAVWYYSDSSYGN-IKTLMASELKDGKEEFEQVKLMREAYSKLISDD
ORF78         39 -------------------FSIRAFG----------------------------------
GI-21909634  163 KGIDPLNAILVTQNAIWYYTDSSYISDTSKAFQQEETLLKLDSQQLQLMRNALKRLINPK
GI-28810257  163 KGIDPLNAILVTQNAIWYYTDSSYISDTSKAFQQEETLLKLDSQQLQLMRNALKRLINPK
GI-19745301   52 ------------------------------------------------------------
GAS15        177 EGLEPLNAIRVTQEAVWYYSDNAPISNPDESFKRESESNLVSTSQLSLMRQALKQLIDPN

GI-19224135  230 LEETSKNKLFQGSKLNIFVPQDKS------VQNLLSAEYVPESPPAPGQSPEPPVQTKKT
ORF78         46 ----------------------------------------------AEEKSTETKKT
GI-21909634  223 EVESLPNQVPANYQLSIFQSSDKT------FQNLLSAEYVPDTPPKPG--EEPPAKTEKT
GI-28810257  223 EVESLPNQVPANYQLSIFQSSDKT------FQNLLSAEYVPDTPPKPG--EEPPAKTEKT
GI-19745301   52 -------------------------------------------------------ETKKT
GAS15        237 LATKMPKQVFDDFQLSIFESEDKGDKYNKGYQNLLSGGLVPTKPPTPGDPPMPPNQPQTT

GI-19224135  284 SVIIRKYAEGDYSKLLEGATLRLTGEDILDFQEKVFQSNGTGEKIELSNGTYTLTETSSP
ORF78         57 SVIIRKYAEGDYSKLLEGATLRLTGEDIPDFQEKVFQSNGTGEKIELSNGTYTLTETSSP
GI-21909634  275 SVIIRKYAEGDYSKLLEGATLKLAQIEGSGFQEKIFDSNKSGEKVELPNGTYVLSELKPP
GI-28810257  275 SVIIRKYAEGDYSKLLEGATLKLAQIEGSGFQEKIFDSNKSGEKVELPNGTYVLSELKPP
GI-19745301   57 SVIIRKYAEGDYSKLLEGATLKLAQIEGSGFQEQSFESSTSGQKLQLSDGTYILTETKSP
GAS15        297 SVLIRKYAIGDYSKLLEGATLQLTGDNVNSFQARVFSSNDIGERIELSDGTYTLTELNSP

GI-19224135  344 DGYKIAEPIKFRVVNKKVFIVQKDGSQVENPNKEVAEPYSVEAYSDMQLSNYINPETFTP
ORF78        117 DGYKITEPIKFRVVNKKVFIVQKDGSQVENPNKELGSPYTIEAYNDFDEFGLLSTQN---
GI-21909634  335 QGYGVATPITFKVAAEKVLIKNKEGQFVENQNKEIAEPYSVTAFNDFEEIGYLS--DFNN
GI-28810257  335 QGYGVATPITFKVAAEKVLIKNKEGQFVENQNKEIAEPYSVTAFNDFEEIGYLS--DFNN
GI-19745301  117 QGYEIAEPITFKVTAGKVFIKGKDGQFVENQNKEVAEPYSVTAYNDFDLSGFINPKTFTP
GAS15        357 AGYSIAEPITFKVEAGKVYT-IIDGKQIENPNKEIVEPYSVEAYNDFEEFSVLTTQN---

GI-19224135  404 YGKFYYAKNKDKSSQVVYCFNADLHSPPESEDGGGTIDPDISTMKEVKYTHTAGSDLFKY
ORF78        174 YAKFYYGKNYDGSSQIVYCFNANLKSPPDSEDHGATINPDFTTG-DIRYSHIAGSDLIKY
GI-21909634  393 YGKFYYAKNTNGTNQVVYCFNADLHSPPDSYDHGANIDPDVSESKEIKYTHVSGYDLYKY
GI-28810257  393 YGKFYYAKNTNGTNQVVYCFNADLHSPPDSYDHGANIDPDVSESKEIKYTHVSGYDLYKY
GI-19745301  177 YGKFYYAKNANGTSQVVYCFNVDLHSPPDSLDKGETIDPDFNEGKEIKYTHILGADLFSY
GAS15        413 YAKFYYAKNKNGSSQVVYCFNADLKSPPDSEDGGKTMTPDFTTG-EVKYTHIAGRDLFKY
```

FIGURE 52A

```
GI-19224135  464 ALRPRDTNPEDFLKHIKKVIEKGYNKKGD--SYNGLTETQFRAATQLAIYYFTDSTDLKT
ORF78        233 ANTARDEDPQLFLKHVKKVIENGYHKKGQAIPYNGLTEAQFRAATQLAIYYFTDSVDL--
GI-21909634  453 AATPRDKEADFFLKHIKKILDKGYKKKGD--TYKTLTEAQFRAATQLAIYYYTDSADLTT
GI-28810257  453 AATPRDKEADFFLKHIKKILDKGYKKKGD--TYKTLTEAQFRAATQLAIYYYTDSADLTT
GI-19745301  237 ANNPRASTNDELLSQVKKVLEKGYRDDST--TYANLTSVEFRAATQLAIYYFTDSVDLDN
GAS15        472 TVKPRDTDPDTFLKHIKKVIEKGYREKGQAIEYSGLTETQLRAATQLAIYYFTDSAELD-

GI-19224135  522 LKTYNNGKGYHGFESMDEKTLAVTKELINYAQD-NSAPQLTNLDFFVPNNSKYQSLIGTE
ORF78        291 --TKDRLKDEHGFGDMNDQTLGVAKKIVEYALS-DEDSKLTNLDFFVPNNSKYQSLIGTE
GI-21909634  511 LKTYNDNKGYHGFDKLDDATLAVVHELITYAED-VTLPMTQNLDFFVPNSSRYQALIGTQ
GI-28810257  511 LKTYNDNKGYHGFDKLDDATLAVVHELITYAED-VTLPMTQNLDFFVPNSSRYQALIGTQ
GI-19745301  295 LADY------HGFGALTTEALNATKEIVAYAEDRANLPNISNLDFYVPNSNKYQSLIGTQ
GAS15        531 ---KDKLKDYHGFGDMNDSTLAVAKIIVEYAQD-SNPPQLTDLDFFIPNNNKYQSLIGTQ

GI-19224135  581 YHPDDLVDVIRMEDKKQEVIPVTHSLTVKKTVVGELGDKTNGFQFELELKDKTGQPIVNT
ORF78        348 YHPDDLVDVIRMEDKKQEVIPVTHSLTVQKTVVGELGDKTNGFQFELELKDKTGQPIVNT
GI-21909634  570 YHPNELIDVISMEDKQAPIIPITHKLTISKTVTGTIADKKKEFNFEIHLKSSDGQAISGT
GI-28810257  570 YHPNELIDVISMEDKQAPIIPITHKLTISKTVTGTIADKKKEFNFEIHLKSSDGQAISGT
GI-19745301  349 YHPESLVDIIRMEDKQAPIIPITHKLTISKTVTGTIADKKKEFNFEIHLKSSDGQAISGT
GAS15        587 WHPEDLVDIIRMEDKK-EVIPVTHNLTIRKTVTGLAGDRTKDFHFEIELKNNKQELLSQT

GI-19224135  641 LKTNNQDLVAKDGKYSFNLKHGDTIRIEGLPTGYSYTLKETEAKDYIVTVDNKVSQEAQS
ORF78        408 LKTNNQDLVAKDGKYSFNLKHGDTIRIEGLPTGYSYTLKETEAKDYIVTVDNKVSQEAQS
GI-21909634  630 YPTNSGELTVTDGKATFTLKDGESLIVEGLPSGYSYEITETGASDYEVSVNGKNAPDGKA
GI-28810257  630 YPTNSGELTVTDGKATFTLKDGESLIVEGLPSGYSYEITETGASDYEVSVNGKNAPDGKA
GI-19745301  409 YPTNSGELTVTDGKATFTLKDGESLIVEGLPSGYSYEITETGASDYEVSVNGKNAPDGKA
GAS15        646 VKTDKTNLEFKDGKATINLKHGESLTLQGLPEGYSYLVKETDSEGYKVKVNSQEVANATV

GI-19224135  701 ASENVTADKEVTFENRKDLVPPTGFITDGGTYLWLLLLVPFGLLVWFFGRKGLKND-
ORF78        468 ASENVTADKEVTFENRKDLVPPTGLTTDGAIYLWLLLLVPFGLLVWLFGRKGLKND-
GI-21909634  690 TKASVKEDETVAFENRKDLVPPTGLTTDGAIYLWLLLLVPFGLLVWLFGRKGTKK--
GI-28810257  690 TKASVKEDETVAFENRKDLVPPTGLTTDGAIYLWLLLLVPFGLLVWLFGRKGTKK--
GI-19745301  469 TKASVKEDETITFENRKDLVPPTGLTTDGAIYLWLLLLVLLGLWVWLIGRKGLKND-
GAS15        706 SKTGITSDETLAFENNKEPVVPTGVDQKINGYLALIVIAGISLGIWGIHTIRIRKHD
```

FIGURE 52B

```
GI-19224134    1 MVSSYMFARGEKMNNKMFLNKEAGFLVHTKRKRRFAVTLVGVFFLLLACAGAIGFGQVAY
GI-50913503    1 MVSSYMFVRGEKMNNKIFLNKEASFLAHTKRKRRFAVTLVGVFFMLLACAGAIGFGQVAY

GI-19224134   61 AADEKTVPNFKSPDPDYPWYGYDSY------RGIFARYHNLKVNLKGSKEYQAYCFNDTK
GI-50913503   61 AADEKTVPSHSSPNPEFPWYGYDAYGKEYPGYNIWTRYHDLRVNLNGSRSYQVYCFNIQS

GI-19224134  115 YFPRPTYSTTNNEYKKIDGSGSAFKSYAANPRVLDENLDKLEKNILNVIYNGYKSNANGF
GI-50913503  121 NYPSQKNSFIKNVFKKIEGNGKSFVDYAHTTKLGKE---ELEQRILSLIYNAYPNDANGY

GI-19224134  175 MNGIEDLNAILVTQNAIWYYSDSAPLNDVNKMWEREVRNGEISESQVTLMREALKKLIDP
GI-50913503  178 MKGLEHLNAITVTQYAVWHYSDNS-QYQFETLWESEAKEGKISRSQVTLMREALKKLIDP

GI-19224134  235 NLEATAANKIPSGYRLNIFKSENEDYQNLLSAEYVPDDPPKPGDTSEHNPKTPELDGTPI
GI-50913503  237 NLEATAVNKIPSGYRLNIFESENEAYQNLLSAEYVPDDPPKPGETSEHNPKTPELDGTPI

GI-19224134  295 PEDPKRPDESSEPALPPLMPELDGEEVPEVPSESLEPALPPLMPELDGEEVPEVPSESLE
GI-50913503  297 PEDPKHPDENLEPTLPPVM-----------------------------------------

GI-19224134  355 PALPPLMPELDGEEVPEVPSESLEPALPPLMPELDGEEVPEVPSESLEPALPPLMPELDG
GI-50913503  316 ---------------------------------LDGEEVPEVPSESLEPALPPLMPELDG

GI-19224134  415 EEVPEKPSVDLPIEVPRYEFNNKDQSPLAGESGETEYITEVYGNQQNPVDIDKKLPNETG
GI-50913503  343 QEVPEKPSIDLPIEVPRYEFNNKDQSPLAGESGETEYITEVYGNQQNPVDIDKKLPNETG

GI-19224134  475 FSGNMVETEDTKEPEVLMGGQSESVEFTKDTQTGMSGQTTPQVETEDTKEPEVLMGGQSE
GI-50913503  403 FSGNMVETEDTKEPEVLMGGQSESVEFTKDTQTGMSGQTTPQVETEDTKEPEVLMGGQSE

GI-19224134  535 SVEFTKDTQTGMSGQTTPQVETEDTKEPGVLMGGQSESVEFTKDTQTGMSGQTTPQVETE
GI-50913503  463 SVEFTKDTQTGMSGQTTPQIETEDTKEPEVLMGGQSESVEFTKDTQTGMSGQTTPQIETE

GI-19224134  595 DTKEPGVLMGGQSESVEFTKDTQTGMSGFSETVTIVEDTRPKLVFHFDNNEPKVEENREK
GI-50913503  523 DTKEPEVLMGGQSESVEFTKDTQTGMSGFSETATVVEDTRPKLVFHFDNNEPKVEENREK

GI-19224134  655 PTKNITPILPATGDIENVLAFLGILILSVLSIFSLLKNKQNNKV-
GI-50913503  583 PTKNITPILPATGDIENVLAFLGILILSVLSIFSLLKNKQSNKKV
```

```
GI-19745307    1 MTQKNSYKLSFLLSLTGFILGLLLVFIGLSGVSVGHAETRNGANKQGAFEIKKN------
ORF84          1 MTQKNSYKLSFLLSLTGFILGLLLVFIGLSGVSVGHAETRNGANKQGAFEIKKN------
GI-28810263    1 MTQKNSYKLSFLLSLTGFILGLLLVFIGLSGVSVGHAETRNGANKQGAFEIKKN------
GI-21909640    1 ------------------------------------------------------------
GI-19224141    1 MTQKNSYKLSFLLSLTGFILGLLLVFIGLSGVSVGHAETRNGANKQGSFEIKKVDQNNKP

GI-19745307   55 ---------------------------------------------------KSQEEYNYE
ORF84         55 ---------------------------------------------------KSQEEYNYE
GI-28810263   55 ---------------------------------------------------KSQEEYNYE
GI-21909640    1 ------------------------------------------------------------
GI-19224141   61 LPGATFSLTSKDGKGTSVQTFTSNDKGIVDAQNLQPGTYTLKEETAPDGYDKSSRTETVT

GI-19745307   64 VYDN-----------------------------------------------------RNI
ORF84         64 VYDN-----------------------------------------------------RNI
GI-28810263   64 VYDN-----------------------------------------------------RNI
GI-21909640    1 ------------------------------------------------------------
GI-19224141  121 VYENGYTKLVENPYNGEIISKAGSKDVSSSLQLENPKMSVVSKYGKTEVSSGAADFYRNH

GI-19745307   71 LQDGEHKLEIKRVDGTGKTYQG--FCFQLTKNFP---TAQGVSKKLYKKLSS--------
ORF84         71 LQDGEHKLEIKRVDGTGKTYQG--FCFQLTKNFP---TAQGVSKKLYKKLSS--------
GI-28810263   71 LQDGEHKLEIKRVDGTGKTYQG--FCFQLTKNFP---TAQGVSKKLYKKLSS--------
GI-21909640    1 ---------------------------------------------------------MSS--------
GI-19224141  181 AAYFKMSFELKQKDKSETINPGDTFVLQLDRRLNPKGISQDIPKIEYDSANSPLAIGKYH

GI-19745307  118 ------------------------------SDEETLK-----------------------
ORF84        118 ------------------------------SDEETLK-----------------------
GI-28810263  118 ------------------------------SDEETLK-----------------------
GI-21909640    4 ------------------------------SDEETLK-----------------------
GI-19224141  241 AENHQLIYTFTDYIAGLDKVQLSAELSLFLENKEVLENTSISNFKSTIGGQEITYKGTVN

GI-19745307  125 -------QYASKYTSNRRGDTSG-------------------------------------
ORF84        125 -------QYASKYTSNRRGDTSG-------------------------------------
GI-28810263  125 -------QYASKYTSNRRGDTSG-------------------------------------
GI-21909640   11 -------QYASKYTSNRRGDTSG-------------------------------------
GI-19224141  301 VLYGNESTKESNYIENGLSNVGGSIESYNTETGEFVWYVYVNPNRTNIPYATMNLWGFGR

GI-19745307  141 --------------------------------------------NLKKQIAKVLTEGYPT
ORF84        141 --------------------------------------------NLKKQIAKVLTEGYPT
GI-28810263  141 --------------------------------------------NLKKQIAKVLTEGYPT
GI-21909640   27 --------------------------------------------NLKKQIAKVLTEGYPT
GI-19224141  361 ARSNTSDLENDANTSSAELGEIQVYEVPEGEKLPSSYGVDVTKLTLRTDITAGLGNGEQM

GI-19745307  157 NKS---DWLN--------------------------------GLTENEKIEVTQDAIWYF
ORF84        157 NKS---DWLN--------------------------------GLTENEKIEVTQDAIWYF
GI-28810263  157 NKS---DWLN--------------------------------GLTENEKIEVTQDAIWYF
GI-21909640   43 NKS---DWLN--------------------------------GLTENEKIEVTQDAIWYF
GI-19224141  421 TKRQRIDSGNNIQNKAFIIKVTGKTDQSGKPLVVQSNLASFRGASEYAAFTPVGGNVYFQ

GI-19745307  182 TETTVPADR-------SYTNRNVNSQKMKEVYQKLIDTTDID--KYEDVQFDLFVPQDTN
ORF84        182 TETTVPADR-------SYTNRNVNSQKMKEVYQKLIDTTDID--KYEDVQFDLFVPQDTN
GI-28810263  182 TETTVPADR-------SYTNRNVNSQKMKEVYQKLIDTTDID--KYEDVQFDLFVPQDTN
GI-21909640   68 TETTVPADR-------SYTNRNVNSQKMKEVYQKLIDTTDID--KYEDVQFDLFVPQDTN
GI-19224141  481 NEIAKSPSKGSGSGKSEETKPSETVANEKRVAQLRFKKMSTDNVPLPEAAFELRSSNGNS
```

Figure 54B

```
GI-19745307   233 --LQAVISVEPVIESLPWTS-----------------LKPIAQKDITAKK----------
ORF84         233 --LQAVISVEPVIESLPWTS-----------------LKPIAQKDITAKK----------
GI-28810263   233 --LQAVISVEPVIESLPWTS-----------------LKPIAQKDITAKK----------
GI-21909640   119 --LQAVISVEPVIESLPWTS-----------------LKPIAQKDITAKK----------
GI-19224141   541 QKLEASSNTQGEVHFKDLTSGTYDLYETKAPKGYQQVTEKLATVTVDTTKPAEEMVTWGS

GI-19745307   264 ----IWVDAPKEKPIIYFKLYRQLPGEKEVAVDDAELK------QINSEGQ---------
ORF84         264 ----IWVDAPKEKPIIYFKLYRQLPGEKEVAVDDAELK------QINSEGQ---------
GI-28810263   264 ----IWVDAPKEKPIIYFKLYRQLPGEKEVAVDDAELK------QINSEGQ---------
GI-21909640   150 ----IWVDAPKEKPIIYFKLYRQLPGEKEVAVDDAELK------QINSEGQ---------
GI-19224141   601 PHSSVKVEANKEVTIVNHKETLTFSGKKIWENDRPDQRPAKIQVQLLQNGQKMPNQIQEV

GI-19745307   305 ---QEISVTWTNQLVTDEKGMAYIYSVKEVDK---------NGELLEPKD----YIKKED
ORF84         305 ---QEISVTWTNQLVTDEKGMAYIYSVKEVDK---------NGELLEPKD----YIKKED
GI-28810263   305 ---QEISVTWTNQLVTDEKGMAYIYSVKEVDK---------NGELLEPKD----YIKKED
GI-21909640   191 ---QEISVTWTNQLVTDEKGMAYIYSVKEVDK---------NGELLEPKD----YIKKED
GI-19224141   661 TKDNDWSYHEKDLPKYDAKNQEYKYSVEEVNVPDGYKVSYLGNDIFNTRETEFVFEQNNF

GI-19745307   349 GLTVTNTYVKPTSG----HYDIEVTFG-----------NGHIDITEDTTPDIVSGENQMK
ORF84         349 GLTVTNTYVKPTSG----HYDIEVTFG-----------NGHIDITEDTTPDIVSGENQMK
GI-28810263   349 GLTVTNTYVKPTSG----HYDIEVTFG-----------NGHIDITEDTTPDIVSGENQMK
GI-21909640   235 GLTVTNTYVKPTSG----HYDIEVTFG-----------NGHIDITEDTTPDIVSGENQMK
GI-19224141   721 NLEFGNAEIKGQSGSKIIDEDTLTSFKGKKIWKNDTAENRPQAIQVQLYADGVAVEGQTK

GI-19745307   394 QIEGEDS--------------------KPIDEVT-----------ENNLIEFGKNTMPGEE
ORF84         394 QIEGEDS--------------------KPIDEVT-----------ENNLIEFGKNTMPGEE
GI-28810263   394 QIEGEDS--------------------KPIDEVT-----------ENNLIEFGKNTMPGEE
GI-21909640   280 QIEGEDS--------------------KPIDEVT-----------ENNLIEFGKNTMPGEE
GI-19224141   781 FISGSGNEWSFEFKNLKKYNGTGNDIIYSVKEVTVPTGYDVTYSANDIINTKREVITQQG

GI-19745307   424 -----------DGTNSNKYEEVEDSRPVDTLSGLSSEQGQSGDMTIEEDSATHIKFSKRD
ORF84         424 -----------DGTNSNKYEEVEDSRPVDTLSGLSSEQGQSGDMTIEEDSATHIKFSKRD
GI-28810263   424 -----------DGTNSNKYEEVEDSRPVDTLSGLSSEQGQSGDMTIEEDSATHIKFSKRD
GI-21909640   310 -----------DGTNSNKYEEVEDSRPVDTLSGLSSEQGQSGDMTIEEDSATHIKFSKRD
GI-19224141   841 PKLEIEETLPLESGASGGTTTVEDSRPVDTLSGLSSEQGQSGDMTIEEDSATHIKFSKRD

GI-19745307   473 IDGKELAGATMELRDSSGKTISTWISDGQVKDFYLMPGKYTFVETAAPDGYEIATAITFT
ORF84         473 IDGKELAGATMELRDSSGKTISTWISDGQVKDFYLMPGKYTFVETAAPDGYEIATAITFT
GI-28810263   473 IDGKELAGATMELRDSSGKTISTWISDGQVKDFYLMPGKYTFVETAAPDGYEVATAITFT
GI-21909640   359 IDGKELAGATMELRDSSGKTISTWISDGQVKDFYLMPGKYTFVETAAPDGYEVATAITFT
GI-19224141   901 IDGKELAGATMELRDSSGKTISTWISDGQVKDFYLMPGKYTFVETAAPDGYEIATAITFT

GI-19745307   533 VNEQGQVTVNGKATKGDAHIVMVDAYKPTKGSGQVIDIEEKLPDEQGHSGSTTEIEDSKS
ORF84         533 VNEQGQVTVNGKATKGDAHIVMVDAYKPTKGSGQVIDIEEKLPDEQGHSGSTTEIEDSKS
GI-28810263   533 VNEQGQVTVNGKATKGDAHIVMVDAYKPTKGSGQVIDIEEKLPDEQGHSGSTTEIEDSKS
GI-21909640   419 VNEQGQVTVNGKATKGDAHIVMVDAYKPTKGSGQVIDIEEKLPDEQGHSGSTTEIEDSKS
GI-19224141   961 VNEQGQVTVNGKATKGDTHIVMVDAYKPTKGSGQVIDIEEKLPDEQGHSGSTTEIEDSKS

GI-19745307   593 SDVIIGGQG---------------------------------------------------
ORF84         593 SDVIIGGQG---------------------------------------------------
GI-28810263   593 SDVIIGGQGEVVDTTEDTQSGMTGHS----------------------------------
GI-21909640   479 SDVIIGGQGEVVDTTEDTQSGMTGHSGSTTEIEDSKSSDVIIGGQGEVVDTTEDTQSGMT
GI-19224141  1021 SDLIIGGQGEVVDTTEDTQSGMTGHS----------------------------------
```

Figure 54C

```
GI-19745307  602 ------------------------QIVETTEDTQTGMHGDSGCKTEVEDTKLVQSFHFDNK
ORF84        602 ------------------------QIVETTEDTQTGMHGDSGCKTEVEDTKLVQSFHFDNK
GI-28810263  619 ---GSTTKIEDSKSSDVIVGGQGQIVETTEDTQTGMHGDSGRKTEVEDTKLVQSFHFDNK
GI-21909640  539 GHSGSTTKIEDSKSSDVIVGGQGQIVETTEDTQTGMHGDSGRKTEVEDTKLVQSFHFDNK
GI-19224141 1047 ---GSTTEIEDSKSSDVIIGGQGQVVETTEDTQTGMYGDSGCKTEVEDTKLVQSFHFDNK

GI-19745307  639 ESESNSEIPKKDKPKSNTSLPATGEKQHNMFFWMVTSCSLISSVFVISLKTKKRLSSC
ORF84        639 ESESNSEIPKKDKPKSNTSLPATGEKQHNMFFWMVTSCSLISSVFVISLKTKKRLSSC
GI-28810263  676 EPESNSEIPKKDKSKSNTSLPATGEKQHNKFFWMVTSCSLISSVFVISLKSKKRLSSC
GI-21909640  599 EPESNSEIPKKDKSKSNTSLPATGEKQHNKFFWMVTSCSLISSVFVISLKSKKRLSSC
GI-19224141 1104 EPESNSEIPKKDKPKSNTSLPATGEKQHNMFFWMVTSCSLISSVFVISLKSKKRLSSC
```

```
GI-19224137    1 -----MKKNKLLLATAILATALGTASLNQNVKAETAGVVSSGQLTIKKSITNENDDTLLM
ORF80          1 LEREKMKKNKLLLATAILATALGTASLNQNVKAETAGVVTGKSLQVTKTMT-YDDEEVLM
GI-21909636    1 -----MKKNKLLLATAILATALGTASLNQNVKAETAGVSENAKLIVKKTFDSYTDNEVLM
GI-28810259    1 MEREKMKKNKLLLATAILATALGTASLNQNVKAETAGVSENAKLIVKKTFDSYTDNEVLM
GI-19745303    1 -----MKKNKLLLATAILATALGTASLNQNVKAETAGVIDGSTLVVKKTFPSYTDDKVLM
GI-13621428    1 -----MKLRHLLLTGAALTSFAATT-------VHGETVVNGAKLTVTKNLDLVNSN-ALI

GI-19224137   56 PKTDYTFSVNPDSAATGTESN-LPIKPGIAVN-NQDIKVSYSNTDKTSGKEKQVVVDFMK
ORF80         60 PETARTFTIEPDMTASGKEGS-LDIKNGIVEGLDKQVTVKYKNTDKTSQKTKIAQFDFSK
GI-21909636   56 PKADYTFKVEADSTASGKTKDGLEIKPGIVNGLT-EQIISYTNTDKPDSKVKSTEFDFSK
GI-28810259   61 PKADYTFKVEADSTASGKTKDGLEIKPGIVNGLT-EQIISYTNTDKPDSKVKSTEFDFSK
GI-19745303   56 PKADYTFKVEADDNAKGKTKDGLDIKPGVIDGLENTKTLHYGNSDKTTAKEKSVNFDFAN
GI-13621428   48 PNTDFTFKIEPDITVNEDGNKFKG-----VALNTPMTKVIYTNSDKGGSNTKTAEFDFSE

GI-19224137  114 VTFPSVGIYRYVVTENKGTAE-GVTYDDTKWLVDVYVGN--NEKGGLEPKYIVSKKGDSA
ORF80        119 VKFPAIGVYRYMVSEKNDKKD-GITYDDKKWTVDVYVGNKANNEEGFEVLYIVSKEGTSS
GI-21909636  115 VVFPGIGVYRYTVSEKQGDVE-GITYDTKKWTVDVYVGN--KEGGGFEPKFIVSKEQGTD
GI-28810259  120 VVFPGIGVYRYTVSEKQGDVE-GITYDTKKWTVDVYVGN--KEGGGFEPKFIVSKEQGTD
GI-19745303  116 VKFPGVGVYRYTVSEVNGNKA-GIAYDSQQWTVDVYVVN--REDGGFEAKYIVSTEGGQS
GI-13621428  103 VTFEKPGVYYYKVTEEKIDKVPGVSYDTTSYTVQVHVLWN-EEQQKPVATYIVGYKEGS-

GI-19224137  171 TKEPIQFNNSFETTSLKIEKEVIGNTGDHKKAFTFTLTLQPNEYYEASSVVKIEENGQ--
ORF80        178 TKKPIEFTNSIKTTSLKIEKQIIGNAGDRKKSFNFTLTLQPSEYYKTGSVVKIEQDGS--
GI-21909636  172 VKKPVNFNNSFATTSLKVKKNVSGNTGELQKEFDFTLTLNESTNFKKDQIVSLQKGNE--
GI-28810259  177 VKKPVNFNNSFATTSLKVKKNVSGNTGELQKEFDFTLTLNESTNFKKDQIVSLQKGNE--
GI-19745303  173 DKKPVLFKNFFDTTSLKVTKKVIGNTGEHQRSFSFTLLLTPNECFEKGQVVNILQGGE--
GI-13621428  161 -KVPIQFKNSLDSTTLTVKKKVSGTGGDRSKDFNFGLTLKANQYYKASEKVMIEKTTKGG

GI-19224137  229 ----TKDVKIGEAYKFTLNDSQSVILSKLPVGINYKVEEAEANQGGYTTTATLKDG--EK
ORF80        236 ----KKDVTIGTPYKFTLGHGKSVMLSKLPIGINYYLSEDEANKDGYTTTATLKEQGKEK
GI-21909636  230 ----KFEVKIGTPYKFKLKNGESIQLDKLPVGITYKVNEMEANKDGYKTTASLKEG-DGQ
GI-28810259  235 ----KFEVKIGTPYKFKLKNGESIQLDKLPVGITYKVNEMEANKDGYKTTASLKEG-DGQ
GI-19745303  231 ----TKKVVIGEEYSFTLKDKESVTLSQLPVGIEYKVTEEDVTKDGYKTSATLKDG-D-V
GI-13621428  220 QAPVQTEASIDQLYHFTLKDGESIKVTNLPVGVDYVVTEDDYKSEKYTTNVEVSPQDGAV

GI-19224137  283 LSTYNLG-QEHKTDKTADEIVVTNNRDTQVPTGVVGTLAPFAVLSIVAIGGVIYITKRKK
ORF80        292 SSDETLSTQNQKTDESADEIVVTNKRDTQVPTGVVGTLAPFAVLSIVAIGGVIYITKRKK
GI-21909636  285 SKMYQLD-MEQKTDESADEIVVTNKRDTQVPTGVVGTLAPFAVLSIVAIGGVIYITKRKK
GI-28810259  290 SKMYQLD-MEQKTDESADEIVVTNKRDTQVPTGVVGTLAPFAVLSIVAIGGVIYITKRKK
GI-19745303  285 TDGYNLG-DSKTTDKSTDEIVVTNKRDTQVPTGVVGTLAPFAVLSIVAIGGVIYITKRKK
GI-13621428  280 KNIAGNSTEQETSTDKDMTITFTNKKDFEVPTGVAMTVAPYIALGIVAVGGALYFVKKKN

GI-19224137  342 A
ORF80        352 A
GI-21909636  344 A
GI-28810259  349 A
GI-19745303  344 A
GI-13621428  340 A
```

Figure 55

```
GI-21909638    1 ---------------------------------------MILTMLAFNQTVLAKDSTV
GI-28810261    1 ---------------------------------MLFSVVMILTMLAFNQTVLAKDSTV
GI-19224139    1 ---------------------------------MLFSVVMILTMLAFNQTVLAKDSTV
ORF82          1 LLFQRVKIFLLTIVLSLSVLFKNNERRRLLRKYWKMLFSVVMILTMLAFNQTVLAKDSTV
GI-19745305    1 ---------------------------MRKYWKMLFSVVMILTMLAFNQTVLAKDSTV

GI-21909638   20 QTSISVENVLERAGDSTPFSIALESIDAMKTIEEITIAGSGKASFSPLTFTTVGQYTYRV
GI-28810261   26 QTSISVENVLERAGDSTPFSIALESIDAMKTIEEITIAGSGKASFSPLTFTTVGQYTYRV
GI-19224139   26 QTSISVENVLERAGDSTPFSIALESIDAMKTIEEITIAGSGKASFSPLTFTTVGQYTYRV
ORF82         61 QTSISVENVLERAGDSTPFSVALESIDAMKTIDEITIAGSGKASFSPLTFTTVGQYTYRV
GI-19745305   32 QTSISVENVLERAGDSTSFSVALESIDAMKTIDEITIAGSGKASFSPLTFTTVGQYTYRV

GI-21909638   80 YQKPSQNKDYQADTTVFDVLVYVTYDEDGTLVAKVISRRAGDEEKSAITFKPKWLVKPIP
GI-28810261   86 YQKPSQNKDYQADTTVFDVLVYVTYDEDGTLVAKVISRRAGDEEKSAITFKPKWLVKPIP
GI-19224139   86 YQKPSQNKDYQADTTVFDVLVYVTYDEDGTLVAKVISRRAGDEEKSAITFKPKRLVKPIP
ORF82        121 YQKPSQNKDYQADTTVFDVLVYVTYDEDGTLVAKVISRRAGDEEKSAITFKPKRLVKPIP
GI-19745305   92 YQKPSQNKDYQADTTVFDVLVYVTYDEDGTLVAKVISRRAGDEEKSAITFKPKRLVKPIP

GI-21909638  140 PRQPNIPKTPLPLAGEVKSLLGILSIVLLGLLVLLYVKKLKSRL
GI-28810261  146 PRQPNIPKTPLPLAGEVKSLLGILSIVLLGLLVLLYVKKLKSRL
GI-19224139  146 PRQPNIPKTPLPLAGEVKSLLGILSIVLLGLLVLLYVKKLKSKL
ORF82        181 PRQPNIPKTPLPLAGEVKSLLGILSIVLLGLLVLLYVKKLKSRL
GI-19745305  152 PRQPDIPKTPLPLAGEVKSLLGILSIVLLGLLVLLYVKKLKSRL
```

Figure 56

```
!!SEQUENCE_LIST 1.0

(Peptide) FASTA of: gi-50913505.pep  from: 1 to: 1036  September 15, 2004 18:46

gi|50913505|ref|YP_059477.1| Collagen adhesion protein [Streptococcus pyogenes M
GAS10394]

 TO: *.pep  Sequences:        56  Symbols:       22,803  Word Size: 2

 Scoring matrix: GenRunData:blosum50.cmp
 Variable pamfactor used
 Gap creation penalty: 12  Gap extension penalty: 2



Histogram Key:
 Each histogram symbol represents 1 search set sequences
 z-scores computed from opt scores

z-score obs    exp
        (=)    (*)

< 20      0      0:
  22      0      0:
  24      0      0:
  26      0      0:
  28      0      0:
  30      0      0:
  32      0      0:
  34      0      1:*
  36      0      2: *
  38      0      3:  *
  40      0      4:   *
  42      0      5:    *
  44      0      5:    *
  46      5      5:====*
  48     10      5:====*=====
  50     12      4:===*========
  52      4      4:===*
  54      6      3:==*===
  56      4      3:==*=
  58      5      2:=*===
  60      3      2:=*=
  62      0      1:*
  64      1      1:*
  66      1      1:*
  68      0      1:*
  70      1      1:*
  72      0      0:
  74      0      0:
  76      1      0:=
  78      0      0:
  80      0      0:
  82      0      0:
  84      0      0:
  86      0      0:
  88      0      0:
  90      0      0:
  92      0      0:
  94      0      0:
  96      1      0:=
```

```
  98       0       0:
 100       0       0:
 102       0       0:
 104       0       0:
 106       1       0:=
 108       0       0:
 110       0       0:
 112       0       0:
 114       0       0:
 116       0       0:
 118       0       0:
>120       1       0:=

Joining threshold: 39, opt. threshold: 27, opt. width:  16, reg.-scaled


The best scores are:                    init1 initn   opt    z-sc E(54)..

/home/morama/gas/pili/align/gi-50913505.pep    Begin: 1  End: 1036
! gi|50913505|ref|YP_059477.1| Collag... 6697  6697  6697  3452.1  9.6e-189
/home/morama/gas/pili/align/gi-19224141.pep    Begin: 48  End: 144
! gi|19224141|gb|AAL86412.1|AF447492_...   63   100   159   105.9   0.023
/home/morama/gas/pili/align/gi-21909640.pep    Begin: 147  End: 449
! gi|21909640|ref|NP_663908.1| protei...   35    35   136    96.3    0.08
/home/morama/gas/pili/align/gi-13621428.pep    Begin: 57  End: 318
! gi|13621428|gb|AAK33238.1| hypothet...   33    33    91    75.6     1.1
/home/morama/gas/pili/align/gi-50913506.pep    Begin: 33  End: 428
! gi|50913506|ref|YP_059478.1| Fimbri...   70   149    86    71.3     1.9
/home/morama/gas/pili/align/gi-13621432.pep    Begin: 14  End: 56
! gi|13621432|gb|AAK33241.1| conserve...   40    65    78    68.0     2.9
/home/morama/gas/pili/align/gi-19745301.pep    Begin: 241  End: 466
! gi|19745301|ref|NP_606437.1| putati...   52    52    73    64.8     4.3
/home/morama/gas/pili/align/gas15.pep    Begin: 492  End: 739
! GAS15 GAS15                              43    68    69    61.4     6.6
/home/morama/gas/pili/align/gi-21909636.pep    Begin: 176  End: 298
! gi|21909636|ref|NP_663904.1| conser...   31    31    62    60.8     7.1
/home/morama/gas/pili/align/gi-28810259.pep    Begin: 181  End: 303
! gi|28810259|dbj|BAC63197.1| hypothe...   31    31    62    60.7     7.2
/home/morama/gas/pili/align/gi-19224139.pep    Begin: 90  End: 143
! gi|19224139|gb|AAL86410.1|AF447492_...   43    43    54    58.9     8.9
/home/morama/gas/pili/align/gi-19745305.pep    Begin: 96  End: 149
! gi|19745305|ref|NP_606441.1| hypoth...   43    43    54    58.8       9
/home/morama/gas/pili/align/orf82.pep    Begin: 125  End: 178
! TRANSLATE of: orf82.seq check: 4296...   43    43    54    58.2     9.6
/home/morama/gas/pili/align/gi-21909638.pep    Begin: 84  End: 137
! gi|21909638|ref|NP_663906.1| hypoth...   43    43    52    58.0     9.9
\\End of List


gi-50913505.pep
/home/morama/gas/pili/align/gi-50913505.pep

gi|50913505|ref|YP_059477.1| Collagen adhesion protein [Streptococcus pyogenes M
GAS10394]


SCORES   Init1: 6697  Initn: 6697  Opt: 6697  z-score: 3452.1 E(): 9.6e-189
>>/home/morama/gas/pili/align/gi-50913505.pep            (1036 aa)
 initn: 6697 init1: 6697 opt: 6697 Z-score: 3452.1 expect(): 9.6e-189
Smith-Waterman score: 6697;   100.0% identity in 1036 aa overlap
 (1-1036:1-1036)
```

Figure 57B

```
                       10        20        30        40        50        60
gi-50913505.  MYSRLKRELVIVINRKKKYKLIRLMVTVGLIFSQLVLPIRRLGLQMISTQTKVIPQEIVT
              ||||||||||||||||||||||||||||||||||||||||||||||||||||||||||||
gi-50913505.  MYSRLKRELVIVINRKKKYKLIRLMVTVGLIFSQLVLPIRRLGLQMISTQTKVIPQEIVT
                       10        20        30        40        50        60

                       70        80        90       100       110       120
gi-50913505.  QTETQGTQVVATKQKLESENSSLKVALKRESGFEHNATIDASLDTESQGDNSQRSVTQAI
              ||||||||||||||||||||||||||||||||||||||||||||||||||||||||||||
gi-50913505.  QTETQGTQVVATKQKLESENSSLKVALKRESGFEHNATIDASLDTESQGDNSQRSVTQAI
                       70        80        90       100       110       120

                      130       140       150       160       170       180
gi-50913505.  VTMALELRKQGLSIVDTKIVRIQSSTNQRNDITTTLTFKNGLSLEGASTEANDPNVRVGI
              ||||||||||||||||||||||||||||||||||||||||||||||||||||||||||||
gi-50913505.  VTMALELRKQGLSIVDTKIVRIQSSTNQRNDITTTLTFKNGLSLEGASTEANDPNVRVGI
                      130       140       150       160       170       180

                      190       200       210       220       230       240
gi-50913505.  VNPNDTVQTITPTIKQDADGKVKNLVFTGRLGKQVIIVSTTRLKEEQTISLDSYGELVID
              ||||||||||||||||||||||||||||||||||||||||||||||||||||||||||||
gi-50913505.  VNPNDTVQTITPTIKQDADGKVKNLVFTGRLGKQVIIVSTTRLKEEQTISLDSYGELVID
                      190       200       210       220       230       240

                      250       260       270       280       290       300
gi-50913505.  GAVGLSQKDRPPYSKPITVNILKPKLSSIESSLDSKDFEIVKTIDNLYTWDDQFYLLDFI
              ||||||||||||||||||||||||||||||||||||||||||||||||||||||||||||
gi-50913505.  GAVGLSQKDRPPYSKPITVNILKPKLSSIESSLDSKDFEIVKTIDNLYTWDDQFYLLDFI
                      250       260       270       280       290       300

                      310       320       330       340       350       360
gi-50913505.  SKQYEVLKTDYQSAKDSTPQTRDILFGEYTVEPLVMNKGHNNTINIYIRSTRPLGLKPIG
              ||||||||||||||||||||||||||||||||||||||||||||||||||||||||||||
gi-50913505.  SKQYEVLKTDYQSAKDSTPQTRDILFGEYTVEPLVMNKGHNNTINIYIRSTRPLGLKPIG
                      310       320       330       340       350       360

                      370       380       390       400       410       420
gi-50913505.  AAPALIQPRSFRSLTPRSTRMKRSAPVEKFEGELEHHKRIDYLGDNQNNPDTTIDDKEDE
              ||||||||||||||||||||||||||||||||||||||||||||||||||||||||||||
gi-50913505.  AAPALIQPRSFRSLTPRSTRMKRSAPVEKFEGELEHHKRIDYLGDNQNNPDTTIDDKEDE
                      370       380       390       400       410       420

                      430       440       450       460       470       480
gi-50913505.  HDTSDLYRLYLDMTGKKNPLDILVVVDKSGSMQEGIGSVQRYRYYAQRWDDYYSQWVYHG
              ||||||||||||||||||||||||||||||||||||||||||||||||||||||||||||
gi-50913505.  HDTSDLYRLYLDMTGKKNPLDILVVVDKSGSMQEGIGSVQRYRYYAQRWDDYYSQWVYHG
                      430       440       450       460       470       480

                      490       500       510       520       530       540
gi-50913505.  TFDYSSYQGESFNRGQIHYRYRGIVSVSDGIRRDDAVKNSLLGVNGLLQRFVNINPENKL
              ||||||||||||||||||||||||||||||||||||||||||||||||||||||||||||
gi-50913505.  TFDYSSYQGESFNRGQIHYRYRGIVSVSDGIRRDDAVKNSLLGVNGLLQRFVNINPENKL
                      490       500       510       520       530       540

                      550       560       570       580       590       600
gi-50913505.  SVIGFQGSADYHAGKWYPDQSPRGGFYQPNLNNSRDAELLKGWSTNSLLDPNTLTALHNN
              ||||||||||||||||||||||||||||||||||||||||||||||||||||||||||||
gi-50913505.  SVIGFQGSADYHAGKWYPDQSPRGGFYQPNLNNSRDAELLKGWSTNSLLDPNTLTALHNN
                      550       560       570       580       590       600
```

Figure 57C

```
                    610       620       630       640       650       660
gi-50913505. GTNYHAALLKAKEILNEVKDDGRRKIMIFISDGVPTFYFGEDGYRSGNGSSNDRNNVTRS
             ||||||||||||||||||||||||||||||||||||||||||||||||||||||||||||
gi-50913505. GTNYHAALLKAKEILNEVKDDGRRKIMIFISDGVPTFYFGEDGYRSGNGSSNDRNNVTRS
                    610       620       630       640       650       660

                    670       680       690       700       710       720
gi-50913505. QEGSKLAIDEFKARYPNLSIYSLGVSKDINSDTASSSPVVLKYLSGEEHYYGITDTAELE
             ||||||||||||||||||||||||||||||||||||||||||||||||||||||||||||
gi-50913505. QEGSKLAIDEFKARYPNLSIYSLGVSKDINSDTASSSPVVLKYLSGEEHYYGITDTAELE
                    670       680       690       700       710       720

                    730       740       750       760       770       780
gi-50913505. KTLNKIVEDSKLSQLGISDSLSQYVDYYDKQPDVLVTRKSKVNDETEILYQKDQVQEAGK
             ||||||||||||||||||||||||||||||||||||||||||||||||||||||||||||
gi-50913505. KTLNKIVEDSKLSQLGISDSLSQYVDYYDKQPDVLVTRKSKVNDETEILYQKDQVQEAGK
                    730       740       750       760       770       780

                    790       800       810       820       830       840
gi-50913505. DIIDKVVFTPKTTSQPKGKVTLTFKSDYKVDDEYTYTLSFNVKASDEAYEKYKDNEGRYS
             ||||||||||||||||||||||||||||||||||||||||||||||||||||||||||||
gi-50913505. DIIDKVVFTPKTTSQPKGKVTLTFKSDYKVDDEYTYTLSFNVKASDEAYEKYKDNEGRYS
                    790       800       810       820       830       840

                    850       860       870       880       890       900
gi-50913505. EMGDSDTDYGTNQTSSGKGGLPSNSDASVNYMADGREQKLPYKHPVIQVKTVPITFTKVD
             ||||||||||||||||||||||||||||||||||||||||||||||||||||||||||||
gi-50913505. EMGDSDTDYGTNQTSSGKGGLPSNSDASVNYMADGREQKLPYKHPVIQVKTVPITFTKVD
                    850       860       870       880       890       900

                    910       920       930       940       950       960
gi-50913505. ADNNQKKLAGVEFELRKEDKKIVWEKGTTGSNGQLNFKYLQKGKTYYLYETKAKLGYTLP
             ||||||||||||||||||||||||||||||||||||||||||||||||||||||||||||
gi-50913505. ADNNQKKLAGVEFELRKEDKKIVWEKGTTGSNGQLNFKYLQKGKTYYLYETKAKLGYTLP
                    910       920       930       940       950       960

                    970       980       990      1000      1010      1020
gi-50913505. ENPWEVAVANNGDIKVKHPIEGELKSKDGSYMIKNYKIYQLPSSGGRGSQIFIIVGSMTA
             ||||||||||||||||||||||||||||||||||||||||||||||||||||||||||||
gi-50913505. ENPWEVAVANNGDIKVKHPIEGELKSKDGSYMIKNYKIYQLPSSGGRGSQIFIIVGSMTA
                    970       980       990      1000      1010      1020

                   1030
gi-50913505. TVALLFYRRQHRKKQY
             ||||||||||||||||
gi-50913505. TVALLFYRRQHRKKQY
                   1030
```

gi-50913505.pep
/home/morama/gas/pili/align/gi-19224141.pep gi|19224141|gb|AAL86412.1|AF447492_9 protein F2 [Streptococcus pyogenes]

```
SCORES   Init1: 63    Initn: 100   Opt: 159   z-score: 105.9 E(): 0.023
>>/home/morama/gas/pili/align/gi-19224141.pep           (1161 aa)
 initn: 100 init1:  63 opt: 159 Z-score: 105.9 expect(): 0.023
Smith-Waterman score: 159;    36.7% identity in 98 aa overlap
 (895-990:48-144)
```

Figure 57D

```
                 870       880       890       900       910       920
gi-50913505. SDASVNYMADGREQKLPYKHPVIQVKTVPITFTKVDADNNQKKLAGVEFELRKEDKK-IV
                                               :|    :|:|:| | |: | | ::| |
gi-19224141. FILGLLLVFIGLSGVSVGHAETRNGANKQGSFEIKKVDQNNKPLPGATFSLTSKDGKGTS
               20        30        40        50        60        70

                930       940       950       960       970        980
gi-50913505. WEKGTTGSNGQLNFKYLQKGKTYYLYETKAKLGYTLPENPWEVAVANNGDIK-VKHPIEG
               :  |::::| :: :  || | || | |   |  ||       | |:| :||  | |::| :|
gi-19224141. VQTFTSNDKGIVDAQNLQPG-TYTLKEETAPDGYDKTSRTWTVTVYENGYTKLVENPYNG
               80        90       100       110       120       130

                 990      1000      1010      1020      1030
gi-50913505. ELKSKDGSYMIKNYKIYQLPSSGGRGSQIFIIVGSMTATVALLFYRRQHRKKQY
             |: || ||
gi-19224141. EIISKAGSKDVSSSLQLENPKMSVVSKYGKTEVSSGAADFYRNHAAYFKMSFELKQKDKS
               140       150       160       170       180       190
```

gi-50913505.pep
/home/morama/gas/pili/align/gi-21909640.pep gi|21909640|ref|NP_663908.1| protein F2 like fibronectin-binding protein [Strept
ococcus pyogenes MGAS315]

```
SCORES   Init1: 35   Initn: 35   Opt: 136   z-score: 96.3  E(): 0.08
>>/home/morama/gas/pili/align/gi-21909640.pep              (656 aa)
 initn:  35 init1:  35 opt: 136 Z-score: 96.3 expect(): 0.08
Smith-Waterman score: 148;    24.5% identity in 339 aa overlap
 (686-1005:147-449)

               660       670       680       690       700          710
gi-50913505. NVTRSQEGSKLAIDEFKARYPNLSIYSLGVSKDINSDTASSSPVVL----KYLSGEEHYY
                                               :| |  |: : :|::     : | ||::
gi-21909640. TNLQAVISVEPVIESLPWTSLKPIAQKDITAKKIWVDAPKEKPIIYFKLYRQLPGEKEV-
               120       130       140       150       160       170

                  720       730       740       750       760       770
gi-50913505. GITDTAELEKTLNKIVEDSKLSQLGISDSLSQYVDYYDKQPDVLVTRKSKVNDETEILYQ
               :| |||::     :::  :::::: : :| |    |::  : :   ::|: : |:|
gi-21909640. -AVDDAELKQ-----INSEGQQEISVTWT-NQLVT--DEKGMAYIYSVKEVDKNGELLEP
                180             190       200       210       220

                   780       790       800       810       820       830
gi-50913505. KDQVQ-EAGKDIIDKVVFTPKTTSQPKGKVTLTFKSDYKVDDEYTYTLSFNVKASDEAYE
             || :: | |  : :  |    | ||  :   : :|| : : :|    |    : :: ::::
gi-21909640. KDYIKKEDGLTVTNTYV---KPTSG-HYDIEVTFGNGH-ID--ITEDTTPDIVSGEN---
               230       240            250       260           270

                   840       850       860       870
gi-50913505. KYKDNEGRYSEMGDSDTDYGTNQTSSGKGGLPSNSDA--SVNY--MADGR----------
             ::|: ||: |:   |   |:  :|     ||: :|:: |:  | :|  : |:|
gi-21909640. QMKQIEGEDSKPIDEVTE--NNLIEFGKNTMPGEEDGTNSNKYEEVEDSRPVDTLSGLSS
               280       290          300       310       320       330

               880       890       900       910       920       930
gi-50913505. EQKLPYKHPVIQVKTVPITFTKVDADNNQKKLAGVEFELRKEDKKIVWEKGTTGSNGQLN
             ||         : : ::: | |:| | |:  |:|||: :|||  : | :   :|  |:||::
gi-21909640. EQGQSGDMTIEEDSATHIKFSKRDIDG--KELAGATMELRDSSGKTI---STWISDGQVK
                340       350       360       370            380
```

Figure 57E

```
             940       950       960       970       980       990
gi-50913505. FKYLQKGKTYYLYETKAKLGYTLPENPWEVAVANNGDIKVKHPIEGELKSKDGSYMIKNY
               ||: || | : || |  ||       |||:| :  :: :  :  : |:  |:  |
gi-21909640. DFYLMPGK-YTFVETAAPDGY-------EVATAITFTVNEQGQVTVNGKATKGDAHIVMV
          390       400                410       420       430       440

             1000      1010      1020      1030
gi-50913505. KIYQLPSSGGRGSQIFIIVGSMTATVALLFYRRQHRKKQY
               |: |::|:
gi-21909640. DAYK-PTKGSGQVIDIEEKLPDEQGHSGSTTEIEDSKSSDVIIGGQGEVVDTTEDTQSGM
                   450       460       470       480       490       500


gi-50913505.pep
/home/morama/gas/pili/align/gi-13621428.pep

gi|13621428|gb|AAK33238.1| hypothetical protein [Streptococcus pyogenes]


SCORES   Init1: 33   Initn: 33   Opt: 91   z-score: 75.6  E(): 1.1
>>/home/morama/gas/pili/align/gi-13621428.pep              (340 aa)
 initn:  33 init1:  33 opt:  91 Z-score: 75.6 expect():  1.1
Smith-Waterman score: 95;    19.9% identity in 271 aa overlap
 (568-819:57-318)

             540       550       560       570       580       590
gi-50913505. NKLSVIGFQGSADYHAGKWYPDQSPRGGFYQPNLNNSRDAELLKGWSTNSLLDPNTLTAL
                                         :|: : ::|:: :|| : |: :    | |
gi-13621428. VNGAKLTVTKNLDLVNSNALIPNTDFTFKIEPDTTVNEDGNKFKGVALNTPMTKVTYTNS
               30        40        50        60        70        80

             600       610       620       630       640              650
gi-50913505. HNNGTNYHAALLKAKEILNEVKDDGRRKIMIFISDGVPTFYFGEDGYR-------SGNGS
             ::|:| ::| :  :|:  |        |:     | ||   :   :|         : : :
gi-13621428. DKGGSNTKTAEFDFSEVTFEKPGVYYYKVTEEKIDKVPGVSYDTTSYTVQVHVLWNEEQQ
               90        100       110       120       130       140

                    660       670       680       690        700
gi-50913505. SNDRNNVTRSQEGSKLAIDEFKARYPNLSIYSLGVSKDINSDTAS-SSPVVLKYLSGEEH
             :   : ::  :||||: | :||     :|:  :| |:| :::  :: |:    :      ::
gi-13621428. KPVATYIVGYKEGSKVPI-QFKN---SLDSTTLTVKKKVSGTGGDRSKDFNFGLTLKANQ
              150       160           170       180       190       200

          710       720           730          740       750
gi-50913505. YYGITDTAELEKTLN----KIVEDSKLSQL---GISDSLSQYVDYYDKQPDVLVT----R
             ||  :: : :|||  :      :  :::::||    ::|: |  |        | :||     :
gi-13621428. YYKASEKVMIEKTTKGGQAPVQTEASIDQLYHFTLKDGESIKVTNLPVGVDYVVTEDDYK
                   210       220       230       240       250       260

           760       770       780       790       800       810
gi-50913505. KSKVNDETEILYQKDQVQEAGKDIIDKVVFTPKTTSQPKGKVTLTFKSDYKVDDEYTYTL
             : | : ::|:  |      |:: : :  :: : | |  :       :|:| |:|::|      ::|:
gi-13621428. SEKYTTNVEVSPQDGAVKNIAGNSTEQETSTDKDMT-----ITFTNKKDFEVPTGVAMTV
                   270       280       290            300       310

           820       830       840       850       860       870
gi-50913505. SFNVKASDEAYEKYKDNEGRYSEMGDSDTDYGTNQTSSGKGGLPSNSDASVNYMADGREQ
             :
gi-13621428. APYIALGIVAVGGALYFVKKKNA
             320       330       340
```

Figure 57F

```
gi-50913505.pep
/home/morama/gas/pili/align/gi-50913506.pep

gi|50913506|ref|YP_059478.1| Fimbrial structural subunit [Streptococcus pyogenes
 MGAS10394]

SCORES    Init1:  70    Initn: 149    Opt:  86    z-score: 71.3  E(): 1.9
>>/home/morama/gas/pili/align/gi-50913506.pep            (556 aa)
 initn: 149 init1:  70 opt:  86 Z-score: 71.3 expect():  1.9
Smith-Waterman score: 120;   21.5% identity in 469 aa overlap
 (503-966:33-428)

                  480       490       500       510       520
gi-50913505. YSQWVYHGTFDYSSYQGESFNRGQIHYRYRGIVSVSDGIRRDDAVKNSLLGVNG-----L
                |::  ||  ::  :|||:::  ::  :::|         |
gi-50913506. NRRETVREKILITAKKLMLACLAILAVVGLGMTRVS-ALSKDDTAQLKITNIEGGPTVTL
                      10        20        30         40        50        60

                  530       540       550       560       570       580
gi-50913505. LQRFVNINPENKLSVIGFQGSADYHAGKWYPDQSPRGGFYQPNLNNSRDAELLKGWSTNS
                :   ::   |    |   |:|:      |   |    :  :| :      ::  |: ::    :|  :||::
gi-50913506. YKIGEGVYNTNGDSFINFK----YAEGVSLTETGPTSQEIT-TIANGINTGKIKPFSTEN
                         70        80            90       100       110

                  590       600       610       620       630       640
gi-50913505. LLDPNTLTALHNNGTNYHAALLKAKEILNEVKDDGRRKIMIFISDGVPTFYFGEDGYRSG
                :     |    :: :    |:: :   |||   :             |||     |:::         |  ||   :    :
gi-50913506. VSISNGTATYNARGASVYIALLTGAT-------DGRTYNPILLAAS----YNGEGNLVTK
                    120       130       140              150              160

                  650       660       670       680       690       700
gi-50913505. NGSSNDRNNVTRSQEGSKLAIDEFKARYPNLSIYSLGVSKDINSDTASSSPVVLKYLSGE
                |:|      ::|     :|     :::|          |:  |:::           |: :| |:::      :|  |:| |
gi-50913506. NIDS--KSNYLYGQ--TSVA----KSSLPSITKKVTGTIDDVNKKTTSLGSVLSYSLTFE
                        170          180            190       200       210

                  710       720       730       740       750       760
gi-50913505. EHYYGITDTAELEKTLNKIVEDSKLSQLGISDSLSQYVDYYDKQPDVLVTRKSKVNDETE
                |           :::: ||  |              :||::|: :   :   ::  |    |:|: :  ||
gi-50913506. LPSY-------TKEAVNKTVY--------VSDNMSEGLTF--NFNSLTVEWKGKMANITE
                  220              230               240         250       260

                  770       780       790       800       810       820
gi-50913505. ILYQKDQVQEAGKDIIDKVVFTPKTTSQPKGKVTLTFKSDYKVDDEYTYTLSFNVKASDE
                     |    |:: :|          :|:   |:: ::   |:        ::| |:
gi-50913506. ----------------DGSVMVENTKIGIAKEVNNGFNLSFIYDS--LESISPNI-----
                                          270       280       290

                  830       840       850       860       870       880
gi-50913505. AYEKYKDNEGRYSEMGDSDTDYGTNQTSSGKGGLPSNSDASVNYMADGREQKLPYKHPVI
                :|:    :|::  :| |: :    :::   |||  :|  |   | ::|  :|    |
gi-50913506. SYKAVVNNKAIVGEEGNPNKAEFFYSNNPTKGNTYDNLDKKPDK-GNGITSKEDSK----
                     300       310       320       330        340       350

                  890       900       910       920       930       940
gi-50913505. QVKTVPITFTKVDADNNQKKLAGVEFELRKEDKKIVWEKGTTGSNGQLNFKYLQKGKTYY
                ||   |:|  |||   ::    |  |:  |    :::|::  :   ||::||        :::||    |
gi-50913506. IVYTYQIAFRKVDS-VSKTPLIGAIFGVYDTSNKLI-DIVTTNKNGYAISTQVSSGK-YK
                     360       370        380       390       400
```

Figure 57G

```
              950       960       970       980       990      1000
gi-50913505. LYETKAKLGYTLPENPWEVAVANNGDIKVKHPIEGELKSKDGSYMIKNYKIYQLPSSGGR
             :  |  ||   ||:|   :  :|::
gi-50913506. IKELKAPKGYSLNTETYEITANWVTATVKTSANSKSTTYTSDKNKATDNSEQVGWLKNGI
              410       420       430       440       450       460

gi-50913505.pep
/home/morama/gas/pili/align/gi-13621432.pep

gi|13621432|gb|AAK33241.1| conserved hypothetical protein [Streptococcus pyogene
s]

SCORES   Init1: 40    Initn: 65    Opt: 78    z-score: 68.0   E(): 2.9
>>/home/morama/gas/pili/align/gi-13621432.pep           (450 aa)
 initn:  65 init1:  40 opt:  78 Z-score: 68.0 expect():  2.9
Smith-Waterman score: 78;   37.0% identity in 46 aa overlap
 (368-411:14-56)

              340       350       360       370       380       390
gi-50913505. KGHNNTINIYIRSTRPLGLKPIGAAPALIQPRSFRSLTPRSTRMK--RSAPVEKFEGELE
                                              |  :::|  | ::|  |:|  : :||  ||
gi-13621432.                  MTRTNYQKKRMTCPVETEDITYRRKKIKGRRQAILAQFEPELV
                              10        20        30        40

              400       410       420       430       440       450
gi-50913505. HHKRIDYLGDNQNNPDTTIDDKEDEHDTSDLYRLYLDMTGKKNPLDILVVVDKSGSMQEG
             ||: |   ||: : ||
gi-13621432. HHELI---GDSCTCPDCHGTLTEIGSVVQRQELVFIPAQLKRINHVQHAYKCQTCSDNSL
                50        60        70        80        90       100

gi-50913505.pep
/home/morama/gas/pili/align/gi-19745301.pep

gi|19745301|ref|NP_606437.1| putative collagen binding protein [Streptococcus py
ogenes MGAS8232]

SCORES   Init1: 52    Initn: 52    Opt: 73    z-score: 64.8   E(): 4.3
>>/home/morama/gas/pili/align/gi-19745301.pep           (524 aa)
 initn:  52 init1:  52 opt:  73 Z-score: 64.8 expect():  4.3
Smith-Waterman score: 95;   23.7% identity in 245 aa overlap
 (759-989:241-466)

              730       740       750       760       770       780
gi-50913505. DSKLSQLGISDSLSQYVDYYDKQPDVLVTRKSKVNDETEILYQKDQVQEAG-KDIIDKVV
                                     ::::|||  :|   :| | |   :|   |:::
gi-19745301. ETIDPDFNEGKEIKYTHILGADLFSYANNPRASTNDE--LLSQVKKVLEKGYRD--DSTT
                220       230       240       250       260

              790       800       810       820       830       840
gi-50913505. FTPKTTSQPKGKVTLT---FKSDYKVDD--EYTYTLSFNVKASDEAYEKYKDNEGRYSEM
             ::  |: : :: |:   |   | :: :|   :|    ::: :| | |   |  |   |  :
gi-19745301. YANLTSVEFRAATQLAIYYFTDSVDLDNLADYHGFGALTTEALNATKEIVAYAEDRANLP
               270       280       290       300       310       320

                               Figure 57H
```

```
                    850       860       870       880       890
gi-50913505. GDSDTDY---GTNQTSS--GKGGLPSNSDASVNYMADGREQKLPYKHPVIQVKTVPITFT
             : |: |:     ::|: :|  |     | :| :::  | |  :    :|  | :    |||  |:
gi-19745301. NISNLDFYVPNSNKYQSLIGTQYHP-ESLVDIIRMEDKQAPIIPITHKLTISKTVTGTI-
              330       340       350        360       370       380

             900       910       920       930        940       950
gi-50913505. KVDADNNQKKLAGVEFELRKEDKKIVWEKGTTGSN-GQLNFKYLQKGK-TYYLYETKAKL
                ||  :||  : |::|::  |  : :  :||  :| |:|:   :  || |: | : :: :
gi-19745301. ---AD--KKKEFNFEIHLKSSDGQAI--SGTYPTNSGELT---VTDGKATFTLKDGESLI
                    390       400        410        420       430

              960       970       980       990      1000      1010
gi-50913505. GYTLPEN-PWEVAVANNGDIKVKHPIEGELKSKDGSYMIKNYKIYQLPSSGGRGSQIFII
                || :  :|:: :: :|  :|:  ::|: :: ||:
gi-19745301. VEGLPSGYSYEITETGASDYEVS--VNGK-NAPDGKATKASVKEDETITFENRKDLVPPT
               440       450         460        470       480       490

               1020      1030
gi-50913505. VGSMTATVALLFYRRQHRKKQY

gi-19745301. GLTTDGAIYLWLLLLVLLGLWVWLIGRKGLKND
                   500       510       520


gi-50913505.pep
/home/morama/gas/pili/align/gas15.pep

GAS15 GAS15


SCORES   Init1: 43    Initn: 68    Opt: 69    z-score: 61.4  E(): 6.6
>>/home/morama/gas/pili/align/gas15.pep                   (762 aa)
 initn:  68 init1:  43 opt:  69 Z-score: 61.4 expect():  6.6
Smith-Waterman score: 100;    21.4% identity in 252 aa overlap
 (641-873:492-739)

                   620       630       640       650       660
gi-50913505. AKEILNEVKDDGRRKIMIFISDGVPTFYFGEDGYRSGNGSSNDRNNVTRSQ--EGSKLAI
                                           | |||  :|:: : :::|::|   :::|||
gas15.pep    HIAGRDLFKYTVKPRDTDPDTFLKHIKKVIEKGYRE-KGQAIEYSGLTETQLRAATQLAI
                   470       480       490        500       510       520

            670        680       690       700       710       720
gi-50913505. DEF--KARYPNLSIYSLGVSKDINSDTASSSPVVLKYLSGEEHYYGITDTAELEKTLNKI
               |  :|:  : :: :      |:|::|  : : ::::| : : :    :||    :  : ||
gas15.pep    YYFTDSAELDKDKLKDYHGFGDMNDSTLAVAKILVEY-AQDSNPPQLTDLDFFIPNNNKY
                    530       540       550        560       570

              730       740       750            760          770
gi-50913505. VEDSKLSQLGISDSLSQYVDYYDKQPDVLVT-----RKSKVN---DETEILYQKDQVQEA
               :| ::      ::| : : : ||:  : ||       ||: ::   |:|: :: : ::::
gas15.pep    --QSLIGTQWHPEDLVDIIRMEDKKEVIPVTHNLTLRKTVTGLAGDRTKDFHFEIELKNN
             580       590       600       610       620       630

            780       790        800       810        820       830
gi-50913505. GKDIIDKVVFTPKTTSQPK-GKVTLTFKSDYKVDDE-YTYTLSFNVKASDEAYEKYKDNE
              :::::::| | ||: : |  ||:|:::|    ::  :          |: || :|     | | |
gas15.pep    KQELLSQTVKTDKTNLEFKDGKATINLKHGESLTLQGLPEGYSYLVKETDSEGYKVKVNS
             640       650       660       670       680       690
```

Figure 57I

```
                840       850            860       870         880       890
gi-50913505. GRYSEMGDSDTDYGTNQT----SSGKGGLPSNSDASVN-YMADGREQKLPYKHPVIQVKT
              : ::    | |    :::|     :: :   :|:: | ::| |:|
gas15.pep    QEVANATVSKTGITSDETLAFENNKEPVVPTGVDQKINGYLALIVIAGISLGIWGIHTIR
             700       710       720       730       740       750

                  900       910       920       930       940       950
gi-50913505. VPITFTKVDADNNQKKLAGVEFELRKEDKKIVWEKGTTGSNGQLNFKYLQKGKTYYLYET

gas15.pep    IRKHD
             760
```

gi-50913505.pep
/home/morama/gas/pili/align/gi-21909636.pep gi|21909636|ref|NP_663904.1| conserved hypothetical protein [Streptococcus pyoge nes MGAS315]

```
SCORES   Init1: 31   Initn: 31   Opt: 62   z-score: 60.8  E(): 7.1
>>/home/morama/gas/pili/align/gi-21909636.pep            (344 aa)
 initn:  31 init1:  31 opt:  62 Z-score: 60.8 expect():  7.1
Smith-Waterman score: 71;    22.9% identity in 131 aa overlap
 (181-305:176-298)

                   160       170       180       190       200       210
gi-50913505. DITTTLTFKNGLSLEGASTEANDPNVRVGIVNPNDTVQTITPTIKQDADGKVKNLVFTGR
                                                ||  |::  |  :  :|::::|:       ||:
gi-21909636. VDVYVGNKEGGGFEPKFIVSKEQGTDVKKPVNFNNSFATTSLKVKKNVSGN------TGE
               150       160       170       180       190

                       220       230       240       250       260
gi-50913505. LGKQ----VIIVSTTRLKEEQTISLDSYGELVIDGAVGLSQKDRPPYSKPITVNILKPKL
             | |:     : :  :| :|::| :||:: |:  ::  :|    | :   :: | :: |    :
gi-21909636. LQKEFDFTLTLNESTNFKKDQIVSLQK-GNEKFEVKIGTPYKFKLKNGESIQLDKLPVGI
           200       210       220        230       240       250

                270       280       290        300       310       320
gi-50913505. SSIESSLDSKDFEIVKTIDNLYTWDDQ--FYLLDFISKQYEVLKTDYQSAKDSTPQTRDI
             :   : ::::  :   ||  :|    | |   :| ||: :|   |
gi-21909636. TYKVNEMEANK-DGYKTTASLKEGDGQSKMYQLDMEQKTDESADEIVVTNKRDTQVPTGV
              260        270       280       290       300       310

                 330       340       350       360       370       380
gi-50913505. LFGEYTVEPLVMNKGHNNTINIYIRSTRPLGLKPIGAAPALIQPRSFRSLTPRSTRMKRS

gi-21909636. VGTLAPFAVLSIVAIGGVIYITKRKKA
             320       330       340
```

gi-50913505.pep
/home/morama/gas/pili/align/gi-28810259.pep gi|28810259|dbj|BAC63197.1| hypothetical protein [Streptococcus pyogenes SSI-1]

```
SCORES   Init1: 31   Initn: 31   Opt: 62   z-score: 60.7  E(): 7.2
>>/home/morama/gas/pili/align/gi-28810259.pep            (349 aa)
 initn:  31 init1:  31 opt:  62 Z-score: 60.7 expect():  7.2
```

Figure 57J

```
Smith-Waterman score: 71;    22.9% identity in 131 aa overlap
 (181-305:181-303)

                    160       170       180       190       200       210
gi-50913505. DITTTLTFKNGLSLEGASTEANDPNVRVGIVNPNDTVQTITPTIKQDADGKVKNLVFTGR
                                        || |::  |  :  :|::::|:        ||:
gi-28810259. VDVYVGNKEGGGFEPKFIVSKEQGTDVKKPVNFNNSFATTSLKVKKNVSGN------TGE
                    160       170       180       190       200

                       220       230       240       250       260
gi-50913505. LGKQ----VIIVSTTRLKEEQTISLDSYGELVIDGAVGLSQKDRPPYSKPITVNILKPKL
             | |:     : :  :| :|::| :||:: |:  ::  :|    | :   :: | :: |   :
gi-28810259. LQKEFDFTLTLNESTNFKKDQIVSLQK-GNEKFEVKIGTPYKFKLKNGESIQLDKLPVGI
               210       220       230        240       250       260

              270       280       290        300       310       320
gi-50913505. SSIESSLDSKDFEIVKTIDNLYTWDDQ--FYLLDFISKQYEVLKTDYQSAKDSTPQTRDI
             :   : ::::  :   ||  :|    |  |   :| ||: :|  |
gi-28810259. TYKVNEMEANK-DGYKTTASLKEGDGQSKMYQLDMEQKTDESADEIVVTNKRDTQVPTGV
                270       280       290       300       310       320

                330       340       350       360       370       380
gi-50913505. LFGEYTVEPLVMNKGHNNTINIYIRSTRPLGLKPIGAAPALIQPRSFRSLTPRSTRMKRS

gi-28810259. VGTLAPFAVLSIVAIGGVIYITKRKKA
                 330       340


gi-50913505.pep
/home/morama/gas/pili/align/gi-19224139.pep

gi|19224139|gb|AAL86410.1|AF447492_7 unknown [Streptococcus pyogenes]


SCORES   Init1: 43   Initn: 43   Opt: 54   z-score: 58.9  E(): 8.9
>>/home/morama/gas/pili/align/gi-19224139.pep          (189 aa)
 initn:  43 init1:  43 opt:  54 Z-score: 58.9 expect():  8.9
Smith-Waterman score: 54;    31.6% identity in 57 aa overlap
 (742-796:90-143)

                   720       730       740       750         760
gi-50913505. GITDTAELEKTLNKIVEDSKLSQLGISDSLSQYVDYYDKQP--DVLVTRKSKVNDETEIL
                                        || ||       ||||     : ||   |
gi-19224139. ITIAGSGKASFSPLTFTTVGQYTYRVYQKPSQNKDYQADTTVFDVLVYV---TYDEDGTL
           60        70        80        90       100          110

          770       780       790       800       810       820
gi-50913505. YQKDQVQEAGKDIIDKVVFTPKTTSQPKGKVTLTFKSDYKVDDEYTYTLSFNVKASDEAY
               |   ::||  :  : ::| ||   :|
gi-19224139. VAKVISRRAGDEEKSAITFKPKRLVKPIPPRQPNIPKTPLPLAGEVKSLLGILSIVLLGL
              120       130       140       150       160       170


gi-50913505.pep
/home/morama/gas/pili/align/gi-19745305.pep

gi|19745305|ref|NP_606441.1| hypothetical protein [Streptococcus pyogenes MGAS82
32]
```

Figure 57K

```
SCORES    Init1: 43    Initn: 43    Opt: 54    z-score: 58.8    E(): 9
>>/home/morama/gas/pili/align/gi-19745305.pep                (195 aa)
 initn: 43 init1: 43 opt: 54 Z-score: 58.8 expect():    9
Smith-Waterman score: 54;    31.6% identity in 57 aa overlap
 (742-796:96-149)

                720       730       740       750       760
gi-50913505. GITDTAELEKTLNKIVEDSKLSQLGISDSLSQYVDYYDKQP--DVLVTRKSKVNDETEIL
                            ||  ||         ||||       :  ||    |
gi-19745305. ITIAGSGKASFSPLTFTTVGQYTYRVYQKPSQNKDYQADTTVFDVLVYV---TYDEDGTL
            70        80        90        100       110       120

                770       780       790       800       810       820
gi-50913505. YQKDQVQEAGKDIIDKVVFTPKTTSQPKGKVTLTFKSDYKVDDEYTYTLSFNVKASDEAY
                |   ::||  :  :  :::|  ||       :|
gi-19745305. VAKVISRRAGDEEKSAITFKPKRLVKPIPPRQPDIPKTPLPLAGEVKSLLGILSIVLLGL
            130       140       150       160       170       180

gi-50913505.pep
/home/morama/gas/pili/align/orf82.pep

TRANSLATE of: orf82.seq check: 4296 from: 1 to: 672
generated symbols 1 to: 224.
 GETSEQ from morama, September 13, 2004 17:09.

SCORES    Init1: 43    Initn: 43    Opt: 54    z-score: 58.2    E(): 9.6
>>/home/morama/gas/pili/align/orf82.pep                      (224 aa)
 initn: 43 init1: 43 opt: 54 Z-score: 58.2 expect():    9.6
Smith-Waterman score: 54;    31.6% identity in 57 aa overlap
 (742-796:125-178)

                720       730       740       750       760
gi-50913505. GITDTAELEKTLNKIVEDSKLSQLGISDSLSQYVDYYDKQP--DVLVTRKSKVNDETEIL
                            ||  ||         ||||       :  ||    |
orf82.pep    ITIAGSGKASFSPLTFTTVGQYTYRVYQKPSQNKDYQADTTVFDVLVYV---TYDEDGTL
            100       110       120       130       140       150

                770       780       790       800       810       820
gi-50913505. YQKDQVQEAGKDIIDKVVFTPKTTSQPKGKVTLTFKSDYKVDDEYTYTLSFNVKASDEAY
                |   ::||  :  :  :::|  ||       :|
orf82.pep    VAKVISRRAGDEEKSAITFKPKRLVKPIPPRQPNIPKTPLPLAGEVKSLLGILSIVLLGL
            160       170       180       190       200       210

gi-50913505.pep
/home/morama/gas/pili/align/gi-21909638.pep

gi|21909638|ref|NP_663906.1| hypothetical protein [Streptococcus pyogenes MGAS31
5]

SCORES    Init1: 43    Initn: 43    Opt: 52    z-score: 58.0    E(): 9.9
>>/home/morama/gas/pili/align/gi-21909638.pep                (183 aa)
 initn: 43 init1: 43 opt: 52 Z-score: 58.0 expect():    9.9
Smith-Waterman score: 52;    31.6% identity in 57 aa overlap
 (742-796:84-137)
```

Figure 57L

```
                    720       730       740       750         760
gi-50913505. GITDTAELEKTLNKIVEDSKLSQLGISDSLSQYVDYYDKQP--DVLVTRKSKVNDETEIL
                                        ||  ||        ||||     : ||    |
gi-21909638. ITIAGSGKASFSPLTFTTVGQYTYRVYQKPSQNKDYQADTTVFDVLVYV---TYDEDGTL
                   60        70        80        90       100          110

            770       780       790       800       810       820
gi-50913505. YQKDQVQEAGKDIIDKVVFTPKTTSQPKGKVTLTFKSDYKVDDEYTYTLSFNVKASDEAY
               |   ::|| :   : ::| ||   :|
gi-21909638. VAKVISRRAGDEEKSAITFKPKWLVKPIPPRQPNIPKTPLPLAGEVKSLLGILSIVLLGL
                     120       130       140       150       160       170


! Distributed over 1 thread.
!      Start time: Wed Sep 15 18:46:18 2004
! Completion time: Wed Sep 15 18:46:21 2004

! CPU time used:
!         Database scan:  0:00:00.1
! Post-scan processing:  0:00:02.2
!        Total CPU time:  0:00:02.3
! Output File: gi-50913505.fasta
```

Figure 57M

```
!!SEQUENCE_LIST 1.0


(Peptide) FASTA of: gi-50913506.pep  from: 1 to: 556  September 15, 2004 18:45

gi|50913506|ref|YP_059478.1| Fimbrial structural subunit [Streptococcus pyogenes
 MGAS10394]

 TO: *.pep  Sequences:         56  Symbols:        22,803  Word Size: 2

 Scoring matrix: GenRunData:blosum50.cmp
 Variable pamfactor used
 Gap creation penalty: 12  Gap extension penalty: 2



Histogram Key:
 Each histogram symbol represents 1 search set sequences
 z-scores computed from opt scores

z-score obs    exp
        (=)    (*)

< 20       0      0:
  22       0      0:
  24       0      0:
  26       0      0:
  28       0      0:
  30       0      0:
  32       0      0:
  34       0      1:*
  36       0      2: *
  38       0      3:  *
  40       0      4:   *
  42       0      5:    *
  44       0      5:    *
  46       1      5:=   *
  48       8      5:====*===
  50      24      5:====*===================
  52       2      4:== *
  54       3      3:==*
  56       1      3:= *
  58       2      2:=*
  60       3      2:=*=
  62       0      2: *
  64       2      1:*=
  66       2      1:*=
  68       1      1:*
  70       2      1:*=
  72       0      0:
  74       3      0:===
  76       1      0:=
  78       0      0:
  80       0      0:
  82       0      0:
  84       0      0:
  86       0      0:
  88       0      0:
  90       0      0:
  92       0      0:
  94       0      0:
  96       0      0:
```

```
 98       0       0:
 100      0       0:
 102      0       0:
 104      0       0:
 106      0       0:
 108      0       0:
 110      0       0:
 112      0       0:
 114      0       0:
 116      0       0:
 118      0       0:
>120      1       0:=

Joining threshold: 37, opt. threshold: 25, opt. width:  16, reg.-scaled


The best scores are:                    init1 initn   opt    z-sc E(55)..

/home/morama/gas/pili/align/gi-50913506.pep    Begin: 1  End: 556
! gi|50913506|ref|YP_059478.1| Fimbri... 3454  3454  3454  1016.2  4.7e-53
/home/morama/gas/pili/align/orf84.pep    Begin: 316  End: 567
! TRANSLATE of: orf84.seq check: 7868...   57    83   135    75.1     1.2
/home/morama/gas/pili/align/gi-19745307.pep    Begin: 316  End: 567
! gi|19745307|ref|NP_606443.1| protei...   57    83   135    75.1     1.2
/home/morama/gas/pili/align/gi-21909640.pep    Begin: 202  End: 524
! gi|21909640|ref|NP_663908.1| protei...   56    81   134    75.0     1.2
/home/morama/gas/pili/align/gi-28810263.pep    Begin: 316  End: 638
! gi|28810263|dbj|BAC63201.1| protein...   56    82   134    74.7     1.3
/home/morama/gas/pili/align/orf80.pep    Begin: 49  End: 352
! TRANSLATE of: orf80.seq check: 9824...   45    69   113    70.8     2.1
/home/morama/gas/pili/align/gi-19224137.pep    Begin: 25  End: 342
! gi|19224137|gb|AAL86408.1|AF447492_...   45    69   109    69.8     2.4
/home/morama/gas/pili/align/gi-19224141.pep    Begin: 277  End: 645
! gi|19224141|gb|AAL86412.1|AF447492_...   73    73   118    68.9     2.7
/home/morama/gas/pili/align/gi-21909636.pep    Begin: 44  End: 344
! gi|21909636|ref|NP_663904.1| conser...   45    98    96    66.1     3.8
/home/morama/gas/pili/align/gi-28810259.pep    Begin: 49  End: 349
! gi|28810259|dbj|BAC63197.1| hypothe...   45    98    96    66.0     3.8
/home/morama/gas/pili/align/gas15.pep    Begin: 222  End: 470
! GAS15 GAS15                              42    68    96    63.8       5
/home/morama/gas/pili/align/gi-13621428.pep    Begin: 17  End: 340
! gi|13621428|gb|AAK33238.1| hypothet...   41    41    87    63.6     5.2
/home/morama/gas/pili/align/gi-19224135.pep    Begin: 193  End: 462
! gi|19224135|gb|AAL86406.1|AF447492_...   41    41    86    61.0       7
/home/morama/gas/pili/align/gi-50913505.pep    Begin: 503  End: 966
! gi|50913505|ref|YP_059477.1| Collag...   70   149    86    60.1     7.8
/home/morama/gas/pili/align/gi-13621430.pep    Begin: 60  End: 143
! gi|13621430|gb|AAK33240.1| hypothet...   43    67    67    59.2     8.7
/home/morama/gas/pili/align/gi-19745303.pep    Begin: 44  End: 344
! gi|19745303|ref|NP_606439.1| hypoth...   51   106    69    58.4     9.5
\\End of List


gi-50913506.pep
/home/morama/gas/pili/align/gi-50913506.pep

gi|50913506|ref|YP_059478.1| Fimbrial structural subunit [Streptococcus pyogenes
 MGAS10394]
```

Figure 58B

```
SCORES   Init1: 3454  Initn: 3454  Opt: 3454  z-score: 1016.2 E(): 4.7e-53
>>/home/morama/gas/pili/align/gi-50913506.pep           (556 aa)
 initn: 3454 init1: 3454 opt: 3454 Z-score: 1016.2 expect(): 4.7e-53
Smith-Waterman score: 3454;   100.0% identity in 556 aa overlap
 (1-556:1-556)

                       10        20        30        40        50        60
gi-50913506. MTNRRETVREKILITAKKLMLACLAILAVVGLGMTRVSALSKDDTAQLKITNIEGGPTVT
             ||||||||||||||||||||||||||||||||||||||||||||||||||||||||||||
gi-50913506. MTNRRETVREKILITAKKLMLACLAILAVVGLGMTRVSALSKDDTAQLKITNIEGGPTVT
                       10        20        30        40        50        60

                       70        80        90       100       110       120
gi-50913506. LYKIGEGVYNTNGDSFINFKYAEGVSLTETGPTSQEITTIANGINTGKIKPFSTENVSIS
             ||||||||||||||||||||||||||||||||||||||||||||||||||||||||||||
gi-50913506. LYKIGEGVYNTNGDSFINFKYAEGVSLTETGPTSQEITTIANGINTGKIKPFSTENVSIS
                       70        80        90       100       110       120

                      130       140       150       160       170       180
gi-50913506. NGTATYNARGASVYIALLTGATDGRTYNPILLAASYNGEGNLVTKNIDSKSNYLYGQTSV
             ||||||||||||||||||||||||||||||||||||||||||||||||||||||||||||
gi-50913506. NGTATYNARGASVYIALLTGATDGRTYNPILLAASYNGEGNLVTKNIDSKSNYLYGQTSV
                      130       140       150       160       170       180

                      190       200       210       220       230       240
gi-50913506. AKSSLPSITKKVTGTIDDVNKKTTSLGSVLSYSLTFELPSYTKEAVNKTVYVSDNMSEGL
             ||||||||||||||||||||||||||||||||||||||||||||||||||||||||||||
gi-50913506. AKSSLPSITKKVTGTIDDVNKKTTSLGSVLSYSLTFELPSYTKEAVNKTVYVSDNMSEGL
                      190       200       210       220       230       240

                      250       260       270       280       290       300
gi-50913506. TFNFNSLTVEWKGKMANITEDGSVMVENTKIGIAKEVNNGFNLSFIYDSLESISPNISYK
             ||||||||||||||||||||||||||||||||||||||||||||||||||||||||||||
gi-50913506. TFNFNSLTVEWKGKMANITEDGSVMVENTKIGIAKEVNNGFNLSFIYDSLESISPNISYK
                      250       260       270       280       290       300

                      310       320       330       340       350       360
gi-50913506. AVVNNKAIVGEEGNPNKAEFFYSNNPTKGNTYDNLDKKPDKGNGITSKEDSKIVYTYQIA
             ||||||||||||||||||||||||||||||||||||||||||||||||||||||||||||
gi-50913506. AVVNNKAIVGEEGNPNKAEFFYSNNPTKGNTYDNLDKKPDKGNGITSKEDSKIVYTYQIA
                      310       320       330       340       350       360

                      370       380       390       400       410       420
gi-50913506. FRKVDSVSKTPLIGAIFGVYDTSNKLIDIVTTNKNGYAISTQVSSGKYKIKELKAPKGYS
             ||||||||||||||||||||||||||||||||||||||||||||||||||||||||||||
gi-50913506. FRKVDSVSKTPLIGAIFGVYDTSNKLIDIVTTNKNGYAISTQVSSGKYKIKELKAPKGYS
                      370       380       390       400       410       420

                      430       440       450       460       470       480
gi-50913506. LNTETYEITANWVTATVKTSANSKSTTYTSDKNKATDNSEQVGWLKNGIFYSIDSRPTGN
             ||||||||||||||||||||||||||||||||||||||||||||||||||||||||||||
gi-50913506. LNTETYEITANWVTATVKTSANSKSTTYTSDKNKATDNSEQVGWLKNGIFYSIDSRPTGN
                      430       440       450       460       470       480

                      490       500       510       520       530       540
gi-50913506. DVKEAYIESTKALTDGTTFSKSNEGSGTVLLETDIPNTKLGELPSTGSIGTYLFKAIGSA
             ||||||||||||||||||||||||||||||||||||||||||||||||||||||||||||
gi-50913506. DVKEAYIESTKALTDGTTFSKSNEGSGTVLLETDIPNTKLGELPSTGSIGTYLFKAIGSA
                      490       500       510       520       530       540
```

Figure 58C

```
                    550
gi-50913506. AMIGAIGIYIVKRRKA
             ||||||||||||||||
gi-50913506. AMIGAIGIYIVKRRKA
                    550


gi-50913506.pep
/home/morama/gas/pili/align/orf84.pep

TRANSLATE of: orf84.seq check: 7868 from: 1 to: 2088
generated symbols 1 to: 696.
 GETSEQ from morama, September 13, 2004 17:07.


SCORES   Init1: 57   Initn: 83   Opt: 135   z-score: 75.1  E(): 1.2
>>/home/morama/gas/pili/align/orf84.pep                   (696 aa)
 initn:  83 init1:  57 opt: 135 Z-score: 75.1 expect():  1.2
Smith-Waterman score: 146;    24.4% identity in 262 aa overlap
 (232-462:316-567)

                   210       220       230       240       250
gi-50913506. KTTSLGSVLSYSLTFELPSYTKEAVNKTVYVSDNMSEGLTFNFNSLTVEWKGKMAN----
                                           |:|:  :|::: ::   |: :|:: :
orf84.pep    EKEVAVDDAELKQINSEGQQEISVTWTNQLVTDE--KGMAYIYSVKEVDKNGELLEPKDY
               290       300       310         320       330       340

             260       270       280            290       300       310
gi-50913506. ITEDGSVMVENTKIGIAKEVNNGFNLSFIY-----DSLESISPNISYKAVVNNKAIVGEE
             | :: :: | || :    | ::: :::    :      |    |: :|:|   ::   :  |  |  ||:
orf84.pep    IKKEDGLTVTNTYV---KPTSGHYDIEVTFGNGHIDITEDTTPDI-VSGENQMKQIEGED
                 350          360       370       380        390

                         320            330         340       350
gi-50913506. GNP-------NKAEFFYSNNP-----TKGNTYDNL-DKKP-DKGNGITSKEDSKIVYTYQ
             ::|       |  ||  :: |     |::| |::: |::| |   :|::|:: ::  :| :
orf84.pep    SKPIDEVTENNLIEFGKNTMPGEEDGTNSNKYEEVEDSRPVDTLSGLSSEQGQSGDMTIE
           400       410       420       430       440       450

                  360       370       380       390       400       410
gi-50913506. ------IAFRKVDSVSKTPLIGAIFGVYDTSNKLIDIVTTNKNGYAISTQVSSGKYKIKE
                   | | |  | ::    | ||  : :  |:|:| |:   |   ::| : :   :   ||| : |
orf84.pep    EDSATHIKFSKRD-IDGKELAGATMELRDSSGKTIS--TWISDGQVKDFYLMPGKYTFVE
           460       470        480       490         500       510

                  420        430        440       450       460       470
gi-50913506. LKAPKGYSLNTE-TYEITAN-WVTATVKTSANSKSTTYTSDKNKATDNSEQVGWLKNGIF
               || || :  |   |: :: :   ||:: |:: ::    ::: |   |  | :| ||
orf84.pep    TAAPDGYEIATAITFTVNEQGQVTVNGKATKGDAHIVMV-DAYKPTKGSGQVIDIEEKLP
              520       530       540       550        560       570

                    480       490       500       510       520       530
gi-50913506. YSIDSRPTGNDVKEAYIESTKALTDGTTFSKSNEGSGTVLLETDIPNTKLGELPSTGSIG

orf84.pep    DEQGHSGSTTEIEDSKSSDVIIGGQGQIVETTEDTQTGMHGDSGCKTEVEDTKLVQSFHF
               580       590       600       610       620       630
```

Figure 58D

```
gi-50913506.pep
/home/morama/gas/pili/align/gi-19745307.pep

gi|19745307|ref|NP_606443.1| protein F2-like protein [Streptococcus pyogenes MGA
S8232]


SCORES   Init1: 57    Initn: 83    Opt: 135   z-score: 75.1  E(): 1.2
>>/home/morama/gas/pili/align/gi-19745307.pep            (696 aa)
 initn:  83 init1:  57 opt: 135 Z-score: 75.1 expect():  1.2
Smith-Waterman score: 146;    24.4% identity in 262 aa overlap
 (232-462:316-567)

                  210       220       230       240       250
gi-50913506. KTTSLGSVLSYSLTFELPSYTKEAVNKTVYVSDNMSEGLTFNFNSLTVEWKGKMAN----
                                         |:|:  :|::: ::   |: :|:: :
gi-19745307. EKEVAVDDAELKQINSEGQQEISVTWTNQLVTDE--KGMAYIYSVKEVDKNGELLEPKDY
                290       300       310         320       330       340

             260       270       280            290       300       310
gi-50913506. ITEDGSVMVENTKIGIAKEVNNGFNLSFIY-----DSLESISPNISYKAVVNNKAIVGEE
             | :: :: | || :   | ::: :::   :     |  |: :|:|   ::  : | | ||:
gi-19745307. IKKEDGLTVTNTYV---KPTSGHYDIEVTFGNGHIDITEDTTPDI-VSGENQMKQIEGED
                 350          360       370       380       390

                       320            330        340       350
gi-50913506. GNP-------NKAEFFYSNNP-----TKGNTYDNL-DKKP-DKGNGITSKEDSKIVYTYQ
             ::|        |  ||  :: |      |::| |::: |::| |  :|::|:: ::  :| :
gi-19745307. SKPIDEVTENNLIEFGKNTMPGEEDGTNSNKYEEVEDSRPVDTLSGLSSEQGQSGDMTIE
           400       410       420       430       440       450

                 360       370       380       390       400       410
gi-50913506. ------IAFRKVDSVSKTPLIGAIFGVYDTSNKLIDIVTTNKNGYAISTQVSSGKYKIKE
                   | | | | ::    | || : : |:|:| |:  |   ::| : :  :   ||| : |
gi-19745307. EDSATHIKFSKRD-IDGKELAGATMELRDSSGKTIS--TWISDGQVKDFYLMPGKYTFVE
           460       470        480       490         500       510

                 420        430       440       450       460       470
gi-50913506. LKAPKGYSLNTE-TYEITAN-WVTATVKTSANSKSTTYTSDKNKATDNSEQVGWLKNGIF
              || || :  |   |: :: :   ||:: |:: ::    ::: |   |  | :| ||
gi-19745307. TAAPDGYEIATAITFTVNEQGQVTVNGKATKGDAHIVMV-DAYKPTKGSGQVIDIEEKLP
               520       530       540       550        560       570

                   480       490       500       510       520       530
gi-50913506. YSIDSRPTGNDVKEAYIESTKALTDGTTFSKSNEGSGTVLLETDIPNTKLGELPSTGSIG

gi-19745307. DEQGHSGSTTEIEDSKSSDVIIGGQGQIVETTEDTQTGMHGDSGCKTEVEDTKLVQSFHF
                580       590       600       610       620       630


gi-50913506.pep
/home/morama/gas/pili/align/gi-21909640.pep

gi|21909640|ref|NP_663908.1| protein F2 like fibronectin-binding protein [Strept
ococcus pyogenes MGAS315]


SCORES   Init1: 56    Initn: 81    Opt: 134   z-score: 75.0  E(): 1.2
>>/home/morama/gas/pili/align/gi-21909640.pep            (656 aa)
 initn:  81 init1:  56 opt: 134 Z-score: 75.0 expect():  1.2
```

Figure 58E

```
Smith-Waterman score: 156;    23.9% identity in 347 aa overlap
 (232-547:202-524)

                    210       220       230       240       250
gi-50913506. KTTSLGSVLSYSLTFELPSYTKEAVNKTVYVSDNMSEGLTFNFNSLTVEWKGKMAN----
                                                |:|:  :|::: ::   |: :|:: :
gi-21909640. EKEVAVDDAELKQINSEGQQEISVTWTNQLVTDE--KGMAYIYSVKEVDKNGELLEPKDY
                    180       190       200         210       220

              260       270       280            290       300       310
gi-50913506. ITEDGSVMVENTKIGIAKEVNNGFNLSFIY-----DSLESISPNISYKAVVNNKAIVGEE
             | :: :: | || :     | ::: :::   :     |   |: :|:|   ::  : | | ||:
gi-21909640. IKKEDGLTVTNTYV---KPTSGHYDIEVTFGNGHIDITEDTTPDI-VSGENQMKQIEGED
          230       240          250       260       270        280

                         320            330        340       350
gi-50913506. GNP-------NKAEFFYSNNP-----TKGNTYDNL-DKKP-DKGNGITSKEDSKIVYTYQ
             ::|        |  ||  :: |      |::| |::: |::| |   :|::|:: ::  :| :
gi-21909640. SKPIDEVTENNLIEFGKNTMPGEEDGTNSNKYEEVEDSRPVDTLSGLSSEQGQSGDMTIE
               290       300       310       320       330       340

                  360       370       380       390       400       410
gi-50913506. ------IAFRKVDSVSKTPLIGAIFGVYDTSNKLIDIVTTNKNGYAISTQVSSGKYKIKE
                   | | | | ::     | ||  : :  |:|:| |:   |   ::| : :   :   ||| : |
gi-21909640. EDSATHIKFSKRD-IDGKELAGATMELRDSSGKTIS--TWISDGQVKDFYLMPGKYTFVE
               350        360       370       380         390       400

                  420        430        440       450       460       470
gi-50913506. LKAPKGYSLNTE-TYEITAN-WVTATVKTSANSKSTTYTSDKNKATDNSEQVGWLKNGIF
                || || : |   |: :: :  ||:: |:: ::    ::: |   | | :| ||
gi-21909640. TAAPDGYEVATAITFTVNEQGQVTVNGKATKGDAHIVMV-DAYKPTKGSGQV--------
                  410       420       430       440        450

                    480       490       500       510       520       530
gi-50913506. YSIDSRPTGNDVKEAYIESTKALTDGTTFSKSNEGSGTVLLETDIPNTKLGELPSTGSIG
                || :     | ::::  ||   :  |: : :      |:| |:   |:   :|: |     :||
gi-21909640. --IDIEEKLPD-EQGHSGSTTEIEDSKSSDVIIGGQGEVVDTTE--DTQSGMTGHSGST-
                    460       470       480       490         500

                    540       550
gi-50913506. TYLFKAIGSAAMIGAIGIYIVKRRKA
             | :   : :|  ::||: |
gi-21909640. TEIEDSKSSDVIIGGQGEVVDTTEDTQSGMTGHSGSTTKIEDSKSSDVIVGGQGQIVETT
             510       520       530       540       550       560


gi-50913506.pep
/home/morama/gas/pili/align/gi-28810263.pep

gi|28810263|dbj|BAC63201.1| protein F2-like protein [Streptococcus pyogenes SSI-
1]


SCORES   Init1: 56   Initn: 82   Opt: 134   z-score: 74.7  E(): 1.3
>>/home/morama/gas/pili/align/gi-28810263.pep            (733 aa)
 initn:  82 init1:  56 opt: 134 Z-score: 74.7 expect():  1.3
Smith-Waterman score: 155;    23.6% identity in 347 aa overlap
 (232-547:316-638)
```

Figure 58F

```
                     210       220       230       240       250
gi-50913506. KTTSLGSVLSYSLTFELPSYTKEAVNKTVYVSDNMSEGLTFNFNSLTVEWKGKMAN----
                                         |:|:  :|::: ::   |: :|:: :
gi-28810263. EKEVAVDDAELKQINSEGQQEISVTWTNQLVTDE--KGMAYIYSVKEVDKNGELLEPKDY
               290       300       310         320       330       340

             260       270       280              290       300       310
gi-50913506. ITEDGSVMVENTKIGIAKEVNNGFNLSFIY-----DSLESISPNISYKAVVNNKAIVGEE
             | :: :: | || :   | ::: :::   :      |  |: :|:|   ::  :  | | ||:
gi-28810263. IKKEDGLTVTNTYV---KPTSGHYDIEVTFGNGHIDITEDTTPDI-VSGENQMKQIEGED
                 350          360       370       380        390

                         320            330         340       350
gi-50913506. GNP-------NKAEFFYSNNP-----TKGNTYDNL-DKKP-DKGNGITSKEDSKIVYTYQ
             ::|        |  ||  :: |     |::| |::: |::| |  :|::|:: ::  :| :
gi-28810263. SKPIDEVTENNLIEFGKNTMPGEEDGTNSNKYEEVEDSRPVDTLSGLSSEQGQSGDMTIE
           400       410       420       430       440       450

                  360       370       380       390       400       410
gi-50913506. ------IAFRKVDSVSKTPLIGAIFGVYDTSNKLIDIVTTNKNGYAISTQVSSGKYKIKE
                   | | | | ::    | || : : |:|:| |:  |   ::| : :   :  ||| : |
gi-28810263. EDSATHIKFSKRD-IDGKELAGATMELRDSSGKTIS--TWISDGQVKDFYLMPGKYTFVE
           460       470       480       490         500       510

                  420          430         440       450       460       470
gi-50913506. LKAPKGYSLNTE-TYEITAN-WVTATVKTSANSKSTTYTSDKNKATDNSEQVGWLKNGIF
              || || : |   |: :: :   ||:: |:: ::     ::: |   |  | :| ||
gi-28810263. TAAPDGYEVATAITFTVNEQGQVTVNGKATKGDAHIVMV-DAYKPTKGSGQV--------
              520       530       540       550        560

                    480       490       500       510       520       530
gi-50913506. YSIDSRPTGNDVKEAYIESTKALTDGTTFSKSNEGSGTVLLETDIPNTKLGELPSTGSIG
               || :    | ::::  ||  : |: : :    |:| |:  |:  :|: |     :||
gi-28810263. --IDIEEKLPD-EQGHSGSTTEIEDSKSSDVIIGGQGEVVDTTE--DTQSGMTGHSGST-
               570       580       590       600         610       620

                    540       550
gi-50913506. TYLFKAIGSAAMIGAIGIYIVKRRKA
             | :  : :| :::|: |
gi-28810263. TKIEDSKSSDVIVGGQGQIVETTEDTQTGMHGDSGRKTEVEDTKLVQSFHFDNKEPESNS
                   630       640       650       660       670       680


gi-50913506.pep
/home/morama/gas/pili/align/orf80.pep

TRANSLATE of: orf80.seq check: 9824 from: 1 to: 1056
generated symbols 1 to: 352.
 GETSEQ from morama, September 13, 2004 17:11.


SCORES   Init1: 45    Initn: 69    Opt: 113    z-score: 70.8  E(): 2.1
>>/home/morama/gas/pili/align/orf80.pep                    (352 aa)
 initn:  69 init1:  45 opt: 113 Z-score: 70.8 expect():  2.1
Smith-Waterman score: 123;    22.8% identity in 311 aa overlap
 (284-556:49-352)

                 260       270       280       290       300       310
gi-50913506. KMANITEDGSVMVENTKIGIAKEVNNGFNLSFIYDSLESISPNISYKAVVN-NKAIVGEE
                                         :: ||: | : |: ::  ::: : :    |:|
orf80.pep    ATALGTASLNQNVKAETAGVVTGKSLQVTKTMTYDDEEVLMPETAFTFTIEPDMTASGKE
```

```
                20        30        40        50        60        70

                      320       330       340       350       360       370
gi-50913506.  GNPN-KAEFFYSNNPTKGNTYDNLDKKPDKGNGITSKEDSKIVYTYQIAFRKVDSVSKTP
              |: : |  :  : :      | | ||  :| : |:: : ||: :    ::| : | ::
orf80.pep     GSLDIKNGIVEGLDKQVTVKYKNTDKTSQKTK-IAQFDFSKVKFPAIGVYRYMVSEKNDK
              80        90       100       110        120       130

                      380       390                 400        410       420
gi-50913506.  LIGAIFGVYDTSNKLIDIVTTNKNG--------YAISTQ-VSSGKYKIKELKAPKGYSLN
                |    :|| ::  :|: : || :          | :| : :|| |  |:  :: |  ||:
orf80.pep     KDGI---TYDDKKWTVDVYVGNKANNEEGFEVLYIVSKEGTSSTKKPIEFTNSIKTTSLK
              140           150       160       170       180       190

                    430                 440       450       460
gi-50913506.  TETYEITANW--------VTATVKTSANSKSTTYTSDKNKATDNSEQVG-----WLKNGI
               |   :||:|          | |:: |   |: : :: :: :: ::  :|       | :|
orf80.pep     IEK-QITGNAGDRKKSFNFTLTLQPSEYYKTGSVVKIEQDGSKKDVTIGTPYKFTLGHGK
                  200       210       220       230       240       250

            470       480                      490       500       510
gi-50913506.  FYSIDSRPTGNDV--------KEAYI------ESTKALTDGTTFSKSNEGSGTVLLETDI
                 ::: | | :          |::|       |: |   ::  |:| :|: :      |  :
orf80.pep     SVMLSKLPIGINYYLSEDEANKDGYTTTATLKEQGKEKSSDFTLSTQNQKTDESADEIVV
                  260       270       280       290       300       310

                 520       530       540       550
gi-50913506.  PNTKLGELPSTGSIGTYLFKAIGSAAMIGAIGIYIVKRRKA
               | :  ::| || :||     |: | : ||:: |||:||:||
orf80.pep     TNKRDTQVP-TGVVGTLAPFAVLSIVAIGGV-IYITKRKKA
                  320        330       340        350
```

gi-50913506.pep
/home/morama/gas/pili/align/gi-19224137.pep gi|19224137|gb|AAL86408.1|AF447492_5 EftLSL.A [Streptococcus pyogenes]

```
SCORES   Init1: 45   Initn: 69   Opt: 109   z-score: 69.8  E(): 2.4
>>/home/morama/gas/pili/align/gi-19224137.pep          (342 aa)
 initn:  69 init1:  45 opt: 109 Z-score: 69.8 expect():  2.4
Smith-Waterman score: 169;    26.0% identity in 334 aa overlap
 (257-556:25-342)

                 230       240       250       260       270       280
gi-50913506.  NKTVYVSDNMSEGLTFNFNSLTVEWKGKMANITEDGSVMVENTKIGIAKEVNNGFNLSFI
                                                 |:  : : :| : :: | | ::| ||
gi-19224137.        MKKNKLLLATAILATALGTASLNQNVKAETAGVVSSGQLTIKKSITN-FN----
                            10        20        30        40

                 290       300       310       320       330       340
gi-50913506.  YDSLESISPNISYKAVVN-NKAIVGEEGN-PNKAEFFYSNNPTKGNTYDNLDKKPDKGNG
              |:|  : |: :|     || ::| :| |:| | |   :  :|:  |  :|:| ||    | :
gi-19224137.  DDTL--LMPKTDYTFSVNPDSAATGTESNLPIKPGIAVNNQDIK-VSYSNTDKTSGKEKQ
             50             60        70        80        90       100

                   350       360       370        380       390       400
gi-50913506.  ITSKEDSKIVYTYQIAFRKVDSVSKTPLIGAIFGV-YDTSNKLIDIVTTNKNGYAISTQV
              : :   : |:::      :| | : :|      |:  || || :: |:|: : |:: ::  :
gi-19224137.  VVV-DFMKVTFPSVGIYRYVVTENK----GTAEGVTYDDTKWLVDVYVGNNEKGGLEPKY
```

```
                 110       120       130           140       150       160

                   410         420       430       440       450
gi-50913506.  SSGKYKIKELKAPKGY--SLNTETYEITANWVTATVKTSANSKSTTYTSDKNKATDNS--
                :|   :  | |  :  |::| : :|  : ||:::    :: : | | : |:  : |
gi-19224137.  IVSKKGDSATKEPIQFNNSFETTSLKIEKE-VTGNTGDHKKAFTFTLTLQPNEYYEASSV
                     170       180       190        200       210       220

               460          470                  480              490
gi-50913506.  ---EQVGWLKN---GIFYSI---DSR-------PTGND--VKEAYIE-----STKALTDG
                 |: |  |:   |  |::   ||:        |:| :  |:||   :      :| :| ||
gi-19224137.  VKIEENGQTKDVKIGEAYKFTLNDSQSVILSKLPVGINYKVEEAEANQGGYTTTATLKDG
                      230       240       250       260       270       280

               500           510       520       530       540       550
gi-50913506.  TTFSKSNEG----SGTVLLETDIPNTKLGELPSTGSIGTYLFKAIGSAAMIGAIGIYIVK
                :|  | |      :  :   |  : |::  ::| || :||     |: | : ||:: |||:|
gi-19224137.  EKLSTYNLGQEHKTDKTADEIVVTNNRDTQVP-TGVVGTLAPFAVLSIVAIGGV-IYITK
                      290       300       310        320       330


gi-50913506.  RRKA
              |:||
gi-19224137.  RKKA
             340
```

gi-50913506.pep
/home/morama/gas/pili/align/gi-19224141.pep gi|19224141|gb|AAL86412.1|AF447492_9 protein F2 [Streptococcus pyogenes]

```
SCORES   Init1: 73   Initn: 73   Opt: 118   z-score: 68.9  E(): 2.7
>>/home/morama/gas/pili/align/gi-19224141.pep             (1161 aa)
 initn:  73 init1:  73 opt: 118 Z-score: 68.9 expect():  2.7
Smith-Waterman score: 174;    23.9% identity in 406 aa overlap
 (115-483:277-645)

                 90        100       110       120       130        140
gi-50913506.  VSLTETGPTSQEITTIANGINTGKIKPFSTENVSISNGTATYNARGASVY--IALLTGAT
                                              ||:||||  :| :::  :     : :| |
gi-19224141.  IYTFTDYIAGLDKVQLSAELSLFLENKEVLENTSISNFKSTIGGQEITYKGTVNVLYGNE
               250       260       270       280       290       300

                   150       160       170       180       190
gi-50913506.  DGRTYNPILLAASYNGEGNLVTKNIDSKSNYLYGQTSVAKSSLPSITKKVTG-------T
              : :  | |  : |  | |:: : | ::      |  ::  :::|  | :: |        |
gi-19224141.  STKESNYITNGLSNVG-GSIESYNTETGEFVWYVYVNPNRTNIPYATMNLWGFGRARSNT
               310       320        330       340       350       360

                   200       210         220       230       240       250
gi-50913506.  ID---DVNKKTTSLGSVLSYSLTF--ELPSYTKEAVNKTVYVSDNMSEGLTFNFNSLTVE
              |    |:| ::: || :  | :     :|||     |:| :  :| :: ||  :|:
gi-19224141.  SDLENDANTSSAELGEIQVYEVPEGEKLPSSYGVDVTKLTLRTD-ITAGLGNGFQ-----
                370       380       390       400        410

                     260       270       280       290       300       310
gi-50913506.  WKGKMANITEDGSVMVENTKIGIAKEVNNGFNLSFIYDSLESISPNISYKAVVNNKAIVG
                             |::  :| ::     ||  | :||     : : : | | :| :: :::
gi-19224141.  --------------MTKRQRIDFG---NNIQNKAFIIKV--TGKTDQSGKPLVVQSNLAS
                            420       430        440       450       460
```

Figure 58I

```
                   320       330         340       350               360
gi-50913506. EEGNPNKAEFFYSNNPTKGNTY--DNLDKKPDKGNGITSKEDSKIVYTY-------QIAF
              :|  :  | |     :|: ||:|  :::  :|:||:|  ::| :|    |       |: |
gi-19224141. FRGASEYAAF----TPVGGNVYFQNEIALSPSKGSGSGKSEFTKPSITVANLKRVAQLRF
                   470           480        490       500       510

                  370       380        390       400       410       420
gi-50913506. RKVDSVSKTPLIGAIFGVYDTSNKLIDI-VTTNKNGYAISTQVSSGKYKIKELKAPKGYS
             :|: |::::||  | | : ::::   : :::| :| :    :::|| | : | ||||||:
gi-19224141. KKM-STDNVPLPEAAFELRSSNGNSQKLEASSNTQGEVHFKDLTSGTYDLYETKAPKGYQ
               520       530       540       550       560       570

                             430          440       450       460
gi-50913506. -----LNTETYEIT------ANWVT--ATVKTSANSKSTTYTSDKNKATDNSEQVGWLKN
                  | | | : |      ::| :  ::||: || | :| :: |:  | :::: | ::
gi-19224141. QVTEKLATVTVDTTKPAEEMVTWGSPHSSVKVEAN-KEVTIVNHKETLTFSGKKI-WEND
               580       590       600       610        620        630

             470       480       490       500       510       520
gi-50913506. GIFYSIDSRPTGNDVKEAYIESTKALTDGTTFSKSNEGSGTVLLETDIPNTKLGELPSTG
                   |:||:  :|:
gi-19224141. ----RPDQRPAKIQVQLLQNGQKMPNQIQEVTKDNDWSYHFKDLPKYDAKNQEYKYSVEE
                    640       650       660       670       680
```

gi-50913506.pep
/home/morama/gas/pili/align/gi-21909636.pep gi|21909636|ref|NP_663904.1| conserved hypothetical protein [Streptococcus pyoge nes MGAS315]

```
SCORES  Init1: 45   Initn: 98   Opt: 96   z-score: 66.1  E(): 3.8
>>/home/morama/gas/pili/align/gi-21909636.pep              (344 aa)
 initn:  98 init1:  45 opt:  96 Z-score: 66.1 expect():  3.8
Smith-Waterman score: 181;    25.3% identity in 312 aa overlap
 (298-556:44-344)

             270       280       290       300       310       320
gi-50913506. NTKIGIAKEVNNGFNLSFIYDSLESISPNISYKAVVNNKAIVGEEGNPNKAEFFYSNNPT
                                         :: : ::|:::: :     |:|   ::: :
gi-21909636. ATALGTASLNQNVKAETAGVSENAKLIVKKTFDSYTDNEVLMPKADYTFKVE---ADSTA
                  20        30        40        50        60          70

             330       340                 350       360
gi-50913506. KGNTYDNLDKKPDKGNGIT---------SKEDSKIVYTYQIAFRKV---------DSVSK
             :|:| |:|: ||  ||:|          :| |||:  | :: | ||          :||:
gi-21909636. SGKTKDGLEIKPGIVNGLTEQIISYTNTDKPDSKVKST-EFDFSKVVFPGIGVYRYTVSE
                     80        90       100       110       120

           370       380       390       400       410         420
gi-50913506. TPLIGAIFGV-YDTSNKLIDIVTTNKNGYAISTQVSSGKYKIKELKAPKGY--SLNTETY
                 | : |: |||::  :|: : ||:| ::  :    :| :  ::| | ::  |: | :
gi-21909636. KQ--GDVEGITYDTKKWTVDVYVGNKEGGGFEPKFIVSKEQGTDVKKPVNFNNSFATTSL
           130       140       150       160       170       180

              430       440              450            460
gi-50913506. EITANWVTATVKTSAN-------SKSTTYTSDK----NKATDNSE-QVGW-----LKNGI
             ::  |      | : : :        ::||:: :|:    :|:::: | ::|       ||||
gi-21909636. KVKKNVSGNTGELQKEFDFTLTLNESTNFKKDQIVSLQKGNEKFEVKIGTPYKFKLKNGE
             190       200       210       220       230       240
```

Figure 58J

```
               470       480       490       500       510
gi-50913506. FYSIDSRPTGNDVKEAYIESTKALTDGTTFSKS-NEGSGTVLL-------ETD-------
               ::|: |:|    |    :|::|   ||    :  | :||:|   :       :||
gi-21909636. SIQLDKLPVGITYKVNEMEANK---DGYKTTASLKEGDGQSKMYQLDMEQKTDESADEIV
             250       260          270       280       290       300

                520       530       540       550
gi-50913506. IPNTKLGELPSTGSIGTYLFKAIGSAAMIGAIGIYIVKRRKA
             : |  :  ::| || :||     |: |  : ||:: |||:||:||
gi-21909636. VTNKRDTQVP-TGVVGTLAPFAVLSIVAIGGV-IYITKRKKA
                310       320       330        340
```

gi-50913506.pep
/home/morama/gas/pili/align/gi-28810259.pep gi|28810259|dbj|BAC63197.1| hypothetical protein [Streptococcus pyogenes SSI-1]

```
SCORES   Init1: 45   Initn: 98   Opt: 96   z-score: 66.0  E(): 3.8
>>/home/morama/gas/pili/align/gi-28810259.pep            (349 aa)
 initn:  98 init1:  45 opt:  96 Z-score: 66.0 expect():  3.8
Smith-Waterman score: 181;    25.3% identity in 312 aa overlap
 (298-556:49-349)

                 270       280       290       300       310       320
gi-50913506. NTKIGIAKEVNNGFNLSFIYDSLESISPNISYKAVVNNKAIVGEEGNPNKAEFFYSNNPT
                                                ::  :  ::|:::: :      |:|    ::: :
gi-28810259. ATALGTASLNQNVKAETAGVSENAKLIVKKTFDSYTDNEVLMPKADYTFKVE---ADSTA
             20        30        40        50        60        70

             330       340                 350       360
gi-50913506. KGNTYDNLDKKPDKGNGIT---------SKEDSKIVYTYQIAFRKV---------DSVSK
             :|:| |:|: ||    ||:|           :| |||:  | :: | ||             :||:
gi-28810259. SGKTKDGLEIKPGIVNGLTEQIISYTNTDKPDSKVKST-EFDFSKVVFPGIGVYRYTVSE
                80        90       100       110        120       130

            370       380       390       400       410        420
gi-50913506. TPLIGAIFGV-YDTSNKLIDIVTTNKNGYAISTQVSSGKYKIKELKAPKGY--SLNTETY
                  | :  |: |||::   :|: :  ||:| ::   :     :| :   ::| | ::   |: | :
gi-28810259. KQ--GDVEGITYDTKKWTVDVYVGNKEGGGFEPKFIVSKEQGTDVKKPVNFNNSFATTSL
                 140       150       160       170       180       190

              430       440                450        460
gi-50913506. EITANWVTATVKTSAN-------SKSTTYTSDK----NKATDNSE-QVGW-----LKNGI
             ::   |      | : : :         ::||:: :|:     :|:::: | ::|        ||||
gi-28810259. KVKKNVSGNTGELQKEFDFTLTLNESTNFKKDQIVSLQKGNEKFEVKIGTPYKFKLKNGE
                 200       210       220       230       240       250

            470       480       490       500       510
gi-50913506. FYSIDSRPTGNDVKEAYIESTKALTDGTTFSKS-NEGSGTVLL-------ETD-------
               ::|: |:|    |    :|::|   ||    :  | :||:|   :       :||
gi-28810259. SIQLDKLPVGITYKVNEMEANK---DGYKTTASLKEGDGQSKMYQLDMEQKTDESADEIV
                 260       270          280       290       300

                520       530       540       550
gi-50913506. IPNTKLGELPSTGSIGTYLFKAIGSAAMIGAIGIYIVKRRKA
             : |  :  ::| || :||     |: |  : ||:: |||:||:||
gi-28810259. VTNKRDTQVP-TGVVGTLAPFAVLSIVAIGGV-IYITKRKKA
            310       320       330       340
```

Figure 58K

```
gi-50913506.pep
/home/morama/gas/pili/align/gas15.pep

GAS15 GAS15


SCORES   Init1: 42    Initn: 68    Opt: 96    z-score: 63.8  E(): 5
>>/home/morama/gas/pili/align/gas15.pep                      (762 aa)
 initn:  68 init1:  42 opt:  96 Z-score: 63.8 expect():    5
Smith-Waterman score: 96;    23.4% identity in 269 aa overlap
 (283-535:222-470)

                  260       270       280       290        300
gi-50913506. GKMANITEDGSVMVENTKIGIAKEVNNGFNLSFIYDSLES-ISPNISYKA---VVNN--K
                                              ||:: ::|:: |:||:: |     | ::
gas15.pep    VWYYSDNAPISNPDESFKRESESNLVSTSQLSLMRQALKQLIDPNLATKMPKQVPDDFQL
                   200       210       220       230       240       250

              310       320       330       340       350       360
gi-50913506. AIVGEEGNPNKAEFFYSNNPTKGNTYDNLDKKPDKGNGITSKEDSKIVYTYQIAFRK--V
             :|   | : :| :  |:|  : | :     | |  |:     :: :   | :: :||  :
gas15.pep    SIFESEDKGDKYNKGYQNLLSGGLVPT---KPPTPGDPPMPPNQPQ---TTSVLIRKYAI
                   260       270          280       290         300

                370       380          390       400       410       420
gi-50913506. DSVSKTPLIGAIFGVY-DTSNKL-IDIVTTNKNGYAISTQVSSGKYKIKELKAPKGYSLN
              : ||  | || : :  |: |::   : ::|  |  |  ::|:| | : ||::| |||:
gas15.pep    GDYSKL-LEGATLQLTGDNVNSFQARVFSSNDIGERI--ELSDGTYTLTELNSPAGYSIA
               310        320       330       340         350       360

                  430         440       450       460         470
gi-50913506. TE-TYEITANWVTATV--KTSANSKSTTYTSDKNKATDNSEQVGWLKN---GIFYSIDSR
               |::: |: | : :  |   | ::        : :| :: |: : | :   : ||   ::
gas15.pep    EPITFKVEAGKVYTIIDGKQIENPNKEIVEPYSVEAYNDFEEFSVLTTQNYAKFYYAKNK
                  370       380       390       400       410       420

              480       490       500       510       520       530
gi-50913506. PTGNDVKEAYIESTKALTDGTTFSKSNEGSGTVLLETDIPNTKLGELPSTGSIGTYLFKA
              :::|   :  : |:  |      |::|: |:       |:   ||:  |    |  |||
gas15.pep    NGSSQVVYCFNADLKSPPD------SEDGGKTMT-----PDFTTGEVKYTHIAGRDLFKY
                  430       440             450            460       470

              540       550
gi-50913506. IGSAAMIGAIGIYIVKRRKA

gas15.pep    TVKPRDTDPDTFLKHIKKVIEKGYREKGQAIEYSGLTETQLRAATQLAIYYFTDSAELDK
                   480       490       500       510       520       530


gi-50913506.pep
/home/morama/gas/pili/align/gi-13621428.pep

gi|13621428|gb|AAK33238.1| hypothetical protein [Streptococcus pyogenes]


SCORES   Init1: 41    Initn: 41    Opt: 87    z-score: 63.6  E(): 5.2
>>/home/morama/gas/pili/align/gi-13621428.pep                (340 aa)
 initn:  41 init1:  41 opt:  87 Z-score: 63.6 expect():  5.2
Smith-Waterman score: 109;    22.6% identity in 345 aa overlap
 (256-556:17-340)
```

Figure 58L

```
                  230       240       250       260       270       280
gi-50913506. VNKTVYVSDNMSEGLTFNFNSLTVEWKGKMANITEDGSVMVENTKIGIAKEVNNGFNLSF
                                        |  |  | ::|:::|: ::|      ||::
gi-13621428.              MKLRHLLLTGAALTSFAATTVHGETVVNGAKLTVTK------NLDL
                                  10        20        30              40

                  290       300       310       320       330       340
gi-50913506. IYDSLESISPNISYKAVVNNKAIVGEEGNPNKAEFFYSNNPTKGNTYDNLDKKPDKGNGI
             : ::  :: || ::   ::  :  |:|:||  |:  :   |:|    || | ||    :|
gi-13621428. VNSN--ALIPNTDFTFKIEPDTTVNEDGNKFKGVAL--NTPMTKVTYTNSDK--GGSNTK
                       50        60        70        80          90

                  350          360                           370
gi-50913506. TSKED-SKI------VYTYQIAFRKVDSV--------------------SKTPLIGAIF
             |:: | |::      || |::: :|:|:|                    :: |:   |
gi-13621428. TAEFDFSEVTFEKPGVYYYKVTEEKIDKVPGVSYDTTSYTVQVHVLWNEEQQKPVATYIV
                  100       110       120       130       140       150

             380       390        400       410       420       430
gi-50913506. GVYDTSNKLIDIVTT-NKNGYAISTQVS-SGKYKIKELKAPKGYSLNTETYEITANWVTA
             |   : |:  |:: :: :::  ::: :|| :|  : |:::    | :|::: |  ::: |
gi-13621428. GYKEGSKVPIQFKNSLDSTTLTVKKKVSGTGGDRSKDFNF--GLTLKANQYYKASEKVMI
                  160       170       180       190         200       210

                  440       450       460       470       480         490
gi-50913506. TVKTSANSKSTTYTSDKNKATDNSEQVGWLKNGIFYSIDSRPTGND--VKEAYIESTKAL
               ||: :::: : |     :|: ::      ||:|    :: : |:| |   | |    :| |
gi-13621428. E-KTTKGGQAPVQT----EASIDQLYHFTLKDGESIKVTNLPVGVDYVVTEDDYKSEKYT
                   220          230       240       250       260

                                 500       510       520       530       540
gi-50913506. T-------DGTT-----FSKSNEGSGTVLLETDIPNTKLGELPSTGSIGTYLFKAIGSAA
             |       ||::     |   :|  |     :    :  | |   |:|:  :: :   : |:| :|
gi-13621428. TNVEVSPQDGAVKNIAGNSTEQETSTDKDMTITFTNKKDFEVPTGVAMTVAPYIALGIVA
             270       280       290       300       310       320

                    550
gi-50913506. MIGAIGIYIVKRRKA
             : ||:  |:||:::|
gi-13621428. VGGAL--YFVKKKNA
             330       340
```

gi-50913506.pep
/home/morama/gas/pili/align/gi-19224135.pep gi|19224135|gb|AAL86406.1|AF447492_3 Cpa [Streptococcus pyogenes]

```
SCORES   Init1: 41   Initn: 41   Opt: 86   z-score: 61.0  E(): 7
>>/home/morama/gas/pili/align/gi-19224135.pep           (756 aa)
 initn:  41 init1:  41 opt:  86 Z-score: 61.0 expect():    7
Smith-Waterman score: 101;    19.6% identity in 306 aa overlap
 (243-535:193-462)

                   220       230       240       250       260       270
gi-50913506. SLTFELPSYTKEAVNKTVYVSDNMSEGLTFNFNSLTVEWKGKMANITEDGSVMVENTKIG
                                        ::::: : | :::     :||::   |::|:
gi-19224135. PKNANGYMDKIEPLNAILVTQQAVWYYSDSSYGNIKTLWASEL----KDGKIDFEQVKL-
                   170       180       190       200           210
```

Figure 58M

```
                 280       290       300       310        320       330
gi-50913506. IAKEVNNGFNLSFIYDSLESISPNISYKAVVNNKAIVGEEGNPN--KAEFFYSNNPTKGN
               :|: :    ::| |:||  | |    ::   |  :  :::  |  :||:   : |: |:
gi-19224135. -MREAYS----KLISDDLEETSKNKLPQGSKLNIFVPQDKSVQNLLSAEYVPESPPAPGQ
              220           230       240       250       260       270

                   340       350        360       370       380
gi-50913506. TYDNLDKKPDKGNGITSKEDSKIVYTY-QIAFRKVDSVSKTPLIGAIFGVYDTSNKLIDI
             :     : |     : :|: | |:  | :  : |:   :    | |     : | ::|   :
gi-19224135. S----PEPP-----VQTKKTSVIIRKYAEGDYSKLLEGATLRLTGE--DILDFQEK---V
                           280       290       300         310

          390       400       410       420        430       440
gi-50913506. VTTNKNGYAISTQVSSGKYKIKELKAPKGYSLNTET-YEITANWVTATVKTSANSKSTT-
               :| :|  |   ::|:| | : | ::| ||::     :::: : |   : | ::: :: :
gi-19224135. FQSNGTGEKI--ELSNGTYTLTETSSPDGYKIAEPIKFRVVNKKVFIVQKDGSQVENPNK
            320         330       340       350       360       370

                 450       460         470       480       490
gi-50913506. -----YTSDKNKATDNSEQVG---WLKNGIFYSIDSRPTGNDVKEAYIESTKALTDGTTF
                  |: :  :  ::|: ::    :     | ||   ::  :::|    :         :|  :
gi-19224135. EVAEPYSVEAYSDMQDSNYINPETFTPYGKFYYAKNKDKSSQVVYCFN------ADLHSP
              380       390       400       410       420               430

          500       510       520       530       540       550
gi-50913506. SKSNEGSGTVLLETDIPNTKLGELPSTGSIGTYLFKAIGSAAMIGAIGIYIVKRRKA
              :|::|:||:  : || : |   |:   | : |: |||
gi-19224135. PESEDGGGTI--DPDISTMK--EVKYTHTAGSDLFKYALRPRDTNPEDFLKHIKKVIEKG
                 440            450       460       470       480

gi-19224135. YNKKGDSYNGLTETQFRAATQLAIYYFTDSTDLKTLKTYNNGKGYHGFESMDEKTLAVTK
              490       500       510       520       530       540
```

gi-50913506.pep
/home/morama/gas/pili/align/gi-50913505.pep gi|50913505|ref|YP_059477.1| Collagen adhesion protein [Streptococcus pyogenes M GAS10394]

```
SCORES   Init1: 70   Initn: 149   Opt: 86   z-score: 60.1  E(): 7.8
>>/home/morama/gas/pili/align/gi-50913505.pep            (1036 aa)
 initn: 149 init1:  70 opt:  86 Z-score: 60.1 expect():  7.8
Smith-Waterman score: 120;    21.5% identity in 469 aa overlap
 (33-428:503-966)
```

```
                 10        20        30         40        50        60
gi-50913506. NRRETVREKILITAKKLMLACLAILAVVGLGMTRVS-ALSKDDTAQLKITNIEGGPTVTL
                                           |:: || :: :||::: :: :::|     |
gi-50913505. YSQWVYHGTFDYSSYQGESFNRGQIHYRYRGIVSVSDGIRRDDAVKNSLLGVNG-----L
                 480       490       500       510       520

                   70        80            90       100       110
gi-50913506. YKIGEGVYNTNGDSFINFK----YAEGVSLTETGPTSQEIT-TIANGINTGKIKPFSTEN
             :   ::   |  | |:|:     |  |     : :| :      :: |: ::  :| :||::
gi-50913505. LQRFVNINPENKLSVIGFQGSADYHAGKWYPDQSPRGGFYQPNLNNSRDAELLKGWSTNS
             530       540       550       560       570       580

              120       130       140              150          160
gi-50913506. VSISNGTATYNARGASVYIALLTGAT-------DGRTYNPILLAAS----YNGEGNLVTK
             :   |  :: :  |:: : ||| :          |||    |::: :     | || :  :
```

Figure 58N

```
gi-50913505. LLDPNTLTALHNNGTNYHAALLKAKEILNEVKDDGRRKIMIFISDGVPTFYFGEDGYRSG
             590       600       610       620       630       640

                 170          180            190        200        210
gi-50913506. NIDS--KSNYLYGQ--TSVA----KSSLPSITKKVTGTIDDVNKKTTSLGSVLSYSLTFE
             | :|  ::|   :|  :::|    |:  |:::    |:  |:|: |:| : |:   |: |
gi-50913505. NGSSNDRNNVTRSQEGSKLAIDEFKARYPNLSIYSLGVSKDINSDTASSSPVVLKYLSGE
             650       660       670       680       690       700

             220              230                240          250       260
gi-50913506. LPSY-------TKEAVNKTVY--------VSDNMSEGLTF--NFNSLTVEWKGKMANITE
                |        ::::|| |         :||::|: : :   :  :: |   |:|: : ||
gi-50913505. EHYYGITDTAELEKTLNKIVEDSKLSQLGISDSLSQYVDYYDKQPDVLVTRKSKVNDETE
             710       720       730       740       750       760

                                       270       280          290
gi-50913506. ----------------DGSVMVENTKIGIAKEVNNGFNLSFIYDS--LESISPNI-----
                             | |:: :|     :|:  |: ::  |:    ::| |:
gi-50913505. ILYQKDQVQEAGKDIIDKVVFTPKTTSQPKGKVTLTFKSDYKVDDEYTYTLSFNVKASDE
             770       780       790       800       810       820

             300       310       320       330       340        350
gi-50913506. SYKAVVNNKAIVGEEGNPNKAEFFYSNNPTKGNTYDNLDKKPDK-GNGITSKEDSK----
             :|:   :|::  :| |: :      :::  ||:  :| | : :  ::|  :|    |
gi-50913505. AYEKYKDNEGRYSEMGDSDTDYGTNQTSSGKGGLPSNSDASVNYMADGREQKLPYKHPVI
             830       840       850       860       870       880

                  360         370       380        390       400
gi-50913506. IVYTYQIAFRKVDS-VSKTPLIGAIFGVYDTSNKLI-DIVTTNKNGYAISTQVSSGK-YK
              | |  |:| |||:  ::  | |: | :   ::|:: :  ||::||      :::|| |
gi-50913505. QVKTVPITFTKVDADNNQKKLAGVEFELRKEDKKIVWEKGTTGSNGQLNFKYLQKGKTYY
             890       900       910       920       930       940

           410       420       430       440       450       460
gi-50913506. IKELKAPKGYSLNTETYEITANWVTATVKTSANSKSTTYTSDKNKATDNSEQVGWLKNGI
             : | ||  ||:|  : :|::
gi-50913505. LYETKAKLGYTLPENPWEVAVANNGDIKVKHPIEGELKSKDGSYMIKNYKIYQLPSSGGR
             950       960       970       980       990      1000
```

gi-50913506.pep
/home/morama/gas/pili/align/gi-13621430.pep gi|13621430|gb|AAK33240.1| hypothetical protein [Streptococcus pyogenes]

```
SCORES   Init1: 43   Initn: 67   Opt: 67   z-score: 59.2  E(): 8.7
>>/home/morama/gas/pili/align/gi-13621430.pep          (215 aa)
 initn:  67 init1:  43 opt:  67 Z-score: 59.2 expect():  8.7
Smith-Waterman score: 67;    27.8% identity in 90 aa overlap
 (433-522:60-143)

                  410       420       430       440       450       460
gi-50913506. VSSGKYKIKELKAPKGYSLNTETYEITANWVTATVKTSANSKSTTYTSDKNKATDNSEQV
                                          : |  | |  :|:| || |::: : ||:
gi-13621430. TASINIEVINQVDVATNKQSSDIDETFMFVIEALDKESPLPNSVT-TSVKGNGKTSFEQL
            30        40        50        60        70        80

                  470       480       490       500       510       520
gi-50913506. GWLKNGIFYSIDSRPTGNDVKEAYIESTKALTDGTTFSKSNEGSGTVLLETDIPNTKLGE
              : : | ::    :  |:: :  | |::  ::  : :    || ||:  |||:: ::||||
gi-13621430. TFSEVGQYHYKIHQLLGKNSQYHYDETVYEVVIYVLY---NEQSGA--LETNLVSNKLGE
```
Figure 580

```
              90        100        110        120          130          140

                   530        540        550
gi-50913506. LPSTGSIGTYLFKAIGSAAMIGAIGIYIVKRRKA

gi-13621430. TEKSELIFKQEYSEKTPEPHQPDTTEKEKPQKKRNGILPSTGEMVSYVSALGIVLVATIT
                  150        160        170        180        190        200


gi-50913506.pep
/home/morama/gas/pili/align/gi-19745303.pep

gi|19745303|ref|NP_606439.1| hypothetical protein [Streptococcus pyogenes MGAS82
32]


SCORES   Init1: 51    Initn: 106   Opt: 69    z-score: 58.4  E(): 9.5
>>/home/morama/gas/pili/align/gi-19745303.pep             (344 aa)
 initn: 106 init1:  51 opt:  69 Z-score: 58.4 expect():  9.5
Smith-Waterman score: 129;    24.0% identity in 308 aa overlap
 (298-556:44-344)

             270        280        290        300        310        320
gi-50913506. NTKIGIAKEVNNGFNLSFIYDSLESISPNISYKAVVNNKAIVGEEGNPNKAEFFYSNNPT
                                          :: :  :::|::: :      |:|    ::: :
gi-19745303. ATALGTASLNQNVKAETAGVIDGSTLVVKKTFPSYTDDKVLMPKADYTFKVE---ADDNA
                   20         30         40         50         60         70

             330        340                       350        360        370
gi-50913506. KGNTYDNLDKKPDKGNGI--------------TSKEDSKIVYTYQIAFRKVDSVSKT--P
             ||:| |:|| ||    :|:                |:|| |         :: |   |      |
gi-19745303. KGKTKDGLDIKPGVIDGLENTKTIHYGNSDKTTAKEKSVNFDFANVKFPGVGVYRYTVSE
                     80         90        100        110        120        130

                     380        390        400        410        420
gi-50913506. LIGAIFGV-YDTSNKLIDIVTTNKN--GYAISTQVSS-GKYKIKELKAPKGYSLNTETYE
             : |      |: ||:::   :|: ::|::   |:   :    ||: |   : |:     |:: ::| : :
gi-19745303. VNGNKAGIAYDSQQWTVDVYVVNREDGGFEAKYIVSTEGGQSDKKPVLFKNF-FDTTSLK
                     140        150        160        170        180

             430        440        450        460        470
gi-50913506. ITANWVTATVKTSANSKSTTYTSDKNKATDNSEQVGWLKNGIF--------YSIDSR---
             :| :  ||:::       | | |       |:  :::: |: |::|           ||:  :
gi-19745303. VTKK-VTGNTGEHQRSFSFTLLLTPNECFEKGQVVNILQGGETKKVVIGEEYSFTLKDKE
           190        200        210        220        230        240

                            480        490        500        510
gi-50913506. -------PTG-------NDVKEAYIESTKALTDGTTFSKSNEG-SGTVLLETD---IPNT
                    |:|       :|| :     ::: :| || : :   | | | |:    ||    : |
gi-19745303. SVTLSQLPVGIEYKVTEEDVTKDGYKTSATLKDGDVTDGYNLGDSKTTDKSTDEIVVTNK
            250        260        270        280        290        300

            520        530        540        550
gi-50913506. KLGELPSTGSIGTYLFKAIGSAAMIGAIGIYIVKRRKA
             :   ::| || :||     |: | : ||:: |||:||:||
gi-19745303. RDTQVP-TGVVGTLAPFAVLSIVAIGGV-IYITKRKKA
            310        320        330        340
```

Figure 58P

```
! Distributed over 1 thread.
!      Start time: Wed Sep 15 18:45:54 2004
! Completion time: Wed Sep 15 18:46:02 2004

! CPU time used:
!        Database scan:  0:00:00.1
! Post-scan processing:  0:00:01.9
!       Total CPU time:  0:00:02.0
! Output File: gi-50913506.fasta
```

Figure 58Q

```
!!SEQUENCE_LIST 1.0

(Peptide) FASTA of: gi-13621430.pep  from: 1 to: 215  September 15, 2004 18:45

gi|13621430|gb|AAK33240.1| hypothetical protein [Streptococcus pyogenes]

 TO: *.pep  Sequences:         56  Symbols:        22,803  Word Size: 2

 Scoring matrix: GenRunData:blosum50.cmp
 Variable pamfactor used
 Gap creation penalty: 12  Gap extension penalty: 2



Histogram Key:
 Each histogram symbol represents 1 search set sequences
 z-scores computed from opt scores

z-score obs    exp
        (=)    (*)

< 20       0      0:
  22       0      0:
  24       0      0:
  26       0      0:
  28       0      0:
  30       0      0:
  32       0      0:
  34       0      1:*
  36       0      2: *
  38       0      3:  *
  40       0      4:   *
  42       0      5:    *
  44       1      5:=   *
  46       7      5:====*==
  48      21      5:====*================
  50       7      5:====*==
  52       2      4:== *
  54       4      3:==*=
  56       3      3:==*
  58       0      2: *
  60       4      2:=*==
  62       1      2:=*
  64       0      1:*
  66       0      1:*
  68       0      1:*
  70       0      1:*
  72       0      0:
  74       0      0:
  76       0      0:
  78       0      0:
  80       3      0:===
  82       2      0:==
  84       0      0:
  86       0      0:
  88       0      0:
  90       0      0:
  92       0      0:
  94       0      0:
  96       0      0:
  98       0      0:
```

```
 100      0      0:
 102      0      0:
 104      0      0:
 106      0      0:
 108      0      0:
 110      0      0:
 112      0      0:
 114      0      0:
 116      0      0:
 118      0      0:
>120      1      0:=

Joining threshold: 36, opt. threshold: 24, opt. width:  16, reg.-scaled


The best scores are:                      init1 initn   opt    z-sc E(55)..

/home/morama/gas/pili/align/gi-13621430.pep    Begin: 1  End: 215
! gi|13621430|gb|AAK33240.1| hypothet... 1338  1338  1338   233.9  1.8e-09
/home/morama/gas/pili/align/gi-19745305.pep    Begin: 1  End: 193
! gi|19745305|ref|NP_606441.1| hypoth...  163   243   273    82.2     0.5
/home/morama/gas/pili/align/gi-28810261.pep    Begin: 2  End: 187
! gi|28810261|dbj|BAC63199.1| hypothe...  164   239   268    81.5    0.55
/home/morama/gas/pili/align/gi-19224139.pep    Begin: 2  End: 187
! gi|19224139|gb|AAL86410.1|AF447492_...  164   236   265    81.0    0.57
/home/morama/gas/pili/align/orf82.pep    Begin: 30  End: 222
! TRANSLATE of: orf82.seq check: 4296...  163   235   264    81.0    0.58
/home/morama/gas/pili/align/gi-21909638.pep    Begin: 2  End: 181
! gi|21909638|ref|NP_663906.1| hypoth...  164   239   261    80.5    0.62
/home/morama/gas/pili/align/gi-19745303.pep    Begin: 84  End: 183
! gi|19745303|ref|NP_606439.1| hypoth...  121   121   126    61.4     6.7
/home/morama/gas/pili/align/gi-13621428.pep    Begin: 6  End: 174
! gi|13621428|gb|AAK33238.1| hypothet...   58    86   122    60.9     7.2
/home/morama/gas/pili/align/gi-19224137.pep    Begin: 93  End: 201
! gi|19224137|gb|AAL86408.1|AF447492_...   88    88   119    60.4     7.5
/home/morama/gas/pili/align/gi-50913503.pep    Begin: 549  End: 625
! gi|50913503|ref|YP_059475.1| Fibron...   73    73   117    60.4     7.6
/home/morama/gas/pili/align/gi-19224134.pep    Begin: 631  End: 697
! gi|19224134|gb|AAL86405.1|AF447492_...   73    73   115    60.1     7.8
\\End of List


gi-13621430.pep
/home/morama/gas/pili/align/gi-13621430.pep

gi|13621430|gb|AAK33240.1| hypothetical protein [Streptococcus pyogenes]


SCORES   Init1: 1338  Initn: 1338  Opt: 1338  z-score: 233.9 E(): 1.8e-09
>>/home/morama/gas/pili/align/gi-13621430.pep            (215 aa)
 initn: 1338 init1: 1338 opt: 1338 Z-score: 233.9 expect(): 1.8e-09
Smith-Waterman score: 1338;   100.0% identity in 215 aa overlap
 (1-215:1-215)

                    10        20        30        40        50        60
gi-13621430. MKKSILRILAIGYLLMSFCLLDSVEAENLTASINIEVINQVDVATNKQSSDIDETFMFVI
             ||||||||||||||||||||||||||||||||||||||||||||||||||||||||||||
gi-13621430. MKKSILRILAIGYLLMSFCLLDSVEAENLTASINIEVINQVDVATNKQSSDIDETFMFVI
                    10        20        30        40        50        60
```

Figure 59B

```
                     70        80        90       100       110       120
gi-13621430. EALDKESPLPNSVTTSVKGNGKTSFEQLTFSEVGQYHYKIHQLLGKNSQYHYDETVYEVV
             ||||||||||||||||||||||||||||||||||||||||||||||||||||||||||||
gi-13621430. EALDKESPLPNSVTTSVKGNGKTSFEQLTFSEVGQYHYKIHQLLGKNSQYHYDETVYEVV
                     70        80        90       100       110       120

                    130       140       150       160       170       180
gi-13621430. IYVLYNEQSGALETNLVSNKLGETEKSELIFKQEYSEKTPEPHQPDTTEKEKPQKKRNGI
             ||||||||||||||||||||||||||||||||||||||||||||||||||||||||||||
gi-13621430. IYVLYNEQSGALETNLVSNKLGETEKSELIFKQEYSEKTPEPHQPDTTEKEKPQKKRNGI
                    130       140       150       160       170       180

                    190       200       210
gi-13621430. LPSTGEMVSYVSALGIVLVATITLYSIYKKLKTSK
             |||||||||||||||||||||||||||||||||||
gi-13621430. LPSTGEMVSYVSALGIVLVATITLYSIYKKLKTSK
                    190       200       210


gi-13621430.pep
/home/morama/gas/pili/align/gi-19745305.pep

gi|19745305|ref|NP_606441.1| hypothetical protein [Streptococcus pyogenes MGAS82
32]


SCORES   Init1: 163   Initn: 243   Opt: 273   z-score: 82.2  E(): 0.5
>>/home/morama/gas/pili/align/gi-19745305.pep            (195 aa)
 initn: 243 init1: 163 opt: 273 Z-score: 82.2 expect():  0.5
Smith-Waterman score: 320;    31.9% identity in 213 aa overlap
 (1-213:1-193)

                     10        20        30        40        50        60
gi-13621430. MKKSILRILAIGYLLMSFCLLDSVEAENLTASINIEVINQVDVATNKQSSDIDETFMFVI
             |:|    :::: ::|  : : ::| |:: |:: :| | | :: | :: |      |  ::
gi-19745305. MRKYWKMLFSVVMILTMLAFNQTVLAKDSTVQTSISVENVLERAGDSTS------FSVAL
                     10        20        30        40              50

                     70        80        90       100       110       120
gi-13621430. EALDKESPLPNSVTTSVKGNGKTSFEQLTFSEVGQYHYKIHQLLGKNSQYHYDETVYEVV
             |::|  : : : :|  : |:||:||  |||: |||| |:::|  ::|::|: | ||::|:
gi-19745305. ESIDAMKTI-DEIT--IAGSGKASFSPLTFTTVGQYTYRVYQKPSQNKDYQADTTVFDVL
                 60           70        80        90       100       110

                    130       140       150       160       170       180
gi-13621430. IYVLYNEQSGALETNLVSNKLGETEKSELIFKQEYSEKTPEPHQPDTTEKEKPQKKRNGI
             :|| |:|: |:| ::::| : |: ||| : || :   |   |:|||      |:
gi-19745305. VYVTYDED-GTLVAKVISRRAGDEEKSAITFKPKRLVKPIPPRQPDI-----PKTP----
                    120       130       140       150            160

                    190       200       210
gi-13621430. LPSTGEMVSYVSALGIVLVATITLYSIYKKLKTSK
             || :||: | :: |:|||:: ::|  : ||||:
gi-19745305. LPLAGEVKSLLGILSIVLLGLLVLLYV-KKLKSRL
                   170       180        190


gi-13621430.pep
/home/morama/gas/pili/align/gi-28810261.pep

gi|28810261|dbj|BAC63199.1| hypothetical protein [Streptococcus pyogenes SSI-1]
```

Figure 59C

```
SCORES   Init1: 164   Initn: 239   Opt: 268   z-score: 81.5  E(): 0.55
>>/home/morama/gas/pili/align/gi-28810261.pep            (189 aa)
 initn: 239 init1: 164 opt: 268 Z-score: 81.5 expect(): 0.55
Smith-Waterman score: 306;    30.6% identity in 206 aa overlap
 (8-213:2-187)

                      10        20        30        40        50        60
gi-13621430. MKKSILRILAIGYLLMSFCLLDSVEAENLTASINIEVINQVDVATNKQSSDIDETFMFVI
                    :::: ::|  : : ::| |:: |:: :| | | :: | ::        | :::
gi-28810261.       MLFSVVMILTMLAFNQTVLAKDSTVQTSISVENVLERAGDSTP------FSIAL
                          10        20        30        40

                      70        80        90       100       110       120
gi-13621430. EALDKESPLPNSVTTSVKGNGKTSFEQLTFSEVGQYHYKIHQLLGKNSQYHYDETVYEVV
             |::|  : : :    :: |:||:||  |||: |||| |:::|  ::|::|: | ||::|:
gi-28810261. ESIDAMKTIEE---ITIAGSGKASFSPLTFTTVGQYTYRVYQKPSQNKDYQADTTVFDVL
             50            60        70        80        90       100

                     130       140       150       160       170       180
gi-13621430. IYVLYNEQSGALETNLVSNKLGETEKSELIFKQEYSEKTPEPHQPDTTEKEKPQKKRNGI
             :|| |:|: |:| ::::| : |: ||| : || ::  |    |:||:       |:
gi-28810261. VYVTYDED-GTLVAKVISRRAGDEEKSAITFKPKWLVKPIPPRQPNI-----PKTP----
               110       120       130       140       150

                     190       200       210
gi-13621430. LPSTGEMVSYVSALGIVLVATITLYSIYKKLKTSK
             || :||: | :: |:|||:: ::|   : ||||:
gi-28810261. LPLAGEVKSLLGILSIVLLGLLVLLYV-KKLKSRL
               160       170       180


gi-13621430.pep
/home/morama/gas/pili/align/gi-19224139.pep

gi|19224139|gb|AAL86410.1|AF447492_7 unknown [Streptococcus pyogenes]


SCORES   Init1: 164   Initn: 236   Opt: 265   z-score: 81.0  E(): 0.57
>>/home/morama/gas/pili/align/gi-19224139.pep            (189 aa)
 initn: 236 init1: 164 opt: 265 Z-score: 81.0 expect(): 0.57
Smith-Waterman score: 303;    30.6% identity in 206 aa overlap
 (8-213:2-187)

                      10        20        30        40        50        60
gi-13621430. MKKSILRILAIGYLLMSFCLLDSVEAENLTASINIEVINQVDVATNKQSSDIDETFMFVI
                    :::: ::|  : : ::| |:: |:: :| | | :: | ::        | :::
gi-19224139.       MLFSVVMILTMLAFNQTVLAKDSTVQTSISVENVLERAGDSTP------FSIAL
                          10        20        30        40

                      70        80        90       100       110       120
gi-13621430. EALDKESPLPNSVTTSVKGNGKTSFEQLTFSEVGQYHYKIHQLLGKNSQYHYDETVYEVV
             |::|  : : :    :: |:||:||  |||: |||| |:::|  ::|::|: | ||::|:
gi-19224139. ESIDAMKTIEE---ITIAGSGKASFSPLTFTTVGQYTYRVYQKPSQNKDYQADTTVFDVL
             50            60        70        80        90       100

                     130       140       150       160       170       180
gi-13621430. IYVLYNEQSGALETNLVSNKLGETEKSELIFKQEYSEKTPEPHQPDTTEKEKPQKKRNGI
             :|| |:|: |:| ::::| : |: ||| : || :   |    |:||:       |:
gi-19224139. VYVTYDED-GTLVAKVISRRAGDEEKSAITFKPKRLVKPIPPRQPNI-----PKTP----
               110       120       130       140       150
```

Figure 59D

```
                 190       200       210
gi-13621430. LPSTGEMVSYVSALGIVLVATITLYSIYKKLKTSK
             || :||: | :: |:|||:: ::|  : ||||::
gi-19224139. LPLAGEVKSLLGILSIVLLGLLVLLYV-KKLKSKL
               160       170       180


gi-13621430.pep
/home/morama/gas/pili/align/orf82.pep

TRANSLATE of: orf82.seq check: 4296 from: 1 to: 672
generated symbols 1 to: 224.
 GETSEQ from morama, September 13, 2004 17:09.


SCORES   Init1: 163   Initn: 235   Opt: 264   z-score: 81.0  E(): 0.58
>>/home/morama/gas/pili/align/orf82.pep                    (224 aa)
 initn: 235 init1: 163 opt: 264 Z-score: 81.0 expect(): 0.58
Smith-Waterman score: 304;    30.5% identity in 213 aa overlap
 (1-213:30-222)

                                                 10        20        30
gi-13621430.                          MKKSILRILAIGYLLMSFCLLDSVEAENLTA
                                      ::|    :::: ::|  : : ::| |:: |:
orf82.pep    LLFQRVKIFLLTIVLSLSVLFKNNERRRLLRKYWKMLFSVVMILTMLAFNQTVLAKDSTV
                     10        20        30        40        50        60

                    40        50        60        70        80        90
gi-13621430. SINIEVINQVDVATNKQSSDIDETFMFVIEALDKESPLPNSVTTSVKGNGKTSFEQLTFS
             : :| | | :: | ::         |  ::|::|  : : : :|  : |:||:||  |||:
orf82.pep    QTSISVENVLERAGDSTP------FSVALESIDAMKTI-DEIT--IAGSGKASFSPLTFT
                     70                80        90          100       110

                   100       110       120       130       140       150
gi-13621430. EVGQYHYKIHQLLGKNSQYHYDETVYEVVIYVLYNEQSGALETNLVSNKLGETEKSELIF
             |||| |:::|  ::|::|: | ||::|::|| |:|: |:| ::::| : |: ||| : |
orf82.pep    TVGQYTYRVYQKPSQNKDYQADTTVFDVLVYVTYDED-GTLVAKVISRRAGDEEKSAITF
                   120       130       140          150       160       170

                   160       170       180       190       200       210
gi-13621430. KQEYSEKTPEPHQPDTTEKEKPQKKRNGILPSTGEMVSYVSALGIVLVATITLYSIYKKL
             | :   |   |:||:       |:       || :||: | :: |:|||:: ::|  : |||
orf82.pep    KPKRLVKPIPPRQPNI-----PKTP----LPLAGEVKSLLGILSIVLLGLLVLLYV-KKL
                     180            190            200       210       220


gi-13621430. KTSK
             |:
orf82.pep    KSRL


gi-13621430.pep
/home/morama/gas/pili/align/gi-21909638.pep

gi|21909638|ref|NP_663906.1| hypothetical protein [Streptococcus pyogenes MGAS31
5]


SCORES   Init1: 164   Initn: 239   Opt: 261   z-score: 80.5  E(): 0.62
>>/home/morama/gas/pili/align/gi-21909638.pep             (183 aa)
```

Figure 59E

```
 initn: 239 init1: 164 opt: 261 Z-score: 80.5 expect(): 0.62
Smith-Waterman score: 302;    31.5% identity in 200 aa overlap
 (14-213:2-181)

                   10        20        30        40        50        60
gi-13621430. MKKSILRILAIGYLLMSFCLLDSVEAENLTASINIEVINQVDVATNKQSSDIDETFMFVI
                          :|  : : ::| |:: |:: :| | | :: | ::       | :::
gi-21909638.              MILTMLAFNQTVLAKDSTVQTSISVENVLERAGDSTP------FSIAL
                                  10        20        30              40

                   70        80        90       100       110       120
gi-13621430. EALDKESPLPNSVTTSVKGNGKTSFEQLTFSEVGQYHYKIHQLLGKNSQYHYDETVYEVV
             |::|  : : :    :: |:||:||  |||: |||| |::|  ::|::|: | ||::|:
gi-21909638. ESIDAMKTIEE---ITIAGSGKASFSPLTFTTVGQYTYRVYQKPSQNKDYQADTTVFDVL
                 50           60        70        80        90

                  130       140       150       160       170       180
gi-13621430. IYVLYNEQSGALETNLVSNKLGETEKSELIFKQEYSEKTPEPHQPDTTEKEKPQKKRNGI
             :|| |:|: |:| ::::| : |: ||| : || ::  |   |:||:      |:
gi-21909638. VYVTYDED-GTLVAKVISRRAGDEEKSAITFKPKWLVKPIPPRQPNI-----PKTP----
           100       110       120       130       140

                  190       200       210
gi-13621430. LPSTGEMVSYVSALGIVLVATITLYSIYKKLKTSK
             || :||: | :: |:|||:: ::|  : ||||:
gi-21909638. LPLAGEVKSLLGILSIVLLGLLVLLYV-KKLKSRL
           150       160       170        180


gi-13621430.pep
/home/morama/gas/pili/align/gi-19745303.pep

gi|19745303|ref|NP_606439.1| hypothetical protein [Streptococcus pyogenes MGAS82
32]


SCORES   Init1: 121   Initn: 121   Opt: 126   z-score: 61.4  E(): 6.7
>>/home/morama/gas/pili/align/gi-19745303.pep            (344 aa)
 initn: 121 init1: 121 opt: 126 Z-score: 61.4 expect():  6.7
Smith-Waterman score: 126;    27.0% identity in 100 aa overlap
 (59-155:84-183)

             30        40        50        60        70        80
gi-13621430. LTASINIEVINQVDVATNKQSSDIDETFMFVIEALDKESPLP--NSVTTSVKGNG-KTSF
                                               ||::|:: : :   ||  |::| :: : :|
gi-19745303. LMPKADYTFKVEADDNAKGKTKDGLDIKPGVIDGLENTKTIHYGNSDKTTAKEKSVNFDF
                   60        70        80        90       100       110

                90       100       110       120       130       140
gi-13621430. EQLTFSEVGQYHYKIHQLLGKNSQYHYDETVYEVVIYVLYNEQSGALETNLVSNKLGETE
               :: |  || |:| : :: |::  ||   : | :||:  |::|     :||:: |:::
gi-19745303. ANVKFPGVGVYRYTVSEVNGNKAGIAYDSQQWTVDVYVVNREDGGFEAKYIVSTEGGQSD
                 120       130       140       150       160       170

               150       160       170       180       190       200
gi-13621430. KSELIFKQEYSEKTPEPHQPDTTEKEKPQKKRNGILPSTGEMVSYVSALGIVLVATITLY
             |: ::||: ::
gi-19745303. KKPVLFKNFFDTTSLKVTKKVTGNTGEHQRSFSFTLLLTPNECFEKGQVVNILQGGETKK
                 180       190       200       210       220       230


gi-13621430.pep
```

Figure 59F

```
/home/morama/gas/pili/align/gi-13621428.pep

gi|13621428|gb|AAK33238.1| hypothetical protein [Streptococcus pyogenes]


SCORES   Init1: 58    Initn: 86    Opt: 122   z-score: 60.9  E(): 7.2
>>/home/morama/gas/pili/align/gi-13621428.pep              (340 aa)
 initn:  86 init1:  58 opt: 122 Z-score: 60.9 expect():  7.2
Smith-Waterman score: 135;    29.1% identity in 172 aa overlap
 (8-159:6-174)

                     10        20        30        40         50
gi-13621430. MKKSILRILAIGYLLMSFCLLDSVEAENLTASINIEVINQVD-VATNKQSSDIDETFMF-
                     :|  |  | ||    :|::|::: : ::  | :::| | :|    : | || :
gi-13621428.   MKLRHLLLTGAALTSFAAT-TVHGETVVNGAKLTVTKNLDLVNSNALIPNTDFTFKIE
                       10         20        30        40        50

                 60                70        80        90            100
gi-13621430. ----VIEALDK------ESPLPN-SVTTSVKGNGKTSFEQLTFSEV-----GQYHYKI-H
                 | |  :|      ::|: : : |:| ||:::|:  :: ||||      | |:||: :
gi-13621428. PDTTVNEDGNKFKGVALNTPMTKVTYTNSDKGGSNTKTAEFDFSEVTFEKPGVYYYKVTE
               60        70        80        90       100       110

                   110       120        130       140       150       160
gi-13621430. QLLGKNSQYHYDETVYEVVIYVLYNE-QSGALETNLVSNKLGETEKSELIFKQEYSEKTP
             : : |      || | | | ::||:|| |:  : | :|: | |   |  : ||:  :  |
gi-13621428. EKIDKVPGVSYDTTSYTVQVHVLWNEEQQKPVATYIVGYKEGS--KVPIQFKNSLDSTTL
             120       130       140       150       160        170

                    170       180       190       200       210
gi-13621430. EPHQPDTTEKEKPQKKRNGILPSTGEMVSYVSALGIVLVATITLYSIYKKLKTSK

gi-13621428. TVKKKVSGTGGDRSKDFNFGLTLKANQYYKASEKVMIEKTTKGGQAPVQTEASIDQLYHF
               180       190       200       210       220       230


gi-13621430.pep
/home/morama/gas/pili/align/gi-19224137.pep

gi|19224137|gb|AAL86408.1|AF447492_5 EftLSL.A [Streptococcus pyogenes]


SCORES   Init1: 88    Initn: 88    Opt: 119   z-score: 60.4  E(): 7.5
>>/home/morama/gas/pili/align/gi-19224137.pep              (342 aa)
 initn:  88 init1:  88 opt: 119 Z-score: 60.4 expect():  7.5
Smith-Waterman score: 119;    29.7% identity in 111 aa overlap
 (72-176:93-201)

                     50        60        70         80            90
gi-13621430. DVATNKQSSDIDETFMFVIEALDKESPLPNSVTTSVKGNGK-----TSFEQLTFSEVGQY
                                           | ::: | :||     ::| ::||  || |
gi-19224137. SVNPDSAATGTESNLPIKPGIAVNNQDIKVSYSNTDKTSGKEKQVVVDFMKVTFPSVGIY
                    70        80        90       100       110       120

               100       110       120       130       140       150
gi-13621430. HYKIHQLLGKNSQYHYDETVYEVVIYVLYNEQSGALETNLVSNKLGETEKSELI-FKQEY
             :| : :  |      ||:| : | :||  ||::| || : : :| |::  :| | |:: :
gi-19224137. RYVVTENKGTAEGVTYDDTKWLVDVYVGNNEKGG-LEPKYIVSKKGDSATKEPIQFNNSF
                    130       140       150        160       170       180

               160       170       180       190       200       210
gi-13621430. SEKTPEPHQPDTTEKEKPQKKRNGILPSTGEMVSYVSALGIVLVATITLYSIYKKLKTSK
```

Figure 59G

```
                  | |     : ::| :    :||
gi-19224137. -ETTSLKIEKEVTGNTGDHKKAFTFTLTLQPNEYYEASSVVKIEENGQTKDVKIGEAYKF
                 190       200       210       220       230       240

gi-13621430.pep
/home/morama/gas/pili/align/gi-50913503.pep

gi|50913503|ref|YP_059475.1| Fibronectin-binding protein [Streptococcus pyogenes
 MGAS10394]

SCORES    Init1: 73    Initn: 73    Opt: 117    z-score: 60.4   E(): 7.6
>>/home/morama/gas/pili/align/gi-50913503.pep                    (627 aa)
 initn:  73 init1:  73 opt: 117 Z-score: 60.4 expect():   7.6
Smith-Waterman score: 118;   28.7% identity in 87 aa overlap
 (129-215:549-625)

             100       110       120       130       140       150
gi-13621430. KIHQLLGKNSQYHYDETVYEVVIYVLYNEQSGALETNLVSNKLGETEKSELIFKQEYSEK
                              ||  ||   |     |   : :|:|:: : :|
gi-50913503. IETEDTKEPEVLMGGQSESVEFTKDTQTGMSGFSETATVV----EDTRPKLVFHFDNNEP
              520       530       540       550       560       570

             160       170       180       190       200       210
gi-13621430. TPEPHQPDTTEKEKPQKKRNGILPSTGEMVSYVSALGIVLVATITLYSIYKKLKTSK
              | :       :||| |: :  |||:||:: : ::  |||::::::::::|: |: :::|
gi-50913503. KVEEN------REKPTKNITPILPATGDIENVLAFLGILILSVLSIFSLLKNKQSNKKV
                 580       590       600       610       620

gi-13621430.pep
/home/morama/gas/pili/align/gi-19224134.pep

gi|19224134|gb|AAL86405.1|AF447492_2 protein F [Streptococcus pyogenes]

SCORES    Init1: 73    Initn: 73    Opt: 115    z-score: 60.1   E(): 7.8
>>/home/morama/gas/pili/align/gi-19224134.pep                    (698 aa)
 initn:  73 init1:  73 opt: 115 Z-score: 60.1 expect():   7.8
Smith-Waterman score: 115;   27.4% identity in 73 aa overlap
 (143-215:631-697)

             120       130       140       150       160       170
gi-13621430. DETVYEVVIYVLYNEQSGALETNLVSNKLGETEKSELIFKQEYSEKTPEPHQPDTTEKEK
                                 | : :|:|: : :|    | :         :||
gi-19224134. VLMGGQSESVEFTKDTQTGMSGFSETVTIVEDTRPKLVFHFDNNEPKVEEN------REK
                   610       620       630       640       650

             180       190       200       210
gi-13621430. PQKKRNGILPSTGEMVSYVSALGIVLVATITLYSIYKKLKTSK
              | |: :  |||:||:: : ::  |||::::::::::|: |: :::|
gi-19224134. PTKNITPILPATGDIENVLAFLGILILSVLSIFSLLKNKQNNKV
                 660       670       680       690

! Distributed over 1 thread.
!     Start time: Wed Sep 15 18:45:36 2004
! Completion time: Wed Sep 15 18:45:38 2004
```

Figure 59H

```
! CPU time used:
!         Database scan:  0:00:00.1
! Post-scan processing:  0:00:00.3
!        Total CPU time:  0:00:00.4
! Output File: gi-13621430.fasta
```

Figure 59I

TYPE 3 pilus motifs
protein F2 like fibronectin-binding protein
Length: 696-733
LPXTG
pilin motif consensus PK ($X_7$) K
E box consensus ETxAPxGY

| | | |
|---|---|---|
| SpyM3_0104/21909640 | pilin motif | 155<br>PKEKPIIYFK |
| | E box | 398<br>YTFVETAAPDGY |
| SPs0106/28895018 | pilin motif | 269<br>PKEKPIIYFK |
| | E box | 512<br>YTFVETAAPDGY |
| SpyM18_0132/19745307 | pilin motif | 269<br>PKEKPIIYFK |
| | E box | 512<br>YTFVETAAPDGY |
| orf84 | pilin motif | 269<br>PKEKPIIYFK |
| | E box | 512<br>YTFVETAAPDGY |

TYPE 4 pilus motifs
protein F2 like fibronectin-binding protein
Length: 1161
LPXTG
pilin motif consensus PK ($X_{7-8}$) K
E box consensus YxLxETxAPxGY

The protein is longer than the proteins belonging to TYPE 3 and has 4 possible pilin motifs and 2 E boxes

| | | |
|---|---|---|
| 19224141 | pilin motifs | 215<br>PKGISQDIPK<br>571<br>PKGYQQVTEK<br>156<br>PKMSVVSKYGK<br>674<br>PKYDAKNQEYK |
| | E boxes | 563<br>YDLYETKAPKGY<br>940<br>YTFVETAAPDGY |

FIGURE 60

Adhesin island 2-
Operon gbs 67, 59, 150

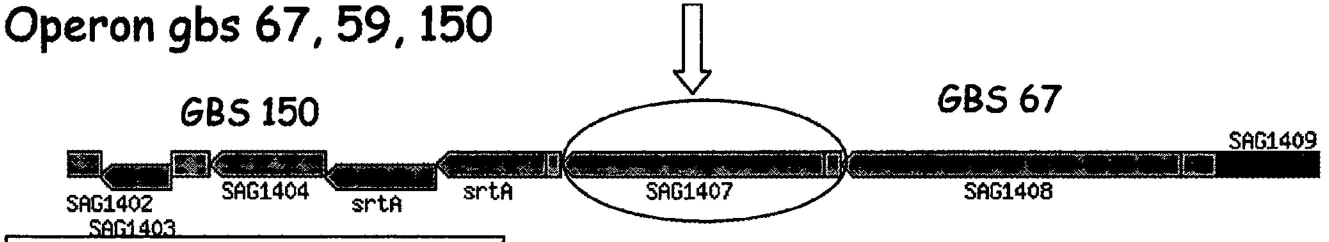

• 30 % identity with GBS 80

• By comparing GBS 59 amino acidic sequence of 2603 with that of other sequenced genomes, the following homologies are obtained:

| | |
|---|---|
| 2603 | |
| nem316 | 47% |
| h36b | 62% |
| 515 | 48% |
| cjb111 | 48% |
| 18rs21 | 100% |
| coh1 | not present (Spb1) |
| A909 | not present (Spb1) |

• CGH: 1/20 GBS strains analyzed (18RS21)

Two-by-two amino acidic sequence comparison

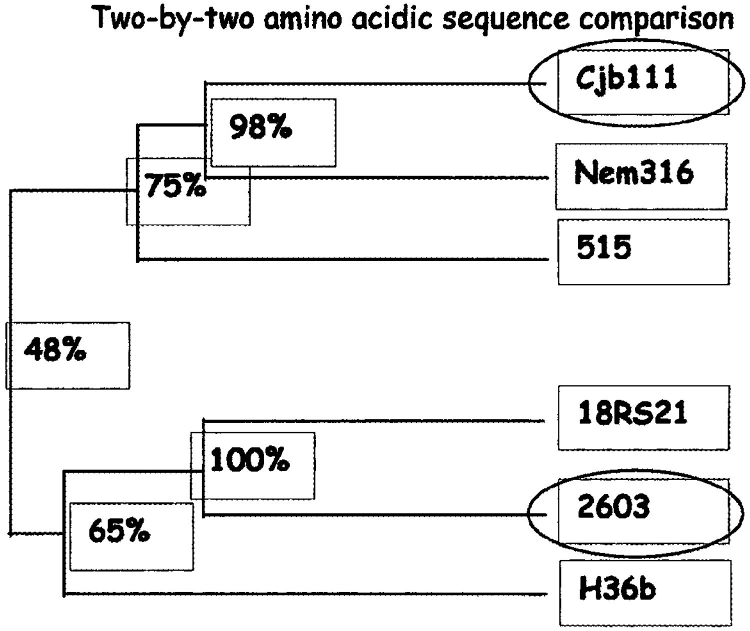

There seem to be two clusters suggesting the presence of two major isoforms

Figure 63

FACS analysis using mouse antiserum after immunization with BO1575 (gbs59) from CJB111 genome

| | | GBS 59 |
|---|---|---|
| GBS strains | Type | FACS (Δ Mean) |
| DK1 | Ia | 565 |
| DK8 | | 559 |
| Davis | | 577 |
| 515 | | 583 |
| 2986 | | 443 |
| 5551 | | 524 |
| 7357b- | | 596 |
| 5518 | | 190 |
| D136C | III | 504 |
| COH31 | | 505 |
| DK21 | II | 249 |
| CJB111 | V | 493 |
| 5364 | | 593 |
| 2110 | | 590 |
| 1999 | | 594 |
| 2210 | | 636 |
| 5408 | | 537 |
| 1169 | | 227 |

Fig. 66

WB GBS 515 Total Extract
α-67; α-150; α-59 (2603)

Controls:
GBS COH1 total extracts

• anti-gbs59 mouse serum after immunization with SAG1407 (GBS 59) from 2603 genome GBS 67 and GBS 150 are parts of
a high molecular weight polymer (pilus)
in 515 GBS strain Western Blotting ko GBS67 from 515 genome (clone 1.45)

FACS GBS 515 Δ67

Complementation of GBS 515 KO 67 with pAM401-gbs80

GBS 80 forms a high molecular weight complex (pilus) in absence of GBS 67 spyM6_0159 type 1 pilus present in M6 spyM6_0160 type 1 pilus present in M6

Gas15 type 2 pilus present in M1

Gas16 type 2 pilus present in M1

Gas18 serum 1 type 2 pilus present in M1

Gas18 serum 2 type 2 pilus present in M1 spyM3_0098 type 3 pilus present in M3 spyM3_0100 type 3 pilus present in M3 spyM3_0102 type 3 pilus present in M3 spyM3_0104 type 3 pilus present in M3 spyM3_0106 type 3 pilus present in M3

19224134 type 4 pilus present in M12

19224135 type 4 pilus present in M12

2728 M12

19224137 type 4 pilus present in M12

2728 M12

19224141 type 4 pilus present in M12

2728 M12

LEGEND:

M1 tot: total extract (M1)
M1 surf prot.: fraction enriched in surface proteins
: Purified recombinant proteins, 30 ng
I α-#: immune sera against #
P α-#: pre-immune sera

I α-15

LEGENDA:

M1 tot: total extract (M1)
M1 prot. Sup.: fraction enriched in surface proteins
#: Purified recombinant proteins, 30 ng
I α-#: immune sera against #
P α-#: pre-immune sera

LEGENDA:

M1 tot: total extract (M1)
M1 prot. Sup.: fraction enriched in surface proteins
#: Purified recombinant proteins, 30 ng
I α-#: immune sera against #
P α-#: pre-immune sera

P α-15

LEGEND:

M1 tot: total extract (M1)
M1 surf prot.: fraction enriched in surface proteins
: Purified recombinant proteins, 30 ng
I α-#: immune sera against #
P α-#: pre-immune sera

I α-16

LEGENDA:

M1 tot: total extract (M1)
M1 prot. Sup.: fraction enriched in surface proteins
#: Purified recombinant proteins, 30 ng
I α-#: immune sera against #
P α-#: pre-immune sera

P α-16

LEGENDA:

M1 tot: total extract (M1)
M1 prot. Sup.: fraction enriched in surface proteins
#: Purified recombinant proteins, 30 ng
I α-#: immune sera against #
P α-#: pre-immune sera

LEGEND:

M1 tot: total extract (M1)
M1 surf prot.: fraction enriched in surface proteins
: Purified recombinant proteins, 30 ng
I α-#: immune sera against #
P α-#: pre-immune sera

I α-18

LEGENDA:

M1 tot: total extract (M1)
M1 prot. Sup.: fraction enriched in surface proteins
#: Purified recombinant proteins, 30 ng
I α-#: immune sera against #
P α-#: pre-immune sera

LEGENDA:

M1 tot: total extract (M1)
M1 prot. Sup.: fraction enriched in surface proteins
: Purified recombinant proteins, 30 ng
I α-#: immune sera against #
P α-#: pre-immune sera

P α-18

LEGEND:

M6 tot: total extract (M6)
M6 surf prot.: fraction enriched in surface proteins
: Purified recombinant proteins, 30 ng
I α-#: immune sera against #
P α-#: pre-immune sera

LEGEND:

M12 tot: total extract (M12)
M12 surf prot.: fraction enriched in surface proteins
#: Purified recombinant proteins, 30 ng
I α-#: immune sera against #
P α-#: pre-immune sera

LEGEND:

M12 tot: total extract (M12)
M12 surf prot.: fraction enriched in surface proteins
#: Purified recombinant proteins, 30 ng
I α-#: immune sera against #
P α-#: pre-immune sera

FIGURE 101A

```
    GACAAGCTTCCTTATACGACCGCTTTCTATATCGGACTCTTCCAAGTTCTTGCTCTTTTA
  1 ---------+---------+---------+---------+---------+---------+ 60
    CTGTTCGAAGGAATATGCTGGCGAAAGATATAGCCTGAGAAGGTTCAAGAACGAGAAAAT

    CCAGGGACTAGCCGTTCAGGTGCAACGATTGTCGGTGGTTTGTTAAATGGAACCAGTCGT
 61 ---------+---------+---------+---------+---------+---------+ 120
    GGTCCCTGATCGGCAAGTCCACGTTGCTAACAGCCACCAAACAATTTACCTTGGTCAGCA

    TCAGTTGTGACAGAATTTACCTTCTATCTTGGGATTCCCGTTATGTTTGGAGCTAGTGCC
121 ---------+---------+---------+---------+---------+---------+ 180
    AGTCAACACTGTCTTAAATGGAAGATAGAACCCTAAGGGCAATACAAACCTCGATCACGG

    TTAAAGATTTTCAAATTTGTGAAAGCCGGAGAACTCTTGAGCTTTGGGCAATTGTTTTTG
181 ---------+---------+---------+---------+---------+---------+ 240
    AATTTCTAAAAGTTTAAACACTTTCGGCCTCTTGAGAACTCGAAACCCGTTAACAAAAAC

    CTCTTGGTCGCGATGGGAGTAGCTTTTGCGGTCAGCATGGTGGCTATTCGCTTCTTGACC
241 ---------+---------+---------+---------+---------+---------+ 300
    GAGAACCAGCGCTACCCTCATCGAAAACGCCAGTCGTACCACCGATAAGCGAAGAACTGG

    AGCTATGTGAAAAAACACGACTTCACCCTTTTTGGTAAATACCGTATCGTGCTTGGTAGT
301 ---------+---------+---------+---------+---------+---------+ 360
    TCGATACACTTTTTTGTGCTGAAGTGGGAAAAACCATTTATGGCATAGCACGAACCATCA

    GTTTTGCTACTTTACAGTTTTGTCCGTTTATTTGTATAAGAAAAACCTTGAAGGGGTAAC
361 ---------+---------+---------+---------+---------+---------+ 420
    CAAAACGATGAAATGTCAAAACAGGCAAATAAACATATTCTTTTTGGAACTTCCCCATTG

    TCTTCAAGGTTTTATACTCTTAGAAAATCTCTTCAAACCGCGTCAGCTTTATCTGCAACC
421 ---------+---------+---------+---------+---------+---------+ 480
    AGAAGTTCCAAAATATGAGAATCTTTTAGAGAAGTTTGGCGCAGTCGAAATAGACGTTGG
```

Figure 101B

```
    TCAAAACAGTGTTTTGAGCAGCCTGCGGCTAGCTTCCTAGTTTGCTCTTTGATTTTCATT
481 ---------+---------+---------+---------+---------+---------+ 540
    AGTTTTGTCACAAAACTCGTCGGACGCCGATCGAAGGATCAAACGAGAAACTAAAAGTAA

    GAGCTTTAAAATCCAGTCAGGGTAATCCCCAATAGGCGGACACCTCTTTCTTTCTCGCTT
541 ---------+---------+---------+---------+---------+---------+ 600
    CTCGAAATTTTAGGTCAGTCCCATTAGGGGTTATCCGCCTGTGGAGAAAGAAAGAGCGAA

    AATTCTTCATAGAGTTGCAGGGCTATTTGGCTTATCTGACTAGCATCTTGTGTTTTTTGG
601 ---------+---------+---------+---------+---------+---------+ 660
    TTAAGAAGTATCTCAACGTCCCGATAAACCGAATAGACTGATCGTAGAACACAAAAAACC

    CAAGACTTTTTCGTTTGGTAAGAGTTGAAAAGTCCTCGTAGCGGATTTTCAAAATGACAA
661 ---------+---------+---------+---------+---------+---------+ 720
    GTTCTGAAAAAGCAAACCATTCTCAACTTTTCAGGAGCATCGCCTAAAAGTTTTACTGTT

    TTTTTCCAGCTTTTTCTTGTTGATGTAGATTGAGAGCGACTTTTTCTGATAGAAGAGTCA
721 ---------+---------+---------+---------+---------+---------+ 780
    AAAAAGGTCGAAAAAGAACAACTACATCTAACTCTCGCTGAAAAAGACTATCTTCTCAGT

    GCTCTTTTTTGATATCTTCCTCGGCACGGAGAATCTTCCCGTAGGTTTTCTCCTTGCCGA
781 ---------+---------+---------+---------+---------+---------+ 840
    CGAGAAAAAACTATAGAAGGAGCCGTGCCTCTTAGAAGGGCATCCAAAAGAGGAACGGCT

    TTGATTTACGGATGCGATTGGATTTGACTGGAGAGTTGTGAATGCCACGAGCCTTTCGAT
841 ---------+---------+---------+---------+---------+---------+ 900
    AACTAAATGCCTACGCTAACCTAAACTGACCTCTCAACACTTACGGTGCTCGGAAAGCTA

    ACAGATCATAGCCTAGTCTACCAAAACGGTCTATTAGGGTTACCTCAGGAACTTCAAGTA
901 ---------+---------+---------+---------+---------+---------+ 960
    TGTCTAGTATCGGATCAGATGGTTTTGCCAGATAATCCCAATGGAGTCCTTGAAGTTCAT
```

Figure 101C

```
     AATCAGCACCAGTAAAAACGCCCATTTGATGAAGACGTTCTACTGTCTTTTTTCCTACTC
 961 ---------+---------+---------+---------+---------+---------+ 1020
     TTAGTCGTGGTCATTTTTGCGGGTAAACTACTTCTGCAAGATGACAGAAAAAAGGATGAG

     CATGAAATTTGGAAATATCCATTTGTTTGAGAAAATCCTCAGCCTGTTCAGGTAGAATCA
1021 ---------+---------+---------+---------+---------+---------+ 1080
     GTACTTTAAACCTTTATAGGTAAACAAACTCTTTTAGGAGTCGGACAAGTCCATCTTAGT

     CTGTCAAACCATGTGGTTTTTGATAATCACTCGCCATTTTAGCTAAGAATTTGTTGTAAG
1081 ---------+---------+---------+---------+---------+---------+ 1140
     GACAGTTTGGTACACCAAAAACTATTAGTGAGCGGTAAAATCGATTCTTAAACAACATTC

     AAACGCCTGCGGAAGCAGTTAGATGGAGTTCTTTCCAGATATCTTTTTGAATGAGGCGAG
1141 ---------+---------+---------+---------+---------+---------+ 1200
     TTTGCGGACGCCTTCGTCAATCTACCTCAAGAAAGGTCTATAGAAAAACTTACTCCGCTC

     CAATTTTGACCGCTGACTTGATACCGAGTTTATTTTCTGTCACATCCAAATAGGCTTCGT
1201 ---------+---------+---------+---------+---------+---------+ 1260
     GTTAAAACTGGCGACTGAACTATGGCTCAAATAAAAGACAGTGTAGGTTTATCCGAAGCA

     CAATGCTCATGGGTTCAATCAAATCTGTATAGCGCTTAAAAATAGCTCGAATCCGGAGTC
1261 ---------+---------+---------+---------+---------+---------+ 1320
     GTTACGAGTACCCAAGTTAGTTTAGACATATCGCGAATTTTTATCGAGCTTAGGCCTCAG

     CCACAGACTTGTATTTCTCATAATTCCCTGAGATAAAGACAGCCTGGGGACAACGTTCAT
1321 ---------+---------+---------+---------+---------+---------+ 1380
     GGTGTCTGAACATAAAGAGTATTAAGGGACTCTATTTCTGTCGGACCCCTGTTGCAAGTA

     AAGCTTCCTTGGAACTCATGGCAGAATGGACACCAAAAGCTCTTGCCTCATAACTACAGG
1381 ---------+---------+---------+---------+---------+---------+ 1440
     TTCGAAGGAACCTTGAGTACCGTCTTACCTGTGGTTTTCGAGAACGGAGTATTGATGTCC
```

Figure 101D

```
     TAGAAACGACTCCCCGTCCACCTGTTTGCCGAGGGTCGCTTCCAATAATGACAGGTTTTC
1441 ---------+---------+---------+---------+---------+---------+ 1500
     ATCTTTGCTGAGGGGCAGGTGGACAAACGGCTCCCAGCGAAGGTTATTACTGTCCAAAAG

     CTCTGAGTTTAGGATTATCCCTGATTTCCACTGCAGCAAAAAAGGCATCCATGTCAATAT
1501 ---------+---------+---------+---------+---------+---------+ 1560
     GAGACTCAAATCCTAATAGGGACTAAAGGTGACGTCGTTTTTTCCGTAGGTACAGTTATA

     GGATGATTTTTCTTGACAAATCATTTAACAAAGGAAAAATCAACATGCCTAGCACCTTTT
1561 ---------+---------+---------+---------+---------+---------+ 1620
     CCTACTAAAAAGAACTGTTTAGTAAATTGTTTCCTTTTTAGTTGTACGGATCGTGGAAAA

     TATACTCTTCGAAAATCTCTTCAAACCACGTCAGCTTCCATCTGCAACCTCAAAACAGTA
1621 ---------+---------+---------+---------+---------+---------+ 1680
     ATATGAGAAGCTTTTAGAGAAGTTTGGTGCAGTCGAAGGTAGACGTTGGAGTTTTGTCAT

     TTTTGAGCTGACTTCGTCAGTTCTATTTACAACCTCAAAGCAGTGCTTTGAGCAGCCTGC
1681 ---------+---------+---------+---------+---------+---------+ 1740
     AAAACTCGACTGAAGCAGTCAAGATAAATGTTGGAGTTTCGTCACGAAACTCGTCGGACG

     GGCTAGTTTCCTAGTTTGCTTTTCGATTTCCATTGAGTGTAACTGCTTATTTTCTTTTAT
1741 ---------+---------+---------+---------+---------+---------+ 1800
     CCGATCAAAGGATCAAACGAAAAGCTAAAGGTAACTCACATTGACGAATAAAAGAAAATA

     TATACCCTTTTTTCTGAAAAAAAGAAAAAAGGACTTTATTTTTTTCAAAAATATAATACA
1801 ---------+---------+---------+---------+---------+---------+ 1860
     ATATGGGAAAAAAGACTTTTTTTCTTTTTTCCTGAAATAAAAAAAGTTTTTATATTATGT

     GTTTGAAATAAAATATAGACTGTTTTAGAAAAGAAAGTGTAAAAATAGGAATTTTTCACT
1861 ---------+---------+---------+---------+---------+---------+ 1920
     CAAACTTTATTTTATATCTGACAAAATCTTTTCTTTCACATTTTTATCCTTAAAAAGTGA
```

Figure 101E

```
          TGTTGAAATCGGTTACTTTATGGTATACTTGTCTCATGAATGTAACAGATGACTGTTACT
     1921 ---------+---------+---------+---------+---------+---------+ 1980
          ACAACTTTAGCCAATGAAATACCATATGAACAGAGTACTTACATTGTCTACTGACAATGA

          AGAAAAAAGAGGACATTAATATGGTTGTTAAGACAGTTGTTGAAGCACAAGATATTTTTG
     1981 ---------+---------+---------+---------+---------+---------+ 2040
          TCTTTTTTCTCCTGTAATTATACCAACAATTCTGTCAACAACTTCGTGTTCTATAAAAAC

c                             M  V  V  K  T  V  V  E  A  Q  D  I  F  D - this orf is the homologue of sp0459, a formate
                                                                          acetyltransferase (pfl). It is out of the
                                                                          pilus locus
          ACAAAGCTTGGGAAGGCTTCAAAGGCGTAGATTGGAAAGAAAAAGCAAGTGTATCACGCT
     2041 ---------+---------+---------+---------+---------+---------+ 2100
          TGTTTCGAACCCTTCCGAAGTTTCCGCATCTAACCTTTCTTTTTCGTTCACATAGTGCGA

c           K  A  W  E  G  F  K  G  V  D  W  K  E  K  A  S  V  S  R  F -

          TTGTACAAGCTAACTACACACCTTATGATGGAGACGAAAGCTTCCTTGCAGGACCAACAG
     2101 ---------+---------+---------+---------+---------+---------+ 2160
          AACATGTTCGATTGATGTGTGGAATACTACCTCTGCTTTCGAAGGAACGTCCTGGTTGTC

c           V  Q  A  N  Y  T  P  Y  D  G  D  E  S  F  L  A  G  P  T  E -

          AGCGTTCACTTCACATCAAGAAAATTGTAGAAGAAACTAAAGCACACTACGAAGAAACTC
     2161 ---------+---------+---------+---------+---------+---------+ 2220
          TCGCAAGTGAAGTGTAGTTCTTTTAACATCTTCTTTGATTTCGTGTGATGCTTCTTTGAG

c           R  S  L  H  I  K  K  I  V  E  E  T  K  A  H  Y  E  E  T  R -

          GTTTCCCAATGGACACTCGTCCAACATCTATCGCTGATATCCCTGCTGGATTTATCGACA
     2221 ---------+---------+---------+---------+---------+---------+ 2280
          CAAAGGGTTACCTGTGAGCAGGTTGTAGATAGCGACTATAGGGACGACCTAAATAGCTGT

c           F  P  M  D  T  R  P  T  S  I  A  D  I  P  A  G  F  I  D  K -

          AAGAAAATGAAGTTATCTTTGGTATCCAAAATGATGAACTCTTCAAATTGAACTTCATGC
     2281 ---------+---------+---------+---------+---------+---------+ 2340
          TTCTTTTACTTCAATAGAAACCATAGGTTTTACTACTTGAGAAGTTTAACTTGAAGTACG
```

```
c          E  N  E  V  I  F  G  I  Q  N  D  E  L  F  K  L  N  F  M  P -

         CAAAAGGTGGTATCCGTATGGCTGAAACTACTTTAAAAGAAAATGGATACGAACCAGACC
    2341 ---------+---------+---------+---------+---------+---------+ 2400
         GTTTTCCACCATAGGCATACCGACTTTGATGAAATTTTCTTTTACCTATGCTTGGTCTGG

c          K  G  G  I  R  M  A  E  T  T  L  K  E  N  G  Y  E  P  D  P -

         CAGCTGTTCACGAAATCTTCACTAAATATGTAACAACAGTTAACGACGGTATTTTCCGTG
    2401 ---------+---------+---------+---------+---------+---------+ 2460
         GTCGACAAGTGCTTTAGAAGTGATTTATACATTGTTGTCAATTGCTGCCATAAAAGGCAC

c          A  V  H  E  I  F  T  K  Y  V  T  T  V  N  D  G  I  F  R  A -

         CCTACACTTCAAATATTCGTCGCGCTCGTCATGCACACACTGTAACTGGTCTTCCAGATG
    2461 ---------+---------+---------+---------+---------+---------+ 2520
         GGATGTGAAGTTTATAAGCAGCGCGAGCAGTACGTGTGTGACATTGACCAGAAGGTCTAC

c          Y  T  S  N  I  R  R  A  R  H  A  H  T  V  T  G  L  P  D  A -

         CATACTCACGCGGACGTATCATCGGTGTTTACGCACGTCTTGCTCTTTACGGTGCAGACT
    2521 ---------+---------+---------+---------+---------+---------+ 2580
         GTATGAGTGCGCCTGCATAGTAGCCACAAATGCGTGCAGAACGAGAAATGCCACGTCTGA

c          Y  S  R  G  R  I  I  G  V  Y  A  R  L  A  L  Y  G  A  D  Y -

         ACTTGATGCAAGAAAAAGTAAACGACTGGAATGCAATCAAAGAAATCGATGAAGAAACAA
    2581 ---------+---------+---------+---------+---------+---------+ 2640
         TGAACTACGTTCTTTTTCATTTGCTGACCTTACGTTAGTTTCTTTAGCTACTTCTTTGTT

c          L  M  Q  E  K  V  N  D  W  N  A  I  K  E  I  D  E  E  T  I -

         TCCGTCTTCGTGAAGAAGTAAACCTTCAATACCAAGCATTGCAACAAGTTGTTCGCCTGG
    2641 ---------+---------+---------+---------+---------+---------+ 2700
         AGGCAGAAGCACTTCTTCATTTGGAAGTTATGGTTCGTAACGTTGTTCAACAAGCGGACC

c          R  L  R  E  E  V  N  L  Q  Y  Q  A  L  Q  Q  V  V  R  L  G -

         GTGACCTTTACGGGGTTGATGTTCGCAAACCAGCGATGAACGTGAAAGAAGCAATCCAAT
    2701 ---------+---------+---------+---------+---------+---------+ 2760
```

Figure 101G

```
            CACTGGAAATGCCCCAACTACAAGCGTTTGGTCGCTACTTGCACTTTCTTCGTTAGGTTA

c            D  L  Y  G  V  D  V  R  K  P  A  M  N  V  K  E  A  I  Q  W -

            GGGTTAACATTGCTTTCATGGCTGTCTGCCGTGTGATTAACGGTGCTGCTACATCTCTAG
      2761 ---------+---------+---------+---------+---------+---------+ 2820
            CCCAATTGTAACGAAAGTACCGACAGACGGCACACTAATTGCCACGACGATGTAGAGATC

c            V  N  I  A  F  M  A  V  C  R  V  I  N  G  A  A  T  S  L  G -

            GTCGTGTACCAATCGTATTGGACATCTTTGCAGAACGTGACCTTGCTCGTGGTACATTTA
      2821 ---------+---------+---------+---------+---------+---------+ 2880
            CAGCACATGGTTAGCATAACCTGTAGAAACGTCTTGCACTGGAACGAGCACCATGTAAAT

c            R  V  P  I  V  L  D  I  F  A  E  R  D  L  A  R  G  T  F  T -

            CTGAATCAGAAATCCAAGAATTCGTTGATGATTTCGTTATGAAACTTCGTACAGTTAAAT
      2881 ---------+---------+---------+---------+---------+---------+ 2940
            GACTTAGTCTTTAGGTTCTTAAGCAACTACTAAAGCAATACTTTGAAGCATGTCAATTTA

c            E  S  E  I  Q  E  F  V  D  D  F  V  M  K  L  R  T  V  K  F -

            TTGCTCGTACCAAAGCTTATGACCAATTGTACTCAGGTGACCCAACCTTTATCACAACTT
      2941 ---------+---------+---------+---------+---------+---------+ 3000
            AACGAGCATGGTTTCGAATACTGGTTAACATGAGTCCACTGGGTTGGAAATAGTGTTGAA

c            A  R  T  K  A  Y  D  Q  L  Y  S  G  D  P  T  F  I  T  T  S -

            CTATGGCTGGTATGGGTAACGACGGTCGTCACCGTGTTACTAAGATGGACTACCGTTTCT
      3001 ---------+---------+---------+---------+---------+---------+ 3060
            GATACCGACCATACCCATTGCTGCCAGCAGTGGCACAATGATTCTACCTGATGGCAAAGA

c            M  A  G  M  G  N  D  G  R  H  R  V  T  K  M  D  Y  R  F  L -

            TGAACACTCTTGACAACATCGGTAACTCACCAGAACCAAACTTGACAGTTCTTTGGACTG
      3061 ---------+---------+---------+---------+---------+---------+ 3120
            ACTTGTGAGAACTGTTGTAGCCATTGAGTGGTCTTGGTTTGAACTGTCAAGAAACCTGAC

c            N  T  L  D  N  I  G  N  S  P  E  P  N  L  T  V  L  W  T  D -
```

Figure 101H

```
         ACAAATTGCCATACAACTTCCGTCGCTACTGTATGCACATGAGCCACAAACACTCTTCTA
   3121 ---------+---------+---------+---------+---------+---------+ 3180
         TGTTTAACGGTATGTTGAAGGCAGCGATGACATACGTGTACTCGGTGTTTGTGAGAAGAT

c          K  L  P  Y  N  F  R  R  Y  C  M  H  M  S  H  K  H  S  S  I -

         TCCAATACGAAGGTGTAACAACAATGGCTAAAGACGGATATGGTGAAATGAGCTGTATCT
   3181 ---------+---------+---------+---------+---------+---------+ 3240
         AGGTTATGCTTCCACATTGTTGTTACCGATTTCTGCCTATACCACTTTACTCGACATAGA

c          Q  Y  E  G  V  T  T  M  A  K  D  G  Y  G  E  M  S  C  I  S -

         CATGCTGTGTGTCTCCACTTGATCCAGAAAATGAAGAACAACGCCACAACATCCAGTACT
   3241 ---------+---------+---------+---------+---------+---------+ 3300
         GTACGACACACAGAGGTGAACTAGGTCTTTTACTTCTTGTTGCGGTGTTGTAGGTCATGA

c          C  C  V  S  P  L  D  P  E  N  E  E  Q  R  H  N  I  Q  Y  F -

         TCGGTGCTCGTGTAAACGTTCTTAAAGCCCTTCTTACTGGTTTGAATGGTGGTTACGACG
   3301 ---------+---------+---------+---------+---------+---------+ 3360
         AGCCACGAGCACATTTGCAAGAATTTCGGGAAGAATGACCAAACTTACCACCAATGCTGC

c          G  A  R  V  N  V  L  K  A  L  L  T  G  L  N  G  G  Y  D  D -

         ATGTTCACAAAGACTACAAAGTATTTGATATCGAACCAATCCGTGACGAAGTTCTTGAAT
   3361 ---------+---------+---------+---------+---------+---------+ 3420
         TACAAGTGTTTCTGATGTTTCATAAACTATAGCTTGGTTAGGCACTGCTTCAAGAACTTA

c          V  H  K  D  Y  K  V  F  D  I  E  P  I  R  D  E  V  L  E  F -

         TTGAATCAGTTAAAGCGAACTTTGAAAAATCTCTTGACTGGTTGACTGACACTTACGTAG
   3421 ---------+---------+---------+---------+---------+---------+ 3480
         AACTTAGTCAATTTCGCTTGAAACTTTTTAGAGAACTGACCAACTGACTGTGAATGCATC

c          E  S  V  K  A  N  F  E  K  S  L  D  W  L  T  D  T  Y  V  D -

         ATGCCTTGAACATCATCCACTACATGACTGATAGGTACAACTACGAAGCTGTTCAAATGG
   3481 ---------+---------+---------+---------+---------+---------+ 3540
         TACGGAACTTGTAGTAGGTGATGTACTGACTATCCATGTTGATGCTTCGACAAGTTTACC
```

```
c          A  L  N  I  I  H  Y  M  T  D  R  Y  N  Y  E  A  V  Q  M  A -

        CCTTCTTGCCAACTAAACAACGTGCCAACATGGGATTCGGTATCTGTGGATTTGCTAACA
   3541 ---------+---------+---------+---------+---------+---------+ 3600
        GGAAGAACGGTTGATTTGTTGCACGGTTGTACCCTAAGCCATAGACACCTAAACGATTGT

c          F  L  P  T  K  Q  R  A  N  M  G  F  G  I  C  G  F  A  N  T -

        CTGTTGATACATTGTCAGCTATCAAATACGCTACAGTTAAACCAATCCGTGACGAAGATG
   3601 ---------+---------+---------+---------+---------+---------+ 3660
        GACAACTATGTAACAGTCGATAGTTTATGCGATGTCAATTTGGTTAGGCACTGCTTCTAC

c          V  D  T  L  S  A  I  K  Y  A  T  V  K  P  I  R  D  E  D  G -

        GCTACATCTACGATTACGAAACAATCGGTGACTACCCACGCTGGGGTGAAGATGACCCAC
   3661 ---------+---------+---------+---------+---------+---------+ 3720
        CGATGTAGATGCTAATGCTTTGTTAGCCACTGATGGGTGCGACCCCACTTCTACTGGGTG

c          Y  I  Y  D  Y  E  T  I  G  D  Y  P  R  W  G  E  D  D  P  R -

        GTTCAAACGAATTGGCAGAATGGTTGATCGAAGCTTACACAACTCGTCTACGTAGCCACA
   3721 ---------+---------+---------+---------+---------+---------+ 3780
        CAAGTTTGCTTAACCGTCTTACCAACTAGCTTCGAATGTGTTGAGCAGATGCATCGGTGT

c          S  N  E  L  A  E  W  L  I  E  A  Y  T  T  R  L  R  S  H  K -

        AACTATACAAAGACGCAGAAGCTACAGTATCACTTTTGACAATCACATCTAACGTTGCTT
   3781 ---------+---------+---------+---------+---------+---------+ 3840
        TTGATATGTTTCTGCGTCTTCGATGTCATAGTGAAAACTGTTAGTGTAGATTGCAACGAA

c          L  Y  K  D  A  E  A  T  V  S  L  L  T  I  T  S  N  V  A  Y -

        ACTCTAAACAAACTGGTAACTCACCAGTTCACAAAGGTGTATACCTCAACGAAGATGGTT
   3841 ---------+---------+---------+---------+---------+---------+ 3900
        TGAGATTTGTTTGACCATTGAGTGGTCAAGTGTTTCCACATATGGAGTTGCTTCTACCAA

c          S  K  Q  T  G  N  S  P  V  H  K  G  V  Y  L  N  E  D  G  S -

        CTGTGAACTTGTCTAAACTTGAATTCTTCTCACCAGGTGCTAACCCATCTAACAAAGCTA
   3901 ---------+---------+---------+---------+---------+---------+ 3960
```

Figure 101J

```
           GACACTTGAACAGATTTGAACTTAAGAAGAGTGGTCCACGATTGGGTAGATTGTTTCGAT

c            V  N  L  S  K  L  E  F  F  S  P  G  A  N  P  S  N  K  A  K -

           AAGGTGGTTGGTTGCAAAACTTGAACTCACTTTCTAGCCTTGACTTTAGTTATGCAGCTG
      3961 ---------+---------+---------+---------+---------+---------+ 4020
           TTCCACCAACCAACGTTTTGAACTTGAGTGAAAGATCGGAACTGAAATCAATACGTCGAC

c            G  G  W  L  Q  N  L  N  S  L  S  S  L  D  F  S  Y  A  A  D -

           ACGGTATCTCATTGACTACACAAGTATCACCTCGCGCTCTTGGTAAGACTCGTGATGAAC
      4021 ---------+---------+---------+---------+---------+---------+ 4080
           TGCCATAGAGTAACTGATGTGTTCATAGTGGAGCGCGAGAACCATTCTGAGCACTACTTG

c            G  I  S  L  T  T  Q  V  S  P  R  A  L  G  K  T  R  D  E  Q -

           AAGTTGATAACTTGGTAACAATCCTTGATGGTTACTTCGAAAACGGTGGACAACACGTTA
      4081 ---------+---------+---------+---------+---------+---------+ 4140
           TTCAACTATTGAACCATTGTTAGGAACTACCAATGAAGCTTTTGCCACCTGTTGTGCAAT

c            V  D  N  L  V  T  I  L  D  G  Y  F  E  N  G  G  Q  H  V  N -

           ACTTGAACGTTATGGACTTGAACGATGTTTACGAAAAAATCATGTCAGGCGAAGACGTTA
      4141 ---------+---------+---------+---------+---------+---------+ 4200
           TGAACTTGCAATACCTGAACTTGCTACAAATGCTTTTTTAGTACAGTCCGCTTCTGCAAT

c            L  N  V  M  D  L  N  D  V  Y  E  K  I  M  S  G  E  D  V  I -

           TCGTACGTATCTCTGGATACTGTGTAAACACTAAATACCTCACTCCAGAACAAAAAACTG
      4201 ---------+---------+---------+---------+---------+---------+ 4260
           AGCATGCATAGAGACCTATGACACATTTGTGATTTATGGAGTGAGGTCTTGTTTTTTGAC

c            V  R  I  S  G  Y  C  V  N  T  K  Y  L  T  P  E  Q  K  T  E -

           AATTGACACAACGTGTCTTCCACGAAGTTCTTTCAATGGATGACGCCTTGGATGCATTGA
      4261 ---------+---------+---------+---------+---------+---------+ 4320
           TTAACTGTGTTGCACAGAAGGTGCTTCAAGAAAGTTACCTACTGCGGAACCTACGTAACT

c            L  T  Q  R  V  F  H  E  V  L  S  M  D  D  A  L  D  A  L  S -
```

Figure 101K

```
       GCTAATCAAGTTCTTGAATAATAAAAAGGGCTCTTTGTCAACTGTAGTGGGTTGAAGAAA
  4321 ---------+---------+---------+---------+---------+---------+ 4380
       CGATTAGTTCAAGAACTTATTATTTTTCCCGAGAAACAGTTGACATCACCCAACTTCTTT

c         *                                                          -

       AGCTAAGCTCGAGAAAGGACAAATTTTGTCCTTTCTTTTTTGATGTTCAGAGCGATGAAA
  4381 ---------+---------+---------+---------+---------+---------+ 4440
       TCGATTCGAGCTCTTTCCTGTTTAAAACAGGAAAGAAAAAACTACAAGTCTCGCTACTTT

e           *  A  R  S  L  V  F  K  T  R  E  K  K  I  N  L  A  I  F  -orf1_670 homologue of sp0460, transposase

       ATCCGTTTTTTGAAGTTTTCAAAGTTCCGAAAACCAAAGGCATTGCGCTTGATGTCTTTG
  4441 ---------+---------+---------+---------+---------+---------+ 4500
       TAGGCAAAAAACTTCAAAAGTTTCAAGGCTTTTGGTTTCCGTAACGCGAACTACAGAAAC

e        I  R  K  K  F  N  E  F  N  R  F  G  F  A  N  R  K  I  D  K  -

       ATGAGTTTGTTAGTGGCCTCAAGTTTAGCGTTAGAATAAGGCAATTCAATGGCGTTAGTG
  4501 ---------+---------+---------+---------+---------+---------+ 4560
       TACTCAAACAATCACCGGAGTTCAAATCGCAATCTTATTCCGTTAAGTTACCGCAATCAC

e        I  L  K  N  T  A  E  L  K  A  N  S  Y  P  L  E  I  A  N  T  -

       ATGTAGTTTTTATAGCAAATAAATGTGCTCAAAGTGGTTTTAAAGGTGCGGTTGAGATGA
  4561 ---------+---------+---------+---------+---------+---------+ 4620
       TACATCAAAAATATCGTTTATTTACACGAGTTTCACCAAAATTTCCACGCCAACTCTACT

e        I  Y  N  K  Y  C  I  F  T  S  L  T  T  K  F  T  R  N  L  H  -

       GGTAACGTGTCTTGAATTAAGCCCCAAAACTGGTCAGTATTCTTCTCTTGTAGATGAAAT
  4621 ---------+---------+---------+---------+---------+---------+ 4680
       CCATTGCACAGAACTTAATTCGGGGTTTTGACCAGTCATAAGAAGAGAACATCTACTTTA

e        P  L  T  D  Q  I  L  G  W  F  Q  D  T  N  K  E  Q  L  H  F  -

       AGGAGTAGTTGATACAGGTCATAGTAATCTTTAAGTTCAGGTACTAGAGTAAAGATTTTC
  4681 ---------+---------+---------+---------+---------+---------+ 4740
       TCCTCATCAACTATGTCCAGTATCATTAGAAATTCAAGTCCATGATCTCATTTCTAAAAG
```

```
e        L  L  L  Q  Y  L  D  Y  Y  D  K  L  E  P  V  L  T  F  I  K  -

         TTCAGACACTCCCTAGGAGTTAAGGTCTCTCTGAAAGTTCTAGCATAGAAAGGCTTAAGA
    4741 ---------+---------+---------+---------+---------+---------+ 4800
         AAGTCTGTGAGGGATCCTCAATTCCAGAGAGACTTTCAAGATCGTATCTTTCCGAATTCT

e        K  L  C  E  R  P  T  L  T  E  R  F  T  R  A  Y  F  P  K  L  -

         GAGAGTTTCCGACTATCTTTTAGGATAAATTTCCAGTAATATTTAAGAGCTCTGTATTCC
    4801 ---------+---------+---------+---------+---------+---------+ 4860
         CTCTCAAAGGCTGATAGAAAATCCTATTTAAAGGTCATTATAAATTCTCGAGACATAAGG

e        S  L  K  R  S  D  K  L  I  F  K  W  Y  Y  K  L  A  R  Y  E  -

         AGAGATTTATCATCAAATTGCTTCATGATGTTGATTCTAGTCTGATTAAGAGCCCTGCTC
    4861 ---------+---------+---------+---------+---------+---------+ 4920
         TCTCTAAATAGTAGTTTAACGAAGTACTACAACTAAGATCAGACTAATTCTCGGGACGAG

e        L  S  K  D  D  F  Q  K  M  I  N  I  R  T  Q  N  L  A  R  S  -

         ATGTGTTGGACAATGTGGAAACGATCGAGAACAATTTTAGCATTGGGAAATAATTTCTTA
    4921 ---------+---------+---------+---------+---------+---------+ 4980
         TACACAACCTGTTACACCTTTGCTAGCTCTTGTTAAAATCGTAACCCTTTATTAAAGAAT

e        M  H  Q  V  I  H  F  R  D  L  V  I  K  A  N  P  F  L  K  K  -

         ATGAGAGGGATATAACTTCCAGACATATCAACAGTGACGACTTTAACTTTTTTTCTAGCT
    4981 ---------+---------+---------+---------+---------+---------+ 5040
         TACTCTCCCTATATTGAAGGTCTGTATAGTTGTCACTGCTGAAATTGAAAAAAAGATCGA

e        I  L  P  I  Y  S  G  S  M  D  V  T  V  V  K  V  K  K  R  A  -

         TCTTTCGAGTACTTGAAGAAATGATTTCGGATGGTTGTTTGACGTCTGTTATCAAGAATG
    5041 ---------+---------+---------+---------+---------+---------+ 5100
         AGAAAGCTCATGAACTTCTTTACTAAAGCCTACCAACAAACTGCAGACAATAGTTCTTAC

e        E  K  S  Y  K  F  F  H  N  R  I  T  T  Q  R  R  N  D  L  I  -

         GTCATGATTTTCTTAGTGTTGAAATCCTGAGCAATGAAAGCCAATTTCCCCTTCTGGTAG
    5101 ---------+---------+---------+---------+---------+---------+ 5160
```

Figure 101M

```
          CAGTACTAAAAGAATCACAACTTTAGGACTCGTTACTTTCGGTTAAAGGGGAAGACCATC

e          T  M  I  K  K  T  N  F  D  Q  A  I  F  A  L  K  G  K  Q  Y  -

          GAGAATTCATCCCAGGAGAGGATTTCAGGCAAAGTGGTGTAATCCTCTTGGAAATGAAAT
     5161 ---------+---------+---------+---------+---------+---------+ 5220
          CTCTTAAGTAGGGTCCTCTCCTAAAGTCCGTTTCACCACATTAGGAGAACCTTTACTTTA

e          S  F  E  D  W  S  L  I  E  P  L  T  T  Y  D  E  Q  F  H  F  -

          TGCTTGAGCTTACGATAGACGGTAGAGGTAGAGGTAGAGATGGCTAATTTAGAAGCGATA
     5221 ---------+---------+---------+---------+---------+---------+ 5280
          ACGAACTCGAATGCTATCTGCCATCTCCATCTCCATCTCTACCGATTAAATCTTCGCTAT

e          Q  K  L  K  R  Y  V  T  S  T  S  T  S  I  A  L  K  S  A  I  -

          TGTGTAAGAGCCTCTCTGTTGAGTAGGAGTTGGGCAATTTTCTGTCTCACCATTTCCGAG
     5281 ---------+---------+---------+---------+---------+---------+ 5340
          ACACATTCTCGGAGAGACAACTCATCCTCAACCCGTTAAAAGACAGAGTGGTAAAGGCTC

e          H  T  L  A  E  R  N  L  L  L  Q  A  I  K  Q  R  V  M  E  S  -

          ATTTGGCAATTTTTCTGAACGAGAGTTGTTTCAGCTACAGTGACTTTCCGACAGGACTTG
     5341 ---------+---------+---------+---------+---------+---------+ 5400
          TAAACCGTTAAAAAGACTTGCTCTCAACAAAGTCGATGTCACTGAAAGGCTGTCCTGAAC

e          I  Q  C  N  K  Q  V  L  T  T  E  A  V  T  V  K  R  C  S  K  -

          CATTGAAATCGTCTCTTTTTCAAATGAATGAGGCTAGGGAAACCACCAATCTCGATAAAA
     5401 ---------+---------+---------+---------+---------+---------+ 5460
          GTAACTTTAGCAGAGAAAAAGTTTACTTACTCCGATCCCTTTGGTGGTTAGAGCTATTTT

e          C  Q  F  R  R  K  K  L  H  I  L  S  P  F  G  G  I  E  I  F  -

          GGGATTTTAGAAGGCTTTTGGAAGTCGTATTTGATTTGTTTTCCTTTACAGTGTTTACAT
     5461 ---------+---------+---------+---------+---------+---------+ 5520
          CCCTAAAATCTTCCGAAAACCTTCAGCATAAACTAAACAAAAGGAAATGTCACAAATGTA

e          P  I  K  S  P  K  Q  F  D  Y  K  I  Q  K  G  K  C  H  K  C  -
```

Figure 101N

```
          TTAGGTGGGTGATAATCAAGTGTAGCGAAGACTTCGATATGGGTATCGTGCTGAATGGCT
     5521 ---------+---------+---------+---------+---------+---------+ 5580
          AATCCACCCACTATTAGTTCACATCGCTTCTGAAGCTATACCCATAGCACGACTTACCGA

e          K  P  P  H  Y  D  L  T  A  F  V  E  I  H  T  D  H  Q  I  A  -

          TTATTTAAGGTGATGTTTTTGTCTTTTATTCCGATGAGTAATGTGGTATGATTGATGTGT
     5581 ---------+---------+---------+---------+---------+---------+ 5640
          AATAAATTCCACTACAAAAACAGAAAATAAGGCTACTCATTACACCATACTAACTACACA

e          K  N  L  T  I  N  K  D  K  I  G  I  L  L  T  T  H  N  I  H  -

          TCCATAAGATACTTTCTAATGAGTTGTTTAGGCGCTTTTCATTATAAGTCTTATGGGACT
     5641 ---------+---------+---------+---------+---------+---------+ 5700
          AGGTATTCTATGAAAGATTACTCAACAAATCCGCGAAAAGTAATATTCAGAATACCCTGA

e          E  M                                                        -

          TTTTTGATACTCAAAAAGCCCTATAATCTCCACAGTGGGATTTACCCACTACAGAAATTA
     5701 ---------+---------+---------+---------+---------+---------+ 5760
          AAAAACTATGAGTTTTTCGGGATATTAGAGGTGTCACCCTAAATGGGTGATGTCTTTAAT

          TAGAGCCAGAAAAAAACACTTTTGTTCACTAGCAGAAACTAGAGAGCAGAAGTGTTTTTCT
     5761 ---------+---------+---------+---------+---------+---------+ 5820
          ATCTCGGTCTTTTTTTGTGAAAACAAGTGATCGTCTTTGATCTCTCGTCTTCACAAAAAGA

          GTTCAGATTTACCCAAAACTGGGAAATATGGGGATAAGAATAGAGATGGCTTAGGAAGCC
     5821 ---------+---------+---------+---------+---------+---------+ 5880
          CAAGTCTAAATGGGTTTTGACCCTTTATACCCCTATTCTTATCTCTACCGAATCCTTCGG

          CCTTTTTGTGTGTAGACAGTACGATGAACTTATAACAAATAGTGAGCCTTTTTAGCAATC
     5881 ---------+---------+---------+---------+---------+---------+ 5940
          GGAAAAACACACATCTGTCATGCTACTTGAATATTGTTTATCACTCGGAAAAATCGTTAG

e                                       *  L  L  Y  H  A  K  K  A  I  -orf2_670 homologue of sp0461, transcriptional
                                                                                regulator
          ATTGCGACCCGTTTGTCAAAAGCCTCTTTTCGGATATCTACAATTGTCTGATAGATGAGA
```

Figure 101O

```
5941 ---------+---------+---------+---------+---------+---------+ 6000
     TAACGCTGGGCAAACAGTTTTCGGAGAAAAGCCTATAGATGTTAACAGACTATCTACTCT

e     M  A  V  R  K  D  F  A  E  K  R  I  D  V  I  T  Q  Y  I  L  -

     CGCTGTTGGCTAACATGCAAATCTAAGGCAATCGTCAAAAAGTGATGTTTCCCTTTGGGA
6001 ---------+---------+---------+---------+---------+---------+ 6060
     GCGACAACCGATTGTACGTTTAGATTCCGTTAGCAGTTTTTCACTACAAAGGGAAACCCT

e     R  Q  Q  S  V  H  L  D  L  A  I  T  L  F  H  H  K  G  K  P  -

     TACTGCTTTTTAACGTAAGGCAGGTATTCTTTCGTTGTAATAATAATCAATGGCTCTGTC
6061 ---------+---------+---------+---------+---------+---------+ 6120
     ATGACGAAAAATTGCATTCCGTCCATAAGAAAGCAACATTATTATTAGTTACCGAGACAG

e     Y  Q  K  K  V  Y  P  L  Y  E  K  T  T  I  I  I  L  P  E  T  -

     AAATGCTCCTCTGAAGGAGGAGGACTAATTAGAATATTGTATCCTGTAACAGAGGCAACT
6121 ---------+---------+---------+---------+---------+---------+ 6180
     TTTACGAGGAGACTTCCTCCTCCTGATTAATCTTATAACATAGGACATTGTCTCCGTTGA

e     L  H  E  E  S  P  P  P  S  I  L  I  N  Y  G  T  V  S  A  V  -

     TTGTCAGTAAAATTCCGTAAAATAATGGACTTTATTAAGTTTACATCTGCTTGATTATTT
6181 ---------+---------+---------+---------+---------+---------+ 6240
     AACAGTCATTTTAAGGCATTTTATTACCTGAAATAATTCAAATGTAGACGAACTAATAAA

e     K  D  T  F  N  R  L  I  I  S  K  I  L  N  V  D  A  Q  N  N  -

     AAAATGATAAAAATCGGGATAGCAGGTAGTGAGGAAAAGATGGTTTCTGTCAAGTAGAGT
6241 ---------+---------+---------+---------+---------+---------+ 6300
     TTTTACTATTTTTAGCCCTATCGTCCATCACTCCTTTTCTACCAAAGACAGTTCATCTCA

e     L  I  I  F  I  P  I  A  P  L  S  S  F  I  T  E  T  L  Y  L  -

     GAGAAAAGGTACAGCCGATGCTGGTCGATAACTCCTTCAATCTTCTGCTCAGTCATCCAC
6301 ---------+---------+---------+---------+---------+---------+ 6360
     CTCTTTTCCATGTCGGCTACGACCAGCTATTGAGGAAGTTAGAAGACGAGTCAGTAGGTG

e     S  F  L  Y  L  R  H  Q  D  I  V  G  E  I  K  Q  E  T  M  W  -
```

Figure 101P

```
      TCTTGAACAATTGCTTTCGAAATATGATACAGTGGCTTGTCGCTTTCAATCCCATAATGT
 6361 ---------+---------+---------+---------+---------+---------+ 6420
      AGAACTTGTTAACGAAAGCTTTATACTATGTCACCGAACAGCGAAAGTTAGGGTATTACA

e      E  Q  V  I  A  K  S  I  H  Y  L  P  K  D  S  E  I  G  Y  H  -

      TCGTAATAATTATAATAGGGAACTAGATTTTGTAAACCAAACAAAAACGTTCTTGTTAAG
 6421 ---------+---------+---------+---------+---------+---------+ 6480
      AGCATTATTAATATTATCCCTTGATCTAAAACATTTGGTTTGTTTTTGCAAGAACAATTC

e      E  Y  Y  N  Y  Y  P  V  L  N  Q  L  G  F  L  F  T  R  T  L  -

      AAAGTCAGTGCTGTTAAAAAAGAAAGAGAATTCGAAATGTCATTTCCTAAGATATTCTTG
 6481 ---------+---------+---------+---------+---------+---------+ 6540
      TTTCAGTCACGACAATTTTTTCTTTCTCTTAAGCTTTACAGTAAAGGATTCTATAAGAAC

e      F  T  L  A  T  L  F  S  L  S  N  S  I  D  N  G  L  I  N  K  -

      AACTTGGATAGTAGATGCTTTCCTCTTGTATGCTGAAGAATCAGTTGAATAGTATGAGTC
 6541 ---------+---------+---------+---------+---------+---------+ 6600
      TTGAACCTATCATCTACGAAAGGAGAACATACGACTTCTTAGTCAACTTATCATACTCAG

e      F  K  S  L  L  H  K  G  R  T  H  Q  L  I  L  Q  I  T  H  T  -

      TTTTTTTCTTGATTCCATTTGTCCTTGGAAAACGAAGAATTAGCAGAACAATAAACCAAA
 6601 ---------+---------+---------+---------+---------+---------+ 6660
      AAAAAAAGAACTAAGGTAAACAGGAACCTTTTGCTTCTTAATCGTCTTGTTATTTGGTTT

e      K  K  E  Q  N  W  K  D  K  S  F  S  S  N  A  S  C  Y  V  L  -

      AAGATATAATCCAGTTCTTCCTGAGTAAAAGTCATGTTGGCATGTGGCTCTAAGTAAGTT
 6661 ---------+---------+---------+---------+---------+---------+ 6720
      TTCTATATTAGGTCAAGAAGGACTCATTTTCAGTACAACCGTACACCGAGATTCATTCAA

e      F  I  Y  D  L  E  E  Q  T  F  T  M  N  A  H  P  E  L  Y  T  -

      TGGCAATGTTCCATCAAAATCGGATACATAAAGAGGTTTTTTAATTTTTCAAACTCTTTG
 6721 ---------+---------+---------+---------+---------+---------+ 6780
      ACCGTTACAAGGTAGTTTTAGCCTATGTATTTCTCCAAAAAATTAAAAAGTTTGAGAAAC
```

```
e        Q  C  H  E  M  L  I  P  Y  M  F  L  N  K  L  K  E  F  E  K  -

         GACTCAGGGAACTCAAGTGGAAATTCCCGACGTTTCCAAGTGAGTGCCACTAGTATGCTA
    6781 ---------+---------+---------+---------+---------+---------+ 6840
         CTGAGTCCCTTGAGTTCACCTTTAAGGGCTGCAAAGGTTCACTCACGGTGATCATACGAT

e        S  E  P  F  E  L  P  F  E  R  R  K  W  T  L  A  V  L  I  S  -

         AAATGAACATACTCGTCAGGTGTGATTTCTAACAGTTCATGACTGAGTTGAGAATTAGAC
    6841 ---------+---------+---------+---------+---------+---------+ 6900
         TTTACTTGTATGAGCAGTCCACACTAAAGATTGTCAAGTACTGACTCAACTCTTAATCTG

e        F  H  V  Y  E  D  P  T  I  E  L  L  E  H  S  L  Q  S  N  S  -

         TGCACAATCATATGTGTGACCCAATCCATACTTCCATCATTCAAATCATAAATCTCAATA
    6901 ---------+---------+---------+---------+---------+---------+ 6960
         ACGTGTTAGTATACACACTGGGTTAGGTATGAAGGTAGTAAGTTTAGTATTTAGAGTTAT

e        Q  V  I  M  H  T  V  W  D  M  S  G  D  N  L  D  Y  I  E  I  -

         CCAAAATGAAACTGGAGGAGTGCAATTAAAAAACGAATGCGATATTCAGGACCAACTACT
    6961 ---------+---------+---------+---------+---------+---------+ 7020
         GGTTTTACTTTGACCTCCTCACGTTAATTTTTTGCTTACGCTATAAGTCCTGGTTGATGA

e        G  F  H  F  Q  L  L  A  I  L  F  R  I  R  Y  E  P  G  V  V  -

         TGATTTTTCACAAGGTCCAAACCTACTGAACGTAGTAACAAGCCACACTTTTGTCGTACG
    7021 ---------+---------+---------+---------+---------+---------+ 7080
         ACTAAAAAGTGTTCCAGGTTTGGATGACTTGCATCATTGTTCGGTGTGAAAACAGCATGC

e        Q  N  K  V  L  D  L  G  V  S  R  L  L  L  G  C  K  Q  R  V  -

         CGGTAGCCTGTTGCGATGGAAATATACTCTTTTTGTGTAAATTCGTTAAAGCTTTGATTA
    7081 ---------+---------+---------+---------+---------+---------+ 7140
         GCCATCGGACAACGCTACCTTTATATGAGAAAAACACATTTAAGCAATTTCGAAACTAAT

e        R  Y  G  T  A  I  S  I  Y  E  K  Q  T  F  E  N  F  S  Q  N  -

         CCTTGTAGTAGAAAGAAGCGGAGTATTTTTAAAATAGTTGATTGGTTATAAAGCTGATGG
    7141 ---------+---------+---------+---------+---------+---------+ 7200
```

Figure 101R

```
          GGAACATCATCTTTCTTCGCCTCATAAAAATTTTATCAACTAACCAATATTTCGACTACC

e          G  Q  L  L  F  F  R  L  I  K  L  I  T  S  Q  N  Y  L  Q  H  -

          AAGTAATAATTCGTTTGATGAGAATGGTGTTCGATTAATTGAACTTGTTGCGTATCTAAA
     7201 ---------+---------+---------+---------+---------+---------+ 7260
          TTCATTATTAAGCAAACTACTCTTACCACAAGCTAATTAACTTGAACAACGCATAGATTT

e          F  Y  Y  N  T  Q  H  S  H  H  E  I  L  Q  V  Q  Q  T  D  L  -

          TTAAATGTCAACTCTTCCTCGAATGTTTCTTGTAATTCCTGCAAAATGCTTAGGAGACTT
     7261 ---------+---------+---------+---------+---------+---------+ 7320
          AATTTACAGTTGAGAAGGAGCTTACAAAGAACATTAAGGACGTTTTACGAATCCTCTGAA

e          N  F  T  L  E  E  E  F  T  E  Q  L  E  Q  L  I  S  L  L  S  -

          TTAGATTGTAATGAAGTTAAAGTAGACAGTTCATCTAGTTCAATAGACCGAATATCCAAT
     7321 ---------+---------+---------+---------+---------+---------+ 7380
          AATCTAACATTACTTCAATTTCATCTGTCAAGTAGATCAAGTTATCTGGCTTATAGGTTA

e          K  S  Q  L  S  T  L  T  S  L  E  D  L  E  I  S  R  I  D  L  -

          AATATATTTAAAATGGTAATTTTATCTGTAATTCTTTTTTCAATGTATTTGTTTAGCATA
     7381 ---------+---------+---------+---------+---------+---------+ 7440
          TTATATAAATTTTACCATTAAAATAGACATTAAGAAAAAAGTTACATAAACAAATCGTAT

e          L  I  N  L  I  T  I  K  D  T  I  R  K  E  I  Y  K  N  L  M  -

          GTTACCGAATCTTAGTTGCATATAGATAATTTTAATTATTATAATACAAAAGAAACTAAT
     7441 ---------+---------+---------+---------+---------+---------+ 7500
          CAATGGCTTAGAATCAACGTATATCTATTAAAATTAATAATATTATGTTTTCTTTGATTA

          TGTCTTGTCAAAAAGGTTGTGGAATTTCCGACTTTATTGATAAAACAGCATGTAATAAAA
     7501 ---------+---------+---------+---------+---------+---------+ 7560
          ACAGAACAGTTTTTCCAACACCTTAAAGGCTGAAATAACTATTTTGTCGTACATTATTTT

          GGCATTTTAAAGATAGTAATGAGTATTGGTGGAGTTTTATGGCTTATTTTTTTTATTAGA
     7561 ---------+---------+---------+---------+---------+---------+ 7620
```

Figure 101S

```
         CCGTAAAATTTCTATCATTACTCATAACCACCTCAAAATACCGAATAAAAAAAATAATCT

         AAATATTTTTTTATCAAATATTGTCGTTCTATAAAAAAATATGTGATAAAAATATCTATT
    7621 ---------+---------+---------+---------+---------+---------+ 7680
         TTTATAAAAAAATAGTTTATAACAGCAAGATATTTTTTTATACACTATTTTTATAGATAA

         GTGATGGAAGTTGTTTTAATTTATACTAGGATAGTTAATAGTAATACTATACTATACTAT
    7681 ---------+---------+---------+---------+---------+---------+ 7740
         CACTACCTTCAACAAAATTAAATATGATCCTATCAATTATCATTATGATATGATATGATA

         ATTGTATACAAGTGTGTCATTGCCAGGTTGAGAAGATAGCTATAACGCACTTTTATACGC
    7741 ---------+---------+---------+---------+---------+---------+ 7800
         TAACATATGTTCACACAGTAACGGTCCAACTCTTCTATCGATATTGCGTGAAAATATGCG

         TTTTGCTACGTTTGTTAGTGAACGGATTAACTCAGTGAGATAAATTTTATCAGAACATAA
    7801 ---------+---------+---------+---------+---------+---------+ 7860
         AAAACGATGCAAACAATCACTTGCCTAATTGAGTCACTCTATTTAAAATAGTCTTGTATT

         GTAATCCGTTTCTTCGTGTATACAGATTGAAAGTACCTATGAATCATAGAAGGATTAACT
    7861 ---------+---------+---------+---------+---------+---------+ 7920
         CATTAGGCAAAGAAGCACATATGTCTAACTTTCATGGATACTTAGTATCTTCCTAATTGA

         TGTTCTATGAATAATGCTTAACAGGGAGACACACATGAAAAAAGTAAGAAAGATATTTCA
    7921 ---------+---------+---------+---------+---------+---------+ 7980
         ACAAGATACTTATTACGAATTGTCCCTCTGTGTGTACTTTTTTCATTCTTTCTATAAAGT

b                        M  L  N  R  E  T  H  M  K  K  V  R  K  I  F  Q  -orf3_670 homologue of sp0462, LPXTG

         GAAGGCAGTTGCAGGACTGTGCTGTATATCTCAGTTGACAGCTTTTTCTTCGATAGTTGC
    7981 ---------+---------+---------+---------+---------+---------+ 8040
         CTTCCGTCAACGTCCTGACACGACATATAGAGTCAACTGTCGAAAAAGAAGCTATCAACG

b         K  A  V  A  G  L  C  C  I  S  Q  L  T  A  F  S  S  I  V  A  -
```

Figure 101T

```
        TTTAGCAGAAACGCCTGAAACCAGTCCAGCGATAGGAAAAGTAGTGATTAAGGAGACAGG
   8041 ---------+---------+---------+---------+---------+---------+ 8100
        AAATCGTCTTTGCGGACTTTGGTCAGGTCGCTATCCTTTTCATCACTAATTCCTCTGTCC

b        L  A  E  T  P  E  T  S  P  A  I  G  K  V  V  I  K  E  T  G  -

        CGAAGGAGGAGCGCTTCTAGGAGATGCCGTCTTTGAGTTGAAAAACAATACGGATGGCAC
   8101 ---------+---------+---------+---------+---------+---------+ 8160
        GCTTCCTCCTCGCGAAGATCCTCTACGGCAGAAACTCAACTTTTTGTTATGCCTACCGTG

b        E  G  G  A  L  L  G  D  A  V  F  E  L  K  N  N  T  D  G  T  -

        AACTGTTTCGCAAAGGACAGAGGCGCAAACAGGAGAAGCGATATTTTCAAACATAAAACC
   8161 ---------+---------+---------+---------+---------+---------+ 8220
        TTGACAAAGCGTTTCCTGTCTCCGCGTTTGTCCTCTTCGCTATAAAAGTTTGTATTTTGG

b        T  V  S  Q  R  T  E  A  Q  T  G  E  A  I  F  S  N  I  K  P  -

        TGGGACATACACCTTGACAGAAGCCCAACCTCCAGTTGGTTATAAACCCTCTACTAAACA
   8221 ---------+---------+---------+---------+---------+---------+ 8280
        ACCCTGTATGTGGAACTGTCTTCGGGTTGGAGGTCAACCAATATTTGGGAGATGATTTGT

b        G  T  Y  T  L  T  E  A  Q  P  P  V  G  Y  K  P  S  T  K  Q  -

        ATGGACTGTTGAAGTTGAGAAGAATGGTCGGACGACTGTCCAAGGTGAACAGGTAGAAAA
   8281 ---------+---------+---------+---------+---------+---------+ 8340
        TACCTGACAACTTCAACTCTTCTTACCAGCCTGCTGACAGGTTCCACTTGTCCATCTTTT

b        W  T  V  E  V  E  K  N  G  R  T  T  V  Q  G  E  Q  V  E  N  -

        TCGAGAAGAGGCTCTATCTGACCAGTATCCACAAACAGGGACTTATCCAGATGTTCAAAC
   8341 ---------+---------+---------+---------+---------+---------+ 8400
        AGCTCTTCTCCGAGATAGACTGGTCATAGGTGTTTGTCCCTGAATAGGTCTACAAGTTTG

b        R  E  E  A  L  S  D  Q  Y  P  Q  T  G  T  Y  P  D  V  Q  T  -

        ACCTTATCAGATTATTAAGGTAGATGGTTCGGAAAAAAACGGACAGCACAAGGCGTTGAA
   8401 ---------+---------+---------+---------+---------+---------+ 8460
        TGGAATAGTCTAATAATTCCATCTACCAAGCCTTTTTTTGCCTGTCGTGTTCCGCAACTT
```

```
b        P  Y  Q  I  I  K  V  D  G  S  E  K  N  G  Q  H  K  A  L  N  -

         TCCGAATCCATATGAACGTGTGATTCCAGAAGGTACACTTTCAAAGAGAATTTATCAAGT
    8461 ---------+---------+---------+---------+---------+---------+ 8520
         AGGCTTAGGTATACTTGCACACTAAGGTCTTCCATGTGAAAGTTTCTCTTAAATAGTTCA

b        P  N  P  Y  E  R  V  I  P  E  G  T  L  S  K  R  I  Y  Q  V  -

         GAATAATTTGGATGATAACCAATATGGAATCGAGTTGACGGTTAGTGGTAAAACGACGGT
    8521 ---------+---------+---------+---------+---------+---------+ 8580
         CTTATTAAACCTACTATTGGTTATACCTTAGCTCAACTGCCAATCACCATTTTGCTGCCA

b        N  N  L  D  D  N  Q  Y  G  I  E  L  T  V  S  G  K  T  T  V  -

         TGAAACGAAAGAAGCCTCTACTCCGCTAGATGTTGTTATTCTATTAGATAACTCCAATAG
    8581 ---------+---------+---------+---------+---------+---------+ 8640
         ACTTTGCTTTCTTCGGAGATGAGGCGATCTACAACAATAAGATAATCTATTGAGGTTATC

b        E  T  K  E  A  S  T  P  L  D  V  V  I  L  L  D  N  S  N  S  -

         TATGAGTAATATTCGACATAATCATGCCCATCGAGCGGAAAAAGCGGGAGAAGCGACACG
    8641 ---------+---------+---------+---------+---------+---------+ 8700
         ATACTCATTATAAGCTGTATTAGTACGGGTAGCTCGCCTTTTTCGCCCTCTTCGCTGTGC

b        M  S  N  I  R  H  N  H  A  H  R  A  E  K  A  G  E  A  T  R  -

         AGCCCTTGTAGATAAGATTACCTCCAATCCAGATAATCGAGTAGCACTTGTGACTTATGG
    8701 ---------+---------+---------+---------+---------+---------+ 8760
         TCGGGAACATCTATTCTAATGGAGGTTAGGTCTATTAGCTCATCGTGAACACTGAATACC

b        A  L  V  D  K  I  T  S  N  P  D  N  R  V  A  L  V  T  Y  G  -

         CTCAACTATCTTTGACGGTTCAGAAGCTACTGTGGAAAAAGGGGTAGCAGATGCGAACGG
    8761 ---------+---------+---------+---------+---------+---------+ 8820
         GAGTTGATAGAAACTGCCAAGTCTTCGATGACACCTTTTTCCCCATCGTCTACGCTTGCC

b        S  T  I  F  D  G  S  E  A  T  V  E  K  G  V  A  D  A  N  G  -

         AAAAATATTGAATGACTCAGCTTTATGGACGTTCGATCGTACGACGTTTACAGCTAAAAC
    8821 ---------+---------+---------+---------+---------+---------+ 8880
```

Figure 101V

```
          TTTTTATAACTTACTGAGTCGAAATACCTGCAAGCTAGCATGCTGCAAATGTCGATTTTG

b          K  I  L  N  D  S  A  L  W  T  F  D  R  T  T  F  T  A  K  T  -

          TTATAATTATAGCTTTTTAAATCTCACATCAGATCCTACTGATATTCAAACTATTAAGGA
     8881 ---------+---------+---------+---------+---------+---------+ 8940
          AATATTAATATCGAAAAATTTAGAGTGTAGTCTAGGATGACTATAAGTTTGATAATTCCT

b          Y  N  Y  S  F  L  N  L  T  S  D  P  T  D  I  Q  T  I  K  D  -

          TAGGATTCCATCAGATGCAGAGGAATTGAACAAAGACAAATTGATGTATCAATTCGGCGC
     8941 ---------+---------+---------+---------+---------+---------+ 9000
          ATCCTAAGGTAGTCTACGTCTCCTTAACTTGTTTCTGTTTAACTACATAGTTAAGCCGCG

b          R  I  P  S  D  A  E  E  L  N  K  D  K  L  M  Y  Q  F  G  A  -

          GACTTTTACCCAGAAGGCTTTGATGACCGCTGATGATATCTTGACAAAGCAGGCAAGACC
     9001 ---------+---------+---------+---------+---------+---------+ 9060
          CTGAAAATGGGTCTTCCGAAACTACTGGCGACTACTATAGAACTGTTTCGTCCGTTCTGG

b          T  F  T  Q  K  A  L  M  T  A  D  D  I  L  T  K  Q  A  R  P  -

          AAACAGTAAAAAGGTTATTTTCCACATTACAGATGGTGTTCCGACTATGTCATATCCAAT
     9061 ---------+---------+---------+---------+---------+---------+ 9120
          TTTGTCATTTTTCCAATAAAAGGTGTAATGTCTACCACAAGGCTGATACAGTATAGGTTA

b          N  S  K  K  V  I  F  H  I  T  D  G  V  P  T  M  S  Y  P  I  -

          TAATTTTAAATATACAGGAACGACGCAATCGTACAGAACTCAGCTGAATAATTTTAAAGC
     9121 ---------+---------+---------+---------+---------+---------+ 9180
          ATTAAAATTTATATGTCCTTGCTGCGTTAGCATGTCTTGAGTCGACTTATTAAAATTTCG

b          N  F  K  Y  T  G  T  T  Q  S  Y  R  T  Q  L  N  N  F  K  A  -

          AAAAACTCCAAATAGTAGCGGGATATTACTGGAGGACTTTGTTACATGGTCAGCAGATGG
     9181 ---------+---------+---------+---------+---------+---------+ 9240
          TTTTTGAGGTTTATCATCGCCCTATAATGACCTCCTGAAACAATGTACCAGTCGTCTACC

b          K  T  P  N  S  S  G  I  L  L  E  D  F  V  T  W  S  A  D  G  -
```

Figure 101W

```
           TGAACATAAGATTGTTCGTGGAGATGGTGAAAGTTATCAGATGTTTACGAAGAAACCTGT
     9241 ---------+---------+---------+---------+---------+---------+ 9300
           ACTTGTATTCTAACAAGCACCTCTACCACTTTCAATAGTCTACAAATGCTTCTTTGGACA

b           E  H  K  I  V  R  G  D  G  E  S  Y  Q  M  F  T  K  K  P  V  -

           AACAGACCAATACGGAGTTCATCAAATACTTTCAATCACCTCCATGGAGCAGAGAGCTAA
     9301 ---------+---------+---------+---------+---------+---------+ 9360
           TTGTCTGGTTATGCCTCAAGTAGTTTATGAAAGTTAGTGGAGGTACCTCGTCTCTCGATT

b           T  D  Q  Y  G  V  H  Q  I  L  S  I  T  S  M  E  Q  R  A  K  -

           ATTAGTTTCAGCGGGATATAGGTTCTATGGAACTGACTTGTATTTATATTGGCGTGATAG
     9361 ---------+---------+---------+---------+---------+---------+ 9420
           TAATCAAAGTCGCCCTATATCCAAGATACCTTGACTGAACATAAATATAACCGCACTATC

b           L  V  S  A  G  Y  R  F  Y  G  T  D  L  Y  L  Y  W  R  D  S  -

           TATTCTAGCCTATCCATTTAACTCTAGTACCGATTGGATTACCAACCATGGTGACCCTAC
     9421 ---------+---------+---------+---------+---------+---------+ 9480
           ATAAGATCGGATAGGTAAATTGAGATCATGGCTAACCTAATGGTTGGTACCACTGGGATG

b           I  L  A  Y  P  F  N  S  S  T  D  W  I  T  N  H  G  D  P  T  -

           GACTTGGTATTATAACGGAAATATGGCTCAGGATGGCTATGATGTCTTCACTGTTGGGGT
     9481 ---------+---------+---------+---------+---------+---------+ 9540
           CTGAACCATAATATTGCCTTTATACCGAGTCCTACCGATACTACAGAAGTGACAACCCCA

b           T  W  Y  Y  N  G  N  M  A  Q  D  G  Y  D  V  F  T  V  G  V  -

           TGGTGTAAACGGGGATCCTGGTACGGATGAAGCAACGGCTACTAGATTTATGCAGAGCAT
     9541 ---------+---------+---------+---------+---------+---------+ 9600
           ACCACATTTGCCCCTAGGACCATGCCTACTTCGTTGCCGATGATCTAAATACGTCTCGTA

b           G  V  N  G  D  P  G  T  D  E  A  T  A  T  R  F  M  Q  S  I  -

           CTCTAGTTCTCCTGACAACTACACTAACGTAGCAGATCCATCTCAGATTTTACAAGAATT
     9601 ---------+---------+---------+---------+---------+---------+ 9660
           GAGATCAAGAGGACTGTTGATGTGATTGCATCGTCTAGGTAGAGTCTAAAATGTTCTTAA
```

```
b          S  S  S  P  D  N  Y  T  N  V  A  D  P  S  Q  I  L  Q  E  L  -

           GAATCGCTACTTCTATACTATCGTCAATGAGAAGAAATCTATCGAAAATGGTACGATTAC
      9661 ---------+---------+---------+---------+---------+---------+ 9720
           CTTAGCGATGAAGATATGATAGCAGTTACTCTTCTTTAGATAGCTTTTACCATGCTAATG

b          N  R  Y  F  Y  T  I  V  N  E  K  K  S  I  E  N  G  T  I  T  -

           AGACCCGATGGGTGAACTAATTGATTTCCAATTGGGAGCAGATGGAAGGTTTGATCCAGC
      9721 ---------+---------+---------+---------+---------+---------+ 9780
           TCTGGGCTACCCACTTGATTAACTAAAGGTTAACCCTCGTCTACCTTCCAAACTAGGTCG

b          D  P  M  G  E  L  I  D  F  Q  L  G  A  D  G  R  F  D  P  A  -

           GGATTACACTTTAACTGCAAACGATGGTAGTTCGTTGGTGAATAATGTCCCTACTGGGGG
      9781 ---------+---------+---------+---------+---------+---------+ 9840
           CCTAATGTGAAATTGACGTTTGCTACCATCAAGCAACCACTTATTACAGGGATGACCCCC

b          D  Y  T  L  T  A  N  D  G  S  S  L  V  N  N  V  P  T  G  G  -

           ACCACAAAATGATGGTGGCTTGCTAAAAAATGCAAAAGTGTTCTATGATACGACTGAGAA
      9841 ---------+---------+---------+---------+---------+---------+ 9900
           TGGTGTTTTACTACCACCGAACGATTTTTTACGTTTTCACAAGATACTATGCTGACTCTT

b          P  Q  N  D  G  G  L  L  K  N  A  K  V  F  Y  D  T  T  E  K  -

           AAGGATTCGTGTAACAGGTTTGTACCTTGGAACGGGTGAAAAAGTTACATTGACTTATAA
      9901 ---------+---------+---------+---------+---------+---------+ 9960
           TTCCTAAGCACATTGTCCAAACATGGAACCTTGCCCACTTTTTCAATGTAACTGAATATT

b          R  I  R  V  T  G  L  Y  L  G  T  G  E  K  V  T  L  T  Y  N  -

           TGTTCGCTTGAATGACCAATTTGTAAGCAATAAATTCTATGACACGAATGGTCGAACAAC
      9961 ---------+---------+---------+---------+---------+---------+ 10020
           ACAAGCGAACTTACTGGTTAAACATTCGTTATTTAAGATACTGTGCTTACCAGCTTGTTG

b          V  R  L  N  D  Q  F  V  S  N  K  F  Y  D  T  N  G  R  T  T  -

           CCTACACCCTAAGGAAGTAGAAAAGAACACAGTGCGCGACTTCCCGATTCCTAAGATTCG
     10021 ---------+---------+---------+---------+---------+---------+ 10080
```

Figure 101Y

```
              GGATGTGGGATTCCTTCATCTTTTCTTGTGTCACGCGCTGAAGGGCTAAGGATTCTAAGC

b              L  H  P  K  E  V  E  K  N  T  V  R  D  F  P  I  P  K  I  R  -

              TGATGTACGAAAGTATCCAGAAATCACAATTCCAAAAGAGAAAAAACTTGGTGAAATTGA
        10081 ---------+---------+---------+---------+---------+---------+ 10140
              ACTACATGCTTTCATAGGTCTTTAGTGTTAAGGTTTTCTCTTTTTTGAACCACTTTAACT

b              D  V  R  K  Y  P  E  I  T  I  P  K  E  K  K  L  G  E  I  E  -

              GTTTATTAAGATCAATAAGAATGATAAAAAACCACTGAGAGATGCGGTCTTTAGTCTTCA
        10141 ---------+---------+---------+---------+---------+---------+ 10200
              CAAATAATTCTAGTTATTCTTACTATTTTTTGGTGACTCTCTACGCCAGAAATCAGAAGT

b              F  I  K  I  N  K  N  D  K  K  P  L  R  D  A  V  F  S  L  Q  -

              AAAACAACATCCGGATTATCCAGATATTTATGGAGCTATTGATCAAAATGGCACTTATCA
        10201 ---------+---------+---------+---------+---------+---------+ 10260
              TTTTGTTGTAGGCCTAATAGGTCTATAAATACCTCGATAACTAGTTTTACCGTGAATAGT

b              K  Q  H  P  D  Y  P  D  I  Y  G  A  I  D  Q  N  G  T  Y  Q  -

              AAATGTGAGAACAGGTGAAGATGGTAAGTTGACCTTTAAAAATCTGTCAGATGGGAAATA
        10261 ---------+---------+---------+---------+---------+---------+ 10320
              TTTACACTCTTGTCCACTTCTACCATTCAACTGGAAATTTTTAGACAGTCTACCCTTTAT

b              N  V  R  T  G  E  D  G  K  L  T  F  K  N  L  S  D  G  K  Y  -

              TCGATTATTTGAAAATTCTGAACCAGCTGGTTATAAACCCGTTCAAAATAAGCCTATCGT
        10321 ---------+---------+---------+---------+---------+---------+ 10380
              AGCTAATAAACTTTTAAGACTTGGTCGACCAATATTTGGGCAAGTTTTATTCGGATAGCA

b              R  L  F  E  N  S  E  P  A  G  Y  K  P  V  Q  N  K  P  I  V  -

              TGCCTTCCAAATAGTAAATGGAGAAGTCAGAGATGTGACTTCAATCGTTCCACAAGATAT
        10381 ---------+---------+---------+---------+---------+---------+ 10440
              ACGGAAGGTTTATCATTTACCTCTTCAGTCTCTACACTGAAGTTAGCAAGGTGTTCTATA

b              A  F  Q  I  V  N  G  E  V  R  D  V  T  S  I  V  P  Q  D  I  -
```

Figure 101Z

```
          ACCAGCGGGTTACGAGTTTACGAATGATAAGCACTATATCACAAATGAGCCAATTCCTCC
    10441 ---------+---------+---------+---------+---------+---------+ 10500
          TGGTCGCCCAATGCTCAAATGCTTACTATTCGTGATATAGTGTTTACTCGGTTAAGGAGG

b          P  A  G  Y  E  F  T  N  D  K  H  Y  I  T  N  E  P  I  P  P  -

          AAAAAGAGAATATCCTCGAACTGGTGGTATCGGAATGTTGCCATTCTATCTGATAGGTTG
    10501 ---------+---------+---------+---------+---------+---------+ 10560
          TTTTTCTCTTATAGGAGCTTGACCACCATAGCCTTACAACGGTAAGATAGACTATCCAAC

b          K  R  E  Y  P  R  T  G  G  I  G  M  L  P  F  Y  L  I  G  C  -

          CATGATGATGGGAGGAGTTCTATTATACACACGGAAACATCCGTAAAGTGTAGCAATGAG
    10561 ---------+---------+---------+---------+---------+---------+ 10620
          GTACTACTACCCTCCTCAAGATAATATGTGTGCCTTTGTAGGCATTTCACATCGTTACTC

b          M  M  M  G  G  V  L  L  Y  T  R  K  H  P  *

          AAATGATAATATCGATACTCTGAGCGATACTTTTAAGAAGTAGCACTCAAGAAGAGATTT
    10621 ---------+---------+---------+---------+---------+---------+ 10680
          TTTACTATTATAGCTATGAGACTCGCTATGAAAATTCTTCATCGTGAGTTCTTCTCTAAA


          AAGTTTACTTGGTGAAAACAGTTTTCTTCGCCAAGTAAACCACCATTGAAAGGGGAGATG
    10681 ---------+---------+---------+---------+---------+---------+ 10740
          TTCAAATGAACCACTTTTGTCAAAAGAAGCGGTTCATTTGGTGGTAACTTTCCCCTCTAC


          TTTTCGAAAACTTGCACAGAAAAAAGGATTATTATTGTCATGTGTAATTCATTACATTGC
    10741 ---------+---------+---------+---------+---------+---------+ 10800
          AAAAGCTTTTGAACGTGTCTTTTTTCCTAATAATAACAGTACACATTAAGTAATGTAACG


          TCACAGTTGATTTTAAGAGATATGAATAAGGAGAAATCATGAAATCAATCAACAAATTTT
    10801 ---------+---------+---------+---------+---------+---------+ 10860
          AGTGTCAACTAAAATTCTCTATACTTATTCCTCTTTAGTACTTTAGTTAGTTGTTTAAAA

c                                                M  K  S  I  N  K  F  L  - orf4_670, homologue of sp0463, LPXTG

          TAACAATGCTTGCTGCCTTATTACTGACAGCGAGTAGCCTGTTTTCAGCTGCAACAGTTT
```

Figure 101AA

```
10861 ---------+---------+---------+---------+---------+---------+ 10920
      ATTGTTACGAACGACGGAATAATGACTGTCGCTCATCGGACAAAAGTCGACGTTGTCAAA

c       T  M  L  A  A  L  L  L  T  A  S  S  L  F  S  A  A  T  V  F -

      TTGCGGCGGACAATGTTAGTACAGCACCAGATGCTGTTACTAAAACTTTAACAATCCATA
10921 ---------+---------+---------+---------+---------+---------+ 10980
      AACGCCGCCTGTTACAATCATGTCGTGGTCTACGACAATGATTTTGAAATTGTTAGGTAT

c       A  A  D  N  V  S  T  A  P  D  A  V  T  K  T  L  T  I  H  K -

      AGTTACTGCTCTCAGAAGATGATTTAAAGACTTGGGATACAAACGGTCCTAAAGGATATG
10981 ---------+---------+---------+---------+---------+---------+ 11040
      TCAATGACGAGAGTCTTCTACTAAATTTCTGAACCCTATGTTTGCCAGGATTTCCTATAC

c       L  L  L  S  E  D  D  L  K  T  W  D  T  N  G  P  K  G  Y  D -

      ATGGAACTCAATCTAGTTTAAAAGATTTAACTGGAGTTGTAGCTGAGGAAATTCCAAATG
11041 ---------+---------+---------+---------+---------+---------+ 11100
      TACCTTGAGTTAGATCAAATTTTCTAAATTGACCTCAACATCGACTCCTTTAAGGTTTAC

c       G  T  Q  S  S  L  K  D  L  T  G  V  V  A  E  E  I  P  N  V -

      TATACTTTGAATTACAAAAGTATAATTTGACTGATGGTAAGGAAAAAGAAAATCTTAAAG
11101 ---------+---------+---------+---------+---------+---------+ 11160
      ATATGAAACTTAATGTTTTCATATTAAACTGACTACCATTCCTTTTTCTTTTAGAATTTC

c       Y  F  E  L  Q  K  Y  N  L  T  D  G  K  E  K  E  N  L  K  D -

      ATGATAGTAAATGGACAACAGTTCATGGTGGTTTGACAACTAAAGATGGACTTAAAATTG
11161 ---------+---------+---------+---------+---------+---------+ 11220
      TACTATCATTTACCTGTTGTCAAGTACCACCAAACTGTTGATTTCTACCTGAATTTTAAC

c       D  S  K  W  T  T  V  H  G  G  L  T  T  K  D  G  L  K  I  E -

      AAACCAGTACTCTTAAAGGTGTGTATCGTATTCGTGAGGATAGAACAAAGACTACCTATG
11221 ---------+---------+---------+---------+---------+---------+ 11280
      TTTGGTCATGAGAATTTCCACACATAGCATAAGCACTCCTATCTTGTTTCTGATGGATAC

c       T  S  T  L  K  G  V  Y  R  I  R  E  D  R  T  K  T  T  Y  V -
```

Figure 101AB

```
      TTGGTCCTAATGGGCAAGTATTAACAGGTTCAAAAGCCGTACCTGCTCTTGTAACTCTTC
11281 ---------+---------+---------+---------+---------+---------+ 11340
      AACCAGGATTACCCGTTCATAATTGTCCAAGTTTTCGGCATGGACGAGAACATTGAGAAG

c       G  P  N  G  Q  V  L  T  G  S  K  A  V  P  A  L  V  T  L  P -

      CACTTGTTAACAATAATGGTACAGTAATTGATGCACATGTTTTCCCTAAAAATTCATATA
11341 ---------+---------+---------+---------+---------+---------+ 11400
      GTGAACAATTGTTATTACCATGTCATTAACTACGTGTACAAAAGGGATTTTTAAGTATAT

c       L  V  N  N  N  G  T  V  I  D  A  H  V  F  P  K  N  S  Y  N -

      ATAAACCAGTTGTAGATAAAAGAATTGCTGATACTTTGAATTATAACGATCAAAATGGTC
11401 ---------+---------+---------+---------+---------+---------+ 11460
      TATTTGGTCAACATCTATTTTCTTAACGACTATGAAACTTAATATTGCTAGTTTTACCAG

c       K  P  V  V  D  K  R  I  A  D  T  L  N  Y  N  D  Q  N  G  L -

      TGTCTATCGGTACTAAAATCCCATATGTTGTTAATACAACAATTCCAAGTAATGCAACAT
11461 ---------+---------+---------+---------+---------+---------+ 11520
      ACAGATAGCCATGATTTTAGGGTATACAACAATTATGTTGTTAAGGTTCATTACGTTGTA

c       S  I  G  T  K  I  P  Y  V  V  N  T  T  I  P  S  N  A  T  F -

      TTGCAACTTCATTTTGGTCAGATGAAATGACAGAAGGTCTAACTTATAATGAAGATGTAA
11521 ---------+---------+---------+---------+---------+---------+ 11580
      AACGTTGAAGTAAAACCAGTCTACTTTACTGTCTTCCAGATTGAATATTACTTCTACATT

c       A  T  S  F  W  S  D  E  M  T  E  G  L  T  Y  N  E  D  V  T -

      CAATTACTTTGAATAATGTAGCTATGGATCAAGCTGATTATGAAGTCACTAAAGGAAATA
11581 ---------+---------+---------+---------+---------+---------+ 11640
      GTTAATGAAACTTATTACATCGATACCTAGTTCGACTAATACTTCAGTGATTTCCTTTAT

c       I  T  L  N  N  V  A  M  D  Q  A  D  Y  E  V  T  K  G  N  N -

      ATGGCTTTAACTTAAAATTAACAGAAGCAGGTTTAGCTAAAATTAATGGTAAGGATGCAG
11641 ---------+---------+---------+---------+---------+---------+ 11700
      TACCGAAATTGAATTTTAATTGTCTTCGTCCAAATCGATTTTAATTACCATTCCTACGTC
```

```
c          G  F  N  L  K  L  T  E  A  G  L  A  K  I  N  G  K  D  A  D -

          ACCAAAAAATCCAAATTACTTACTCAGCTACTTTGAACTCACTTGCTGTTGCAGACATTC
    11701 ---------+---------+---------+---------+---------+---------+ 11760
          TGGTTTTTTAGGTTTAATGAATGAGTCGATGAAACTTGAGTGAACGACAACGTCTGTAAG

c          Q  K  I  Q  I  T  Y  S  A  T  L  N  S  L  A  V  A  D  I  P -

          CTGAAAGTAACGATATTACATATCATTACGGAAATCATCAAGATCATGGGAATACTCCAA
    11761 ---------+---------+---------+---------+---------+---------+ 11820
          GACTTTCATTGCTATAATGTATAGTAATGCCTTTAGTAGTTCTAGTACCCTTATGAGGTT

c          E  S  N  D  I  T  Y  H  Y  G  N  H  Q  D  H  G  N  T  P  K -

          AACCAACTAAACCTAATAATGGTCAAATTACAGTAACTAAGACATGGGACAGTCAACCTG
    11821 ---------+---------+---------+---------+---------+---------+ 11880
          TTGGTTGATTTGGATTATTACCAGTTTAATGTCATTGATTCTGTACCCTGTCAGTTGGAC

c          P  T  K  P  N  N  G  Q  I  T  V  T  K  T  W  D  S  Q  P  A -

          CTCCTGAGGGGGTGAAAGCGACTGTTCAACTTGTAAATGCCAAGACTGGTGAGAAAGTCG
    11881 ---------+---------+---------+---------+---------+---------+ 11940
          GAGGACTCCCCCACTTTCGCTGACAAGTTGAACATTTACGGTTCTGACCACTCTTTCAGC

c          P  E  G  V  K  A  T  V  Q  L  V  N  A  K  T  G  E  K  V  G -

          GTGCTCCTGTAGAACTTTCAGAAAATAATTGGACATATACTTGGAGTGGTCTAGATAATT
    11941 ---------+---------+---------+---------+---------+---------+ 12000
          CACGAGGACATCTTGAAAGTCTTTTATTAACCTGTATATGAACCTCACCAGATCTATTAA

c          A  P  V  E  L  S  E  N  N  W  T  Y  T  W  S  G  L  D  N  S -

          CTATTGAATACAAAGTTGAAGAAGAATATAATGGATACTCAGCTGAATACACAGTAGAGA
    12001 ---------+---------+---------+---------+---------+---------+ 12060
          GATAACTTATGTTTCAACTTCTTCTTATATTACCTATGAGTCGACTTATGTGTCATCTCT

c          I  E  Y  K  V  E  E  E  Y  N  G  Y  S  A  E  Y  T  V  E  S -

          GCAAAGGGAAGTTGGGGGTAAAAAACTGGAAAGATAATAACCCAGCTCCAATCAATCCTG
    12061 ---------+---------+---------+---------+---------+---------+ 12120
```

Figure 101AD

```
              CGTTTCCCTTCAACCCCCATTTTTTGACCTTTCTATTATTGGGTCGAGGTTAGTTAGGAC

c               K  G  K  L  G  V  K  N  W  K  D  N  N  P  A  P  I  N  P  E -

              AAGAACCACGTGTAAAAACATACGGTAAAAAGTTTGTCAAAGTAGACCAAAAAGATACTC
       12121 ---------+---------+---------+---------+---------+---------+ 12180
              TTCTTGGTGCACATTTTTGTATGCCATTTTTCAAACAGTTTCATCTGGTTTTTCTATGAG

c               E  P  R  V  K  T  Y  G  K  K  F  V  K  V  D  Q  K  D  T  R -

              GTCTAGAAAATGCGCAGTTCGTTGTTAAAAAAGCAGATAGCAATAAATATATTGCCTTTA
       12181 ---------+---------+---------+---------+---------+---------+ 12240
              CAGATCTTTTACGCGTCAAGCAACAATTTTTTCGTCTATCGTTATTTATATAACGGAAAT

c               L  E  N  A  Q  F  V  V  K  K  A  D  S  N  K  Y  I  A  F  K -

              AGTCAACTGCACAACAAGCTGCAGATGAAAAAGCAGCAGCAACTGCAAAACAAAAATTGG
       12241 ---------+---------+---------+---------+---------+---------+ 12300
              TCAGTTGACGTGTTGTTCGACGTCTACTTTTTCGTCGTCGTTGACGTTTTGTTTTTAACC

c               S  T  A  Q  Q  A  A  D  E  K  A  A  A  T  A  K  Q  K  L  D -

              ATGCAGCGGTAGCAGCTTACACAAATGCTGCAGATAAGCAAGCCGCTCAAGCTCTAGTAG
       12301 ---------+---------+---------+---------+---------+---------+ 12360
              TACGTCGCCATCGTCGAATGTGTTTACGACGTCTATTCGTTCGGCGAGTTCGAGATCATC

c               A  A  V  A  A  Y  T  N  A  A  D  K  Q  A  A  Q  A  L  V  D -

              ATCAAGCACAGCAAGAATACAATGTAGCTTACAAAGAAGCCAAATTTGGTTATGTTGAAG
       12361 ---------+---------+---------+---------+---------+---------+ 12420
              TAGTTCGTGTCGTTCTTATGTTACATCGAATGTTTCTTCGGTTTAAACCAATACAACTTC

c               Q  A  Q  Q  E  Y  N  V  A  Y  K  E  A  K  F  G  Y  V  E  V -

              TAGCTGGAAAAGATGAAGCAATGGTTCTTACTTCTAATACGGATGGTCAATTCCAAATTT
       12421 ---------+---------+---------+---------+---------+---------+ 12480
              ATCGACCTTTTCTACTTCGTTACCAAGAATGAAGATTATGCCTACCAGTTAAGGTTTAAA

c               A  G  K  D  E  A  M  V  L  T  S  N  T  D  G  Q  F  Q  I  S -
```

Figure 101AE

```
        CAGGTCTTGCTGCTGGTACTTATAAATTAGAAGAAATTAAAGCTCCAGAAGGTTTTGCGA
  12481 ---------+---------+---------+---------+---------+---------+ 12540
        GTCCAGAACGACGACCATGAATATTTAATCTTCTTTAATTTCGAGGTCTTCCAAAACGCT

c         G  L  A  A  G  T  Y  K  L  E  E  I  K  A  P  E  G  F  A  K -

        AAATTGATGATGTAGAATTTGTTGTTGGAGCAGGTTCTTGGAATCAAGGTGAGTTTAATT
  12541 ---------+---------+---------+---------+---------+---------+ 12600
        TTTAACTACTACATCTTAAACAACAACCTCGTCCAAGAACCTTAGTTCCACTCAAATTAA

c         I  D  D  V  E  F  V  V  G  A  G  S  W  N  Q  G  E  F  N  Y -

        ACTTAAAAGATGTTCAAAAGAATGACGCTACAAAAGTAGTCAACAAAAAAATCACTATCC
  12601 ---------+---------+---------+---------+---------+---------+ 12660
        TGAATTTTCTACAAGTTTTCTTACTGCGATGTTTTCATCAGTTGTTTTTTTAGTGATAGG

c         L  K  D  V  Q  K  N  D  A  T  K  V  V  N  K  K  I  T  I  P -

        CACAAACGGGTGGTATTGGTACAATTATCTTTGCTGTAGCGGGGGCTGCGATTATGGGTA
  12661 ---------+---------+---------+---------+---------+---------+ 12720
        GTGTTTGCCCACCATAACCATGTTAATAGAAACGACATCGCCCCCGACGCTAATACCCAT

c         Q  T  G  G  I  G  T  I  I  F  A  V  A  G  A  A  I  M  G  I -

        TTGCAGTGTACGCATATGTTAAAAACAACAAAGATGAGGATCAACTTGCTTAAGTAAGAG
  12721 ---------+---------+---------+---------+---------+---------+ 12780
        AACGTCACATGCGTATACAATTTTTGTTGTTTCTACTCCTAGTTGAACGAATTCATTCTC

c         A  V  Y  A  Y  V  K  N  N  K  D  E  D  Q  L  A  *          -

        AGAAAGGAGCCATTGATGACAATGCAGAAAATGCAGAAAATGATTAGTCGTATCTTCTTT
  12781 ---------+---------+---------+---------+---------+---------+ 12840
        TCTTTCCTCGGTAACTACTGTTACGTCTTTTACGTCTTTTACTAATCAGCATAGAAGAAA

a                        M  T  M  Q  K  M  Q  K  M  I  S  R  I  F  F  -orf5_670, homologue of sp0464,LPXTG

        GTTATGGCTCTGTGTTTTTCTCTTGTATGGGGTGCACATGCAGTCCAAGCGCAAGAAGAT
  12841 ---------+---------+---------+---------+---------+---------+ 12900
        CAATACCGAGACACAAAAAGAGAACATACCCCACGTGTACGTCAGGTTCGCGTTCTTCTA
```

```
a         V  M  A  L  C  F  S  L  V  W  G  A  H  A  V  Q  A  Q  E  D   -

          CACACGTTGGTCTTGCAATTGGAGAACTATCAGGAGGTGGTTAGTCAATTGCCATCTCGT
   12901 ---------+---------+---------+---------+---------+---------+ 12960
          GTGTGCAACCAGAACGTTAACCTCTTGATAGTCCTCCACCAATCAGTTAACGGTAGAGCA

a         H  T  L  V  L  Q  L  E  N  Y  Q  E  V  V  S  Q  L  P  S  R   -

          GATGGTCATCGGTTGCAAGTATGGAAGTTGGATGATTCGTATTCCTATGATGATCGGGTG
   12961 ---------+---------+---------+---------+---------+---------+ 13020
          CTACCAGTAGCCAACGTTCATACCTTCAACCTACTAAGCATAAGGATACTACTAGCCCAC

a         D  G  H  R  L  Q  V  W  K  L  D  D  S  Y  S  Y  D  D  R  V   -

          CAAATTGTAAGAGACTTGCATTCGTGGGATGAGAATAAACTTTCTTCTTTCAAAAAGACT
   13021 ---------+---------+---------+---------+---------+---------+ 13080
          GTTTAACATTCTCTGAACGTAAGCACCCTACTCTTATTTGAAAGAAGAAAGTTTTTCTGA

a         Q  I  V  R  D  L  H  S  W  D  E  N  K  L  S  S  F  K  K  T   -

          TCGTTTGAGATGACCTTCCTTGAGAATCAGATTGAAGTATCTCATATTCCAAATGGTCTT
   13081 ---------+---------+---------+---------+---------+---------+ 13140
          AGCAAACTCTACTGGAAGGAACTCTTAGTCTAACTTCATAGAGTATAAGGTTTACCAGAA

a         S  F  E  M  T  F  L  E  N  Q  I  E  V  S  H  I  P  N  G  L   -

          TACTATGTTCGCTCTATTATCCAGACGGATGCGGTTTCTTATCCAGCTGAATTTCTTTTT
   13141 ---------+---------+---------+---------+---------+---------+ 13200
          ATGATACAAGCGAGATAATAGGTCTGCCTACGCCAAAGAATAGGTCGACTTAAAGAAAAA

a         Y  Y  V  R  S  I  I  Q  T  D  A  V  S  Y  P  A  E  F  L  F   -

          GAAATGACAGATCAAACGGTAGAGCCTTTGGTCATTGTAGCGAAAAAAACAGATACAATG
   13201 ---------+---------+---------+---------+---------+---------+ 13260
          CTTTACTGTCTAGTTTGCCATCTCGGAAACCAGTAACATCGCTTTTTTTGTCTATGTTAC

a         E  M  T  D  Q  T  V  E  P  L  V  I  V  A  K  K  T  D  T  M   -

          ACAACAAAGGTGAAGCTGATAAAGGTGGATCAAGACCACAATCGCTTGGAGGGTGTCGGC
   13261 ---------+---------+---------+---------+---------+---------+ 13320
```

Figure 101AG

```
          TGTTGTTTCCACTTCGACTATTTCCACCTAGTTCTGGTGTTAGCGAACCTCCCACAGCCG

a         T  T  K  V  K  L  I  K  V  D  Q  D  H  N  R  L  E  G  V  G   -

          TTTAAATTGGTATCAGTAGCAAGAGATGGTTCTGAAAAAGAGGTTCCCTTGATTGGAGAA
   13321 ---------+---------+---------+---------+---------+---------+ 13380
          AAATTTAACCATAGTCATCGTTCTCTACCAAGACTTTTTCTCCAAGGGAACTAACCTCTT

a         F  K  L  V  S  V  A  R  D  G  S  E  K  E  V  P  L  I  G  E   -

          TACCGTTACAGTTCTTCTGGTCAAGTAGGGAGAACTCTCTATACTGATAAAAATGGAGAG
   13381 ---------+---------+---------+---------+---------+---------+ 13440
          ATGGCAATGTCAAGAAGACCAGTTCATCCCTCTTGAGAGATATGACTATTTTTACCTCTC

a         Y  R  Y  S  S  S  G  Q  V  G  R  T  L  Y  T  D  K  N  G  E   -

          ATTTTTGTGACAAATCTTCCTCTTGGGAACTATCGTTTCAAGGAGGTGGAGCCACTGGCA
   13441 ---------+---------+---------+---------+---------+---------+ 13500
          TAAAAACACTGTTTAGAAGGAGAACCCTTGATAGCAAAGTTCCTCCACCTCGGTGACCGT

a         I  F  V  T  N  L  P  L  G  N  Y  R  F  K  E  V  E  P  L  A   -

          GGCTATGCTGTTACGACGCTGGATACGGATGTCCAGCTGGTAGATCATCAGCTGGTGACG
   13501 ---------+---------+---------+---------+---------+---------+ 13560
          CCGATACGACAATGCTGCGACCTATGCCTACAGGTCGACCATCTAGTAGTCGACCACTGC

a         G  Y  A  V  T  T  L  D  T  D  V  Q  L  V  D  H  Q  L  V  T   -

          ATTACGGTTGTCAATCAGAAATTACCACGTGGCAATGTTGACTTTATGAAGGTGGATGGT
   13561 ---------+---------+---------+---------+---------+---------+ 13620
          TAATGCCAACAGTTAGTCTTTAATGGTGCACCGTTACAACTGAAATACTTCCACCTACCA

a         I  T  V  V  N  Q  K  L  P  R  G  N  V  D  F  M  K  V  D  G   -

          CGGACCAATACCTCTCTTCAAGGGGCAATGTTCAAAGTCATGAAAGAAGAAAGCGGACAC
   13621 ---------+---------+---------+---------+---------+---------+ 13680
          GCCTGGTTATGGAGAGAAGTTCCCCGTTACAAGTTTCAGTACTTTCTTCTTTCGCCTGTG

a         R  T  N  T  S  L  Q  G  A  M  F  K  V  M  K  E  E  S  G  H   -
```

Figure 101AH

```
         TATACTCCTGTTCTTCAAAATGGTAAGGAAGTAGTTGTAACATCAGGGAAAGATGGTCGT
   13681 ---------+---------+---------+---------+---------+---------+ 13740
         ATATGAGGACAAGAAGTTTTACCATTCCTTCATCAACATTGTAGTCCCTTTCTACCAGCA

a        Y  T  P  V  L  Q  N  G  K  E  V  V  V  T  S  G  K  D  G  R   -

         TTCCGAGTGGAAGGTCTAGAGTATGGGACATACTATTTATGGGAGCTCCAAGCTCCAACT
   13741 ---------+---------+---------+---------+---------+---------+ 13800
         AAGGCTCACCTTCCAGATCTCATACCCTGTATGATAAATACCCTCGAGGTTCGAGGTTGA

a        F  R  V  E  G  L  E  Y  G  T  Y  Y  L  W  E  L  Q  A  P  T   -

         GGTTATGTTCAATTAACATCGCCTGTTTCCTTTACAATCGGGAAAGATACTCGTAAGGAA
   13801 ---------+---------+---------+---------+---------+---------+ 13860
         CCAATACAAGTTAATTGTAGCGGACAAAGGAAATGTTAGCCCTTTCTATGAGCATTCCTT

a        G  Y  V  Q  L  T  S  P  V  S  F  T  I  G  K  D  T  R  K  E   -

         CTGGTAACAGTGGTTAAAAATAACAAGCGACCACGGATTGATGTGCCAGATACAGGGGAA
   13861 ---------+---------+---------+---------+---------+---------+ 13920
         GACCATTGTCACCAATTTTTATTGTTCGCTGGTGCCTAACTACACGGTCTATGTCCCCTT

a        L  V  T  V  V  K  N  N  K  R  P  R  I  D  V  P  D  T  G  E   -

         GAAACCTTGTATATCTTGATGCTTGTTGCCATTTTGTTGTTTGGTAGTGGTTATTATCTT
   13921 ---------+---------+---------+---------+---------+---------+ 13980
         CTTTGGAACATATAGAACTACGAACAACGGTAAAACAACAAACCATCACCAATAATAGAA

a        E  T  L  Y  I  L  M  L  V  A  I  L  L  F  G  S  G  Y  Y  L   -

         ACGAAAAAACCAAATAACTGATATTCAATGTACATCATTATGAAAAAGATAGCAGGCTGA
   13981 ---------+---------+---------+---------+---------+---------+ 14040
         TGCTTTTTTGGTTTATTGACTATAAGTTACATGTAGTAATACTTTTTCTATCGTCCGACT

a        T  K  K  P  N  N  *

         AGGGAAGACCAGAGTACTCTGAGGTGATGTTAATCAGGAATCATGGTGATGTGGCATGAA
   14041 ---------+---------+---------+---------+---------+---------+ 14100
         TCCCTTCTGGTCTCATGAGACTCCACTACAATTAGTCCTTAGTACCACTACACCGTACTT
```

Figure 101AI

```
      TCACAATAACGGATATGAGGCTGGGCAGATTGTGCCAGCCTCATTGTGGGTTATTGTTTG
14101 ---------+---------+---------+---------+---------+---------+ 14160
      AGTGTTATTGCCTATACTCCGACCCGTCTAACACGGTCGGAGTAACACCCAATAACAAAC

      TAAAACGATAGGACTGGTCTGGTAATCATTTTAGGAATGGACAGGACTGGGATTCTGATT
14161 ---------+---------+---------+---------+---------+---------+ 14220
      ATTTTGCTATCCTGACCAGACCATTAGTAAAATCCTTACCTGTCCTGACCCTAAGACTAA

      TAAAATGGATGGTGAATCAGAAAGAAATGAGATTTTCTCGTTTCTCTTAGCAGATAGGAT
14221 ---------+---------+---------+---------+---------+---------+ 14280
      ATTTTACCTACCACTTAGTCTTTCTTTACTCTAAAAGAGCAAAGAGAATCGTCTATCCTA

      TGTCTGTTAGGAAAAGCGATAAAATGATGAGTTTGAAGATAAAGGGATGCTGATAAAAAT
14281 ---------+---------+---------+---------+---------+---------+ 14340
      ACAGACAATCCTTTTCGCTATTTTACTACTCAAACTTCTATTTCCCTACGACTATTTTTA

                                               M  L  I  K  M  -orf6_670, homologue of sp0466, sortase

      GGTAAAAACAAAAAAGCAAAAACGAAATAATCTCCTATTAGGAGTGGTATTTTTCATTGG
14341 ---------+---------+---------+---------+---------+---------+ 14400
      CCATTTTTGTTTTTTCGTTTTTGCTTTATTAGAGGATAATCCTCACCATAAAAAGTAACC

b       V  K  T  K  K  Q  K  R  N  N  L  L  L  G  V  V  F  F  I  G  -

      AATGGCGGTAATGGCGTATCCGCTGGTGTCTCGCTTGTATTATCGAGTGGAATCAAATCA
14401 ---------+---------+---------+---------+---------+---------+ 14460
      TTACCGCCATTACCGCATAGGCGACCACAGAGCGAACATAATAGCTCACCTTAGTTTAGT

b       M  A  V  M  A  Y  P  L  V  S  R  L  Y  Y  R  V  E  S  N  Q  -

      ACAAATTGCTGACTTTGATAAGGAAAAAGCAACGTTGGATGAGGCTGACATTGATGAACG
14461 ---------+---------+---------+---------+---------+---------+ 14520
      TGTTTAACGACTGAAACTATTCCTTTTTCGTTGCAACCTACTCCGACTGTAACTACTTGC

b       Q  I  A  D  F  D  K  E  K  A  T  L  D  E  A  D  I  D  E  R  -

      AATGAAATTGGCACAAGCCTTCAATGACTCTTTGAATAATGTAGTGAGTGGCGATCCTTG
```

Figure 101AJ

```
14521 ---------+---------+---------+---------+---------+---------+ 14580
      TTACTTTAACCGTGTTCGGAAGTTACTGAGAAACTTATTACATCACTCACCGCTAGGAAC

b       M  K  L  A  Q  A  F  N  D  S  L  N  N  V  V  S  G  D  P  W  -

      GTCGGAAGAAATGAAGAAAAAAGGGCGAGCAGAGTATGCACGTATGTTAGAAATCCATGA
14581 ---------+---------+---------+---------+---------+---------+ 14640
      CAGCCTTCTTTACTTCTTTTTTCCCGCTCGTCTCATACGTGCATACAATCTTTAGGTACT

b       S  E  E  M  K  K  K  G  R  A  E  Y  A  R  M  L  E  I  H  E  -

      GCGGATGGGGCATGTGGAAATCCCCGTTATTGACGTGGATTTGCCGGTTTATGCTGGTAC
14641 ---------+---------+---------+---------+---------+---------+ 14700
      CGCCTACCCCGTACACCTTTAGGGGCAATAACTGCACCTAAACGGCCAAATACGACCATG

b       R  M  G  H  V  E  I  P  V  I  D  V  D  L  P  V  Y  A  G  T  -

      TGCTGAAGAGGTATTGCAGCAAGGGGCTGGGCATCTAGAGGGAACTTCTCTGCCGATCGG
14701 ---------+---------+---------+---------+---------+---------+ 14760
      ACGACTTCTCCATAACGTCGTTCCCCGACCCGTAGATCTCCCTTGAAGAGACGGCTAGCC

b       A  E  E  V  L  Q  Q  G  A  G  H  L  E  G  T  S  L  P  I  G  -

      AGGCAATTCGACCCATGCGGTGATTACGGCACATACAGGTTTGCCAACAGCTAAGATGTT
14761 ---------+---------+---------+---------+---------+---------+ 14820
      TCCGTTAAGCTGGGTACGCCACTAATGCCGTGTATGTCCAAACGGTTGTCGATTCTACAA

b       G  N  S  T  H  A  V  I  T  A  H  T  G  L  P  T  A  K  M  F  -

      TACGGATTTGACCAAACTTAAAGTTGGGGATAAGTTTTATGTGCACAATATCAAGGAAGT
14821 ---------+---------+---------+---------+---------+---------+ 14880
      ATGCCTAAACTGGTTTGAATTTCAACCCCTATTCAAAATACACGTGTTATAGTTCCTTCA

b       T  D  L  T  K  L  K  V  G  D  K  F  Y  V  H  N  I  K  E  V  -

      GATGGCCTATCAAGTGGATCAAGTAAAGGTGATTGAGCCGACGAACTTTGATGATTTATT
14881 ---------+---------+---------+---------+---------+---------+ 14940
      CTACCGGATAGTTCACCTAGTTCATTTCCACTAACTCGGCTGCTTGAAACTACTAAATAA

b       M  A  Y  Q  V  D  Q  V  K  V  I  E  P  T  N  F  D  D  L  L  -
```

Figure 101AK

```
      GATTGTACCAGGTCATGATTATGTGACCTTGCTGACTTGTACGCCATACATGATCAATAC
14941 ---------+---------+---------+---------+---------+---------+ 15000
      CTAACATGGTCCAGTACTAATACACTGGAACGACTGAACATGCGGTATGTACTAGTTATG

b      I  V  P  G  H  D  Y  V  T  L  L  T  C  T  P  Y  M  I  N  T  -

      CCATCGTCTATTGGTTCGGGGGCATCGGATACCGTACGTAGCAGAGGTTGAGGAAGAATT
15001 ---------+---------+---------+---------+---------+---------+ 15060
      GGTAGCAGATAACCAAGCCCCCGTAGCCTATGGCATGCATCGTCTCCAACTCCTTCTTAA

b      H  R  L  L  V  R  G  H  R  I  P  Y  V  A  E  V  E  E  E  F  -

      TATTGCAGCAAACAAACTCAGTCATCTCTATCGCTACCTGTTTTATGTGGCAGTTGGTTT
15061 ---------+---------+---------+---------+---------+---------+ 15120
      ATAACGTCGTTTGTTTGAGTCAGTAGAGATAGCGATGGACAAAATACACCGTCAACCAAA

b      I  A  A  N  K  L  S  H  L  Y  R  Y  L  F  Y  V  A  V  G  L  -

      GATTGTGATTCTTTTATGGATTATTCGACGCTTGCGCAAGAAGAAAAAACAACCGGAAAA
15121 ---------+---------+---------+---------+---------+---------+ 15180
      CTAACACTAAGAAAATACCTAATAAGCTGCGAACGCGTTCTTCTTTTTTGTTGGCCTTTT

b      I  V  I  L  L  W  I  I  R  R  L  R  K  K  K  K  Q  P  E  K  -

      GGCTTTGAAGGCGCTGAAAGCAGCAAGGAAGGAAGTGAAGGTGGAGGATGGACAACAGTA
15181 ---------+---------+---------+---------+---------+---------+ 15240
      CCGAAACTTCCGCGACTTTCGTCGTTCCTTCCTTCACTTCCACCTCCTACCTGTTGTCAT

b      A  L  K  A  L  K  A  A  R  K  E  V  K  V  E  D  G  Q  Q  *  -

      GACGTTCACGAAAAAAAGGCACAAAAAAGAAGAAACATCCGCTGATCCTTCTTCTGATTT
15241 ---------+---------+---------+---------+---------+---------+ 15300
      CTGCAAGTGCTTTTTTTCCGTGTTTTTTCTTCTTTGTAGGCGACTAGGAAGAAGACTAAA

      TCTTAGTAGGATTCGCCGTTGCGATATATCCATTGGTGTCTCGTTATTATTATCGTATTG
15301 ---------+---------+---------+---------+---------+---------+ 15360
      AGAATCATCCTAAGCGGCAACGCTATATAGGTAACCACAGAGCAATAATAATAGCATAAC

c                                 V  S  R  Y  Y  Y  R  I  E -orf7_670, homologue of sp0467, sortase
```

Figure 101AL

```
      AGTCAAACGAGGTTATTAAAGAGTTTGATGAGACGGTTTCCCAGATGGATAAGGCAGAAC
15361 ---------+---------+---------+---------+---------+---------+ 15420
      TCAGTTTGCTCCAATAATTTCTCAAACTACTCTGCCAAAGGGTCTACCTATTCCGTCTTG

c       S  N  E  V  I  K  E  F  D  E  T  V  S  Q  M  D  K  A  E  L -

      TTGAGGAGCGTTGGCGCTTGGCTCAAGCCTTCAATGCGACCTTGAAACCATCTGAAATTC
15421 ---------+---------+---------+---------+---------+---------+ 15480
      AACTCCTCGCAACCGCGAACCGAGTTCGGAAGTTACGCTGGAACTTTGGTAGACTTTAAG

c       E  E  R  W  R  L  A  Q  A  F  N  A  T  L  K  P  S  E  I  L -

      TTGATCCTTTTACAGAGCAAGAGAAAAAGAAAGGCGTCTCAGAATATGCCAATATGCTAA
15481 ---------+---------+---------+---------+---------+---------+ 15540
      AACTAGGAAAATGTCTCGTTCTCTTTTTCTTTCCGCAGAGTCTTATACGGTTATACGATT

c       D  P  F  T  E  Q  E  K  K  K  G  V  S  E  Y  A  N  M  L  K -

      AGGTCCATGAGCGGATTGGCTATGTGGAAATTCCTGCGATTGATCAGGAAATTCCGATGT
15541 ---------+---------+---------+---------+---------+---------+ 15600
      TCCAGGTACTCGCCTAACCGATACACCTTTAAGGACGCTAACTAGTCCTTTAAGGCTACA

c       V  H  E  R  I  G  Y  V  E  I  P  A  I  D  Q  E  I  P  M  Y -

      ATGTCGGAACGAGTGAGGAAATTCTTCAGAAGGGCGCAGGATTGCTAGAGGGAGCTTCGT
15601 ---------+---------+---------+---------+---------+---------+ 15660
      TACAGCCTTGCTCACTCCTTTAAGAAGTCTTCCCGCGTCCTAACGATCTCCCTCGAAGCA

c       V  G  T  S  E  E  I  L  Q  K  G  A  G  L  L  E  G  A  S  L -

      TACCGGTTGGTGGTGAAAATACCCACACAGTTGTCACTGCTCATAGAGGATTACCGACGG
15661 ---------+---------+---------+---------+---------+---------+ 15720
      ATGGCCAACCACCACTTTTATGGGTGTGTCAACAGTGACGAGTATCTCCTAATGGCTGCC

c       P  V  G  G  E  N  T  H  T  V  V  T  A  H  R  G  L  P  T  A -

      CAGAACTGTTTAGTCAATTGGATAAGATGAAAAAAGGGGATGTCTTTTATCTTCACGTTT
15721 ---------+---------+---------+---------+---------+---------+ 15780
      GTCTTGACAAATCAGTTAACCTATTCTACTTTTTTCCCCTACAGAAAATAGAAGTGCAAA
```

```
c          E  L  F  S  Q  L  D  K  M  K  K  G  D  V  F  Y  L  H  V  L -

          TAGACCAGGTGTTGGCCTACCAAGTGGATCAGATTTTGACGGTTGAGCCAAATGACTTTG
   15781 ---------+---------+---------+---------+---------+---------+ 15840
          ATCTGGTCCACAACCGGATGGTTCACCTAGTCTAAAACTGCCAACTCGGTTTACTGAAAC

c          D  Q  V  L  A  Y  Q  V  D  Q  I  L  T  V  E  P  N  D  F  E -

          AGCCTGTCTTGATTCAACATGGGGAAGATTATGCGACCTTGTTGACCTGTACACCGTATA
   15841 ---------+---------+---------+---------+---------+---------+ 15900
          TCGGACAGAACTAAGTTGTACCCCTTCTAATACGCTGGAACAACTGGACATGTGGCATAT

c          P  V  L  I  Q  H  G  E  D  Y  A  T  L  L  T  C  T  P  Y  M -

          TGATTAACAGTCATCGTCTGTTGGTACGTGGGAAGCGGATTCCGTATACGGCACCAATTG
   15901 ---------+---------+---------+---------+---------+---------+ 15960
          ACTAATTGTCAGTAGCAGACAACCATGCACCCTTCGCCTAAGGCATATGCCGTGGTTAAC

c          I  N  S  H  R  L  L  V  R  G  K  R  I  P  Y  T  A  P  I  A -

          CAGAGCGAAATCGAGCGGTGAGAGAGCGTGGGCAATTCTGGTTGTGGTTATTGCTAGCGG
   15961 ---------+---------+---------+---------+---------+---------+ 16020
          GTCTCGCTTTAGCTCGCCACTCTCTCGCACCCGTTAAGACCAACACCAATAACGATCGCC

c          E  R  N  R  A  V  R  E  R  G  Q  F  W  L  W  L  L  L  A  A -

          CGTTGGTTATGATTCTGGTATTGAGTTACGGGGTGTATCGTCATCGTCGCATTGTCAAAG
   16021 ---------+---------+---------+---------+---------+---------+ 16080
          GCAACCAATACTAAGACCATAACTCAATGCCCCACATAGCAGTAGCAGCGTAACAGTTTC

c          L  V  M  I  L  V  L  S  Y  G  V  Y  R  H  R  R  I  V  K  G -

          GGCTAGAAAAACAATTGGAGGAGCATCATGTCAAAGGCTAAGCTACAGAAATTACTAGGG
   16081 ---------+---------+---------+---------+---------+---------+ 16140
          CCGATCTTTTTGTTAACCTCCTCGTAGTACAGTTTCCGATTCGATGTCTTTAATGATCCC

a                                      M  S  K  A  K  L  Q  K  L  L  G  -orf8_670, homologue of sp0468, sortase

c          L  E  K  Q  L  E  E  H  H  V  K  G  *
```

Figure 101AN

```
          TATTTGCTGATGCTGGTAGCATTGGTGATTCCTGTTTATTGTTTTGGGCAGATGGTGTTA
    16141 ---------+---------+---------+---------+---------+---------+ 16200
          ATAAACGACTACGACCATCGTAACCACTAAGGACAAATAACAAAACCCGTCTACCACAAT

a         Y  L  L  M  L  V  A  L  V  I  P  V  Y  C  F  G  Q  M  V  L   -

          CAGTCTTTAGGACAAGTAAAAGGTCATGAGATATTTTCAGAATCTGTGACGGCCGACAGT
    16201 ---------+---------+---------+---------+---------+---------+ 16260
          GTCAGAAATCCTGTTCATTTTCCAGTACTCTATAAAAGTCTTAGACACTGCCGGCTGTCA

a         Q  S  L  G  Q  V  K  G  H  E  I  F  S  E  S  V  T  A  D  S   -

          TACCAAGAGCAATTGCAACGGTCGCTTGATTACAATCAACGCTTGGATTCGCAAAATCGT
    16261 ---------+---------+---------+---------+---------+---------+ 16320
          ATGGTTCTCGTTAACGTTGCCAGCGAACTAATGTTAGTTGCGAACCTAAGCGTTTTAGCA

a         Y  Q  E  Q  L  Q  R  S  L  D  Y  N  Q  R  L  D  S  Q  N  R   -

          ATTGTAGATCCTTTTTTGGCGGAAGGGTATGAGGTAAATTACCAAGTGTCTGACGATCCT
    16321 ---------+---------+---------+---------+---------+---------+ 16380
          TAACATCTAGGAAAAAACCGCCTTCCCATACTCCATTTAATGGTTCACAGACTGCTAGGA

a         I  V  D  P  F  L  A  E  G  Y  E  V  N  Y  Q  V  S  D  D  P   -

          GATGCAGTCTACGGCTATTTGTCGATTCCGAGTTTGGAAATCATGGAGCCAGTTTATCTA
    16381 ---------+---------+---------+---------+---------+---------+ 16440
          CTACGTCAGATGCCGATAAACAGCTAAGGCTCAAACCTTTAGTACCTCGGTCAAATAGAT

a         D  A  V  Y  G  Y  L  S  I  P  S  L  E  I  M  E  P  V  Y  L   -

          GGAGCGGATTACCATCATTTAGCAATGGGGTTGGCCCATGTGGATGGGACGCCTCTTCCT
    16441 ---------+---------+---------+---------+---------+---------+ 16500
          CCTCGCCTAATGGTAGTAAATCGTTACCCCAACCGGGTACACCTACCCTGCGGAGAAGGA

a         G  A  D  Y  H  H  L  A  M  G  L  A  H  V  D  G  T  P  L  P   -

          GTTGAGGGAAAAGGGATTCGTTCAGTGATTGCTGGGCACCGTGCAGAACCAAGCCATGTC
    16501 ---------+---------+---------+---------+---------+---------+ 16560
          CAACTCCCTTTTCCCTAAGCAAGTCACTAACGACCCGTGGCACGTCTTGGTTCGGTACAG
```

```
a          V  E  G  K  G  I  R  S  V  I  A  G  H  R  A  E  P  S  H  V   -

           TTTTTCCGCCATTTGGATCAGCTAAAAGTTGGAGATGCTCTTTATTATGATAATGGCCAG
   16561  ---------+---------+---------+---------+---------+---------+ 16620
           AAAAAGGCGGTAAACCTAGTCGATTTTCAACCTCTACGAGAAATAATACTATTACCGGTC

a          F  F  R  H  L  D  Q  L  K  V  G  D  A  L  Y  Y  D  N  G  Q   -

           GAAATTGTAGAATATCAGATGATGGACACAGAGATTATTTTACCGTCGGAATGGGAAAAA
   16621  ---------+---------+---------+---------+---------+---------+ 16680
           CTTTAACATCTTATAGTCTACTACCTGTGTCTCTAATAAAATGGCAGCCTTACCCTTTTT

a          E  I  V  E  Y  Q  M  M  D  T  E  I  I  L  P  S  E  W  E  K   -

           TTAGAATCGGTTAGCTCTAAAAATATCATGACCTTGATAACCTGCGATCCGATTCCTACC
   16681  ---------+---------+---------+---------+---------+---------+ 16740
           AATCTTAGCCAATCGAGATTTTTATAGTACTGGAACTATTGGACGCTAGGCTAAGGATGG

a          L  E  S  V  S  S  K  N  I  M  T  L  I  T  C  D  P  I  P  T   -

           TTTAATAAACGCTTATTAGTGAATTTTGAACGAGTCGCTGTTTATCAAAAATCAGATCCA
   16741  ---------+---------+---------+---------+---------+---------+ 16800
           AAATTATTTGCGAATAATCACTTAAAACTTGCTCAGCGACAAATAGTTTTTAGTCTAGGT

a          F  N  K  R  L  L  V  N  F  E  R  V  A  V  Y  Q  K  S  D  P   -

           CAAACAGCTGCAGTTGCGAGGGTTGCTTTTACGAAAGAAGGACAATCTGTATCGCGTGTT
   16801  ---------+---------+---------+---------+---------+---------+ 16860
           GTTTGTCGACGTCAACGCTCCCAACGAAAATGCTTTCTTCCTGTTAGACATAGCGCACAA

a          Q  T  A  A  V  A  R  V  A  F  T  K  E  G  Q  S  V  S  R  V   -

           GCAACCTCTCAATGGTTGTACCGTGGGCTAGTGGTACTGGCATTTCTGGGAATCCTGTTT
   16861  ---------+---------+---------+---------+---------+---------+ 16920
           CGTTGGAGAGTTACCAACATGGCACCCGATCACCATGACCGTAAAGACCCTTAGGACAAA

a          A  T  S  Q  W  L  Y  R  G  L  V  V  L  A  F  L  G  I  L  F   -

           GTTTTGTGGAAGCTAGCACGTTTACTACGAGGGAAATAAAAAGAAATGAAAGGAAAGCTA
   16921  ---------+---------+---------+---------+---------+---------+ 16980
```

Figure 101AP

```
             CAAAACACCTTCGATCGTGCAAATGATGCTCCCTTTATTTTTCTTTACTTTCCTTTCGAT

a            V  L  W  K  L  A  R  L  L  R  G  K  *

             AGGCTGTTCCTTTTTCCGGCTCTTTGTCAACTGTAGTGGGTTGAAAAAAAGCTAAGCTCG
      16981 ---------+---------+---------+---------+---------+---------+ 17040
             TCCGACAAGGAAAAAGGCCGAGAAACAGTTGACATCACCCAACTTTTTTTCGATTCGAGC

             AGAAAGGACAAATTTTGTCCTTTCTTTTTTGATATTCAGAGCGATAAAAATCCGTTTTTT
      17041 ---------+---------+---------+---------+---------+---------+ 17100
             TCTTTCCTGTTTAAAACAGGAAAGAAAAAACTATAAGTCTCGCTATTTTTAGGCAAAAAA

             GAAGTTTTCAAA
      17101 ---------+-- 17112
             CTTCAAAAGTTT
```

M1, strain 2580

LEGEND:

I α-#: immune serum anti-#
P α-#: pre-immune serum anti-#

M1, strain 2913

LEGEND:

I α-#: immune serum anti-#
P α-#: pre-immune serum anti-#

M1, strain 3280

LEGEND:

I α-#: immune serum anti-#
P α-#: pre-immune serum anti-#

M1 strain 3348

M1 strain 2719

Figure 107
LPXTG negative controls
Anti-15
Anti-16
Anti-18
Anti-16p2
Anti-57
Anti143
Anti-158
Anti-187

Western blot Western blot on fraction enriched in surface proteins of M1 (SF370)

Western blot on fraction enriched in surface proteins of M12 (2728)

Western blot on fraction enriched in surface proteins of M6 (2724)

M6 strain isolate 2724

M6 strain isolate 3650

A B

Pilus released by *Lactococcus* sonication

FIGURE 136A

1. MK
2. GBS 80 (10 ng )
3. L.lactis-AI1 starting material (30', 0.2 OD)
4. L.lactis-AI1 (not boiled, 0.33 OD)
5. L.lactis-AI1 (5', 0.33 OD)
6. L.lactis-AI1 (60' d, 0.33 OD)
7. L.lactis-AI1 (30', 0.33 OD)
8. Supernatant (not boiled, 2 OD)
9. Supernatant (5', 2 OD)
10. Supernatant (30', 2 OD)
11. Supernatant (60', 2 OD)

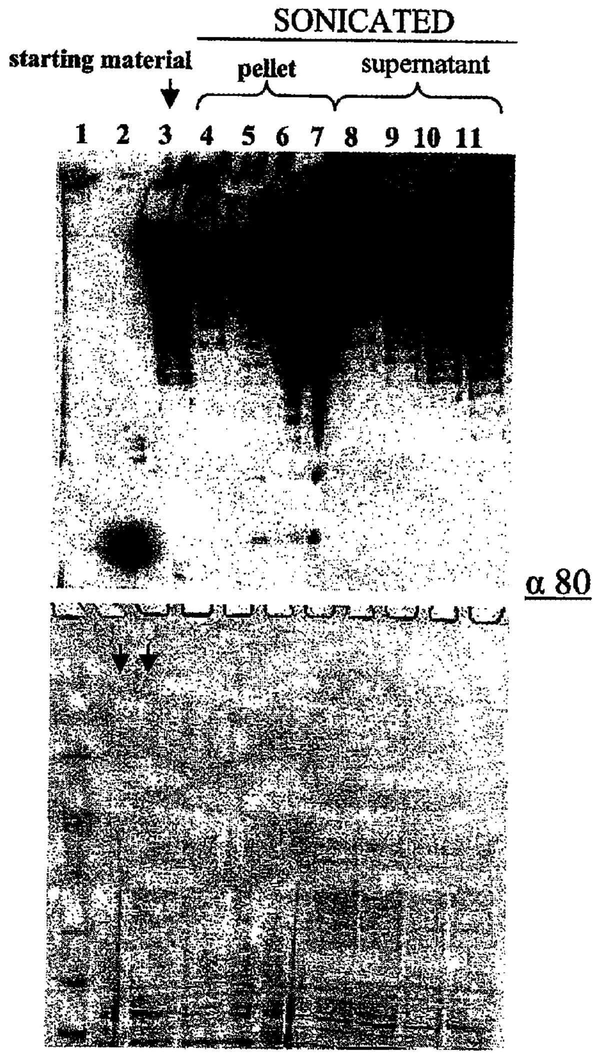

FIGURE 136B

1. MK
2. L.lactis-AI1 (30', 0.33 OD)
3. L.lactis-AI1 starting material (30', 0.2 OD)
4. L.lactis-AI1 (not boiled, 0.33 OD)
5. L.lactis-AI1 (5', 0.33 OD)
6. L.lactis-AI1 (60' d, 0.33 OD)
7. L.lactis-AI1 (30', 0.33 OD)
8. Supernatant (not boiled, 2 OD)
9. Supernatant (5', 2 OD)
10. Supernatant (30', 2 OD)
11. Supernatant (60', 2 OD)

A

TIGR4

B

| PCR product | contig_length _TIGR4 | overlap |
|---|---|---|
| 1 | 754 | 83 |
| 2 | 759 | 84 |
| 3 | 847 | 98 |
| 4 | 2550 | 99 |
| 5 | 2736 | 99 |
| 6 | 925 | 99 |
| 7 | 745 | 87 |
| 8 | 765 | 94 |
| 9 | 1008 | 94 |
| 10 | 802 | 64 |
| 11 | 461 | |

Figure 141A

```
ORF2_14CSR      MLNKYIEKRITDKITILNILLDIRSIELDELSTLTSLQSKSLLSILQELQETFEEELTFN
ORF2_19AH       MLNKYIEKRITDKITILNILLDIRSIELDELSTLTSLQSKSLLSILQELQETFEEELTFN
ORF2_19FTW      MLNKYIEKRITDKITILNILLDIRSIELDELSTLTSLQSKSLLSILQELQETFEEELTFN
ORF2_23FP       MLNKYIEKRITDKITILNILLDIRSIELDELSTLTSLQSKSLLSILQELQETFEEELTFN
ORF2_23FTW      MLNKYIEKRITDKITILNILLDIRSIELDELSTLTSLQSKSLLSILQELQETFEEELTFN
ORF2_670        MLNKYIEKRITDKITILNILLDIRSIELDELSTLTSLQSKSLLSILQELQETFEEELTFN
ORF2_6BF        MLNKYIEKRITDKITILNILLDIRSIELDELSTLTSLQSKSLLSILQELQETFEEELTFN
ORF2_6BSP       MLNKYIEKRITDKITILNILLDIRSIELDELSTLTSLQSKSLLSILQELQETFEEELTFN
ORF2_TIGR       MLNKYIEKRITDKITILNILLDIRSIELDELSTLTSLQSKSLLSILQELQETFEEELTFN
ORF2_9VSP       MLNKYIEKRITDKITILNILLDIRSIELDELSTLTSLQSKSLLSILQELQETFEEELTFN
                ************************************************************

ORF2_14CSR      LDTQQVQLIEHHSHQTNYYFHQLYNQSTILKILRFFLLQGNQSFNEFTQKEYISIATGYR
ORF2_19AH       LDTQQVQLIEHHSHQTNYYFHQLYNQSTILKILRFFLLQGNQSFNEFTQKEYISIATGYR
ORF2_19FTW      LDTQQVQLIEHHSHQTNYYFHQLYNQSTILKILRFFLLQGNQSFNEFTQKEYISIATGYR
ORF2_23FP       LDTQQVQLIEHHSHQTNYYFHQLYNQSTILKILRFFLLQGNQSFNEFTQKEYISIATGYR
ORF2_23FTW      LDTQQVQLIEHHSHQTNYYFHQLYNQSTILKILRFFLLQGNQSFNEFTQKEYISIATGYR
ORF2_670        LDTQQVQLIEHHSHQTNYYFHQLYNQSTILKILRFFLLQGNQSFNEFTQKEYISIATGYR
ORF2_6BF        LDTQQVQLIEHHSHQTNYYFHQLYNQSTILKILRFFLLQGNQSFNEFTQKEYISIATGYR
ORF2_6BSP       LDTQQVQLIEHHSHQTNYYFHQLYNQSTILKILRFFLLQGNQSFNEFTQKEYISIATGYR
ORF2_TIGR       LDTQQVQLIEHHSHQTNYYFHQLYNQSTILKILRFFLLQGNQSFNEFTQKEYISIATGYR
ORF2_9VSP       LDTQQVQLIEHHSHQTNYYFHQLYNQSTILKILRFFLLQGNQSFNEFTQKEYISIATGYR
                ************************************************************

ORF2_14CSR      VRQKCGLLLRSVGLDLVKNQVVGPEYRIRFLIALLQFHFGIEIYDLNDGSMDWVTHMIVQ
ORF2_19AH       VRQKCGLLLRSVGLDLVKNQVVGPEYRIRFLIALLQFHFGIEIYDLNDGSMDWVTHMIVQ
ORF2_19FTW      VRQKCGLLLRSVGLDLVKNQVVGPEYRIRFLIALLQFHFGIEIYDLNDGSMDWVTHMIVQ
ORF2_23FP       VRQKCGLLLRSVGLDLVKNQVVGPEYRIRFLIALLQFHFGIEIYDLNDGSMDWVTHMIVQ
ORF2_23FTW      VRQKCGLLLRSVGLDLVKNQVVGPEYRIRFLIALLQFHFGIEIYDLNDGSMDWVTHMIVQ
ORF2_670        VRQKCGLLLRSVGLDLVKNQVVGPEYRIRFLIALLQFHFGIEIYDLNDGSMDWVTHMIVQ
ORF2_6BF        VRQKCGLLLRSVGLDLVKNQVVGPEYRIRFLIALLQFHFGIEIYDLNDGSMDWVTHMIVQ
ORF2_6BSP       VRQKCGLLLRSVGLDLVKNQVVGPEYRIRFLIALLQFHFGIEIYDLNDGSMDWVTHMIVQ
ORF2_TIGR       VRQKCGLLLRSVGLDLVKNQVVGPEYRIRFLIALLQFHFGIEIYDLNDGSMDWVTHMIVQ
ORF2_9VSP       VRQKCGLLLRSVGLDLVKNQVVGPEYRIRFLIALLQFHFGIEIYDLNDGSMDWVTHMIVQ
                ************************************************************

ORF2_14CSR      SNSQLSHELLEITPDEYVHFSILVALTWKRREFPLEFPESKEFEKLKNLFMYPILMEHCQ
ORF2_19AH       SNSQLSHELLEITPDEYVHFSILVALTWKRREFPLEFPESKEFEKLKNLFMYPILMEHCQ
ORF2_19FTW      SNSQLSHELLEITPDEYVHFSILVALTWKRREFPLEFPESKEFEKLKNLFMYPILMEHCQ
ORF2_23FP       SNSQLSHELLEITPDEYVHFSILVALTWKRREFPLEFPESKEFEKLKNLFMYPILMEHCQ
ORF2_23FTW      SNSQLSHELLEITPDEYVHFSILVALTWKRREFPLEFPESKEFEKLKNLFMYPILMEHCQ
ORF2_670        SNSQLSHELLEITPDEYVHFSILVALTWKRREFPLEFPESKEFEKLKNLFMYPILMEHCQ
ORF2_6BF        SNSQLSHELLEITPDEYVHFSILVALTWKRREFPLEFPESKEFEKLKNLFMYPILMEHCQ
ORF2_6BSP       SNSQLSHELLEITPDEYVHFSILVALTWKRREFPLEFPESKEFEKLKNLFMYPILMEHCQ
ORF2_TIGR       SNSQLSHELLEITPDEYVHFSILVALTWKRREFPLEFPESKEFEKLKNLFMYPILMEHCQ
ORF2_9VSP       SNSQLSHELLEITPDEYVHFSILVALTWKRREFPLEFPESKEFEKLKNLFMYPILMEHCQ
                ************************************************************

ORF2_14CSR      TYLEPHANMTFTQEELDYIFLVYCSANSSFSKDKWNQEKKTHTIQLILQHTRGKHLLSKF
ORF2_19AH       TYLEPHANMTFTQEELDYIFLVYCSANSSFSKDKWNQEKKTHTIQLILQHTRGKHLLSKF
ORF2_19FTW      TYLEPHANMTFTQEELDYIFLVYCSANSSFSKDKWNQEKKTHTIQLILQHTRGKHLLSKF
ORF2_23FP       TYLEPHANMTFTQEELDYIFLVYCSANSSFSKDKWNQEKKTHTIQLILQHTRGKHLLSKF
ORF2_23FTW      TYLEPHANMTFTQEELDYIFLVYCSANSSFSKDKWNQEKKTHTIQLILQHTRGKHLLSKF
ORF2_670        TYLEPHANMTFTQEELDYIFLVYCSANSSFSKDKWNQEKKTHTIQLILQHTRGKHLLSKF
ORF2_6BF        TYLEPHANMTFTQEELDYIFLVYCSANSSFSKDKWNQEKKTHTIQLILQHTRGKHLLSKF
ORF2_6BSP       TYLEPHANMTFTQEELDYIFLVYCSANSSFSKDKWNQEKKTHTIQLILQHTRGKHLLSKF
ORF2_TIGR       TYLEPHANMTFTQEELDYIFLVYCSANSSFSKDKWNQEKKTHTIQLILQHTRGKHLLSKF
ORF2_9VSP       TYLEPHANMTFTQEELDYIFLVYCSANSSFSKDKWNQEKKTHTIQLILQHTRGKHLLSKF
                ************************************************************
```

Figure 141B

```
ORF2_14CSR      KNILGNDISNSLSFLTALTFLTRTFLFGLQNLVPYYNYYEHYGIESDKPLYHISKAIVQE
ORF2_19AH       KNILGNDISNSLSFLTALTFLTRTFLFGLQNLVPYYNYYEHYGIESDKPLYHISKAIVQE
ORF2_19FTW      KNILGNDISNSLSFLTALTFLTRTFLFGLQNLVPYYNYYEHYGIESDKPLYHISKAIVQE
ORF2_23FP       KNILGNDISNSLSFLTALTFLTRTFLFGLQNLVPYYNYYEHYGIESDKPLYHISKAIVQE
ORF2_23FTW      KNILGNDISNSLSFLTALTFLTRTFLFGLQNLVPYYNYYEHYGIESDKPLYHISKAIVQE
ORF2_670        KNILGNDISNSLSFLTALTFLTRTFLFGLQNLVPYYNYYEHYGIESDKPLYHISKAIVQE
ORF2_6BF        KNILGNDISNSLSFLTALTFLTRTFLFGLQNLVPYYNYYEHYGIESDKPLYHISKAIVQE
ORF2_6BSP       KNILGNDISNSLSFLTALTFLTRTFLFGLQNLVPYYNYYEHYGIESDKPLYHISKAIVQE
ORF2_TIGR       KNILGNDISNSLSFLTALTFLTRTFLFGLQNLVPYYNYYEHYGIESDKPLYHISKAIVQE
ORF2_9VSP       KNILGNDISNSLSFLTALTFLTRTFLFGLQNLVPYYNYYEHYGIESDKPLYHISKAIVQE
                ************************************************************

ORF2_14CSR      WMTEQKIEGVIDQHRLYLFSLYLTETIFSSLPAIPIFIILNNQADVNLIKSIILRNFTDK
ORF2_19AH       WMTEQKIEGVIDQHRLYLFSLYLTETIFSSLPAIPIFIILNNQADVNLIKSIILRNFTDK
ORF2_19FTW      WMTEQKIEGVIDQHRLYLFSLYLTETIFSSLPAIPIFIILNNQADVNLIKSIILRNFTDK
ORF2_23FP       WMTEQKIEGVIDQHRLYLFSLYLTETIFSSLPAIPIFIILNNQADVNLIKSIILRNFTDK
ORF2_23FTW      WMTEQKIEGVIDQHRLYLFSLYLTETIFSSLPAIPIFIILNNQADVNLIKSIILRNFTDK
ORF2_670        WMTEQKIEGVIDQHRLYLFSLYLTETIFSSLPAIPIFIILNNQADVNLIKSIILRNFTDK
ORF2_6BF        WMTEQKIEGVIDQHRLYLFSLYLTETIFSSLPAIPIFIILNNQADVNLIKSIILRNFTDK
ORF2_6BSP       WMTEQKIEGVIDQHRLYLFSLYLTETIFSSLPAIPIFIILNNQADVNLIKSIILRNFTDK
ORF2_TIGR       WMTEQKIEGVIDQHRLYLFSLYLTETIFSSLPAIPIFIILNNQADVNLIKSIILRNFTDK
ORF2_9VSP       WMTEQKIEGVIDQHRLYLFSLYLTETIFSSLPAIPIFIILNNQADVNLIKSIILRNFTDK
                ************************************************************

ORF2_14CSR      VASVTGYNILISPPPSEEHLTEPLIIITTKEYLPYVKKQYPKGKHHFLTIALDLHVSQQR
ORF2_19AH       VASVTGYNILISPPPSEEHLTEPLIIITTKEYLPYVKKQYPKGKHHFLTIALDLHVSQQR
ORF2_19FTW      VASVTGYNILISPPPSEEHLTEPLIIITTKEYLPYVKKQYPKGKHHFLTIALDLHVSQQR
ORF2_23FP       VASVTGYNILISPPPSEEHLTEPLIIITTKEYLPYVKKQYPKGKHHFLTIALDLHVSQQR
ORF2_23FTW      VASVTGYNILISPPPSEEHLTEPLIIITTKEYLPYVKKQYPKGKHHFLTIALDLHVSQQR
ORF2_670        VASVTGYNILISPPPSEEHLTEPLIIITTKEYLPYVKKQYPKGKHHFLTIALDLHVSQQR
ORF2_6BF        VASVTGYNILISPPPSEEHLTEPLIIITTKEYLPYVKKQYPKGKHHFLTIALDLHVSQQR
ORF2_6BSP       VASVTGYNILISPPPSEEHLTEPLIIITTKEYLPYVKKQYPKGKHHFLTIALDLHVSQQR
ORF2_TIGR       VASVTGYNILISPPPSEEHLTEPLIIITTKEYLPYVKKQYPKGKHHFLTIALDLHVSQQR
ORF2_9VSP       VASVTGYNILISPPPSEEHLTEPLIIITTKEYLPYVKKQYPKGKHHFLTIALDLHVSQQR
                ************************************************************

ORF2_14CSR      LIYQTIVDIRKEAFDKRVAMIAKKAHYLL
ORF2_19AH       LIYQTIVDIRKEAFDKRVAMIAKKAHYLL
ORF2_19FTW      LIYQTIVDIRKEAFDKRVAMIAKKAHYLL
ORF2_23FP       LIYQTIVDIRKEAFDKRVAMIAKKAHYLL
ORF2_23FTW      LIYQTIVDIRKEAFDKRVAMIAKKAHYLL
ORF2_670        LIYQTIVDIRKEAFDKRVAMIAKKAHYLL
ORF2_6BF        LIYQTIVDIRKEAFDKRVAMIAKKAHYLL
ORF2_6BSP       LIYQTIVDIRKEAFDKRVAMIAKKAHYLL
ORF2_TIGR       LIYQTIVDIRKEAFDKRVAMIAKKAHYLL
ORF2_9VSP       LIYQTIVDIRKEAFDKRVAMIAKKAHYLL
                *****************************
```

Figure 142A

```
ORF3_19AH       MKKVRKIFQKAVAGLCCISQLTAFSSIVALAETPETSPAIGKVVIKETGEGGALLGDAVF
ORF3_23FP       MKKVRKIFQKAVAGLCCISQLTAFSSIVALAETPETSPAIGKVVIKETGEGGALLGDAVF
ORF3_14CSR      MKKVRKIFQKAVAGLCCISQLTAFSSIVALAETPETSPAIGKVVIKETGEGGALLGDAVF
ORF3_670        MKKVRKIFQKAVAGLCCISQLTAFSSIVALAETPETSPAIGKVVIKETGEGGALLGDAVF
ORF3_6BF        MKKVRKIFQKAVAGLCCISQLTAFSSIVALAETPETSPAIGKVVIKETGEGGALLGDAVF
ORF3_6BSP       MKKVRKIFQKAVAGLCCISQLTAFSSIVALAETPETSPAIGKVVIKETGEGGALLGDAVF
ORF3_19FTW      MKKVRKIFQKAVAGLCCISQLTAFSSIVALAETPETSPAIGKVVIKETGEGGALLGDAVF
ORF3_9VSP       MKKVRKIFQKAVAGLCCISQLTAFSSIVALAETPETSPAIGKVVIKETGEGGALLGDAVF
ORF3_23FTW      MKKVRKIFQKAVAGLCCISQLTAFSSIVALAETPETSPAIGKVVIKETGEGGALLGDAVF
ORF3_TIGR       MKKVRKIFQKAVAGLCCISQLTAFSSIVALAETPETSPAIGKVVIKETGEGGALLGDAVF
                ************************************************************

ORF3_19AH       ELKNNTDGTTVSQRTEAQTGEAIFSNIKPGTYTLTEAQPPVGYKPSTKQWTVEVEKNGRT
ORF3_23FP       ELKNNTDGTTVSQRTEAQTGEAIFSNIKPGTYTLTEAQPPVGYKPSTKQWTVEVEKNGRT
ORF3_14CSR      ELKNNTDGTTVSQRTEAQTGEAIFSNIKPGTYTLTEAQPPVGYKPSTKQWTVEVEKNGRT
ORF3_670        ELKNNTDGTTVSQRTEAQTGEAIFSNIKPGTYTLTEAQPPVGYKPSTKQWTVEVEKNGRT
ORF3_6BF        ELKNNTDGTTVSQRTEAQTGEAIFSNIKPGTYTLTEAQPPVGYKPSTKQWTVEVEKNGRT
ORF3_6BSP       ELKNNTDGTTVSQRTEAQTGEAIFSNIKPGTYTLTEAQPPVGYKPSTKQWTVEVEKNGRT
ORF3_19FTW      ELKNNTDGTTVSQRTEAQTGEAIFSNIKPGTYTLTEAQPPVGYKPSTKQWTVEVEKNGRT
ORF3_9VSP       ELKNNTNGTTVSQRTEAQTGEAIFSNIKPGTYTLTEAQPPVGYKPSTKQRTVEVEKNGRT
ORF3_23FTW      ELKNNTDGTTVSQRTEAQTGEAIFSNIKPGTYTLTEAQPPVGYKPSTKQWTVEVEKNGRT
ORF3_TIGR       ELKNNTDGTTVSQRTEAQTGEAIFSNIKPGTYTLTEAQPPVGYKPSTKQWTVEVEKNGRT
                ******:****************************************** **********

ORF3_19AH       TVQGEQVENREEALSDQYPQTGTYPDVQTPYQIIKVDGSEKNGQHKALNPNPYERVIPEG
ORF3_23FP       TVQGEQVENREEALSDQYPQTGTYPDVQTPYQIIKVDGSEKNGQHKALNPNPYERVIPEG
ORF3_14CSR      TVQGEQVENREEALSDQYPQTGTYPDVQTPYQIIKVDGSEKNGQHKALNPNPYERVIPEG
ORF3_670        TVQGEQVENREEALSDQYPQTGTYPDVQTPYQIIKVDGSEKNGQHKALNPNPYERVIPEG
ORF3_6BF        TVQGEQVENREEALSDQYPQTGTYPDVQTPYQIIKVDGSEKNGQHKALNPNPYERVIPEG
ORF3_6BSP       TVQGEQVENREEALSDQYPQTGTYPDVQTPYQIIKVDGSEKNGQHKALNPNPYERVIPEG
ORF3_19FTW      TVQGEQVENREEALSDQYPQTGTYPDVQTPYQIIKVDGSEKNGQHKALNPNPYERVIPEG
ORF3_9VSP       TVQGEQVENREEALSDQYPQTGTYPDVQTPYQIIKVDGSEKNGQHKALNPNPYERVIPEG
ORF3_23FTW      TVQGEQVENREEALSDQYPQTGTYPDVQTPYQIIKVDGSEKNGQHKALNPNPYERVIPEG
ORF3_TIGR       TVQGEQVENREEALSDQYPQTGTYPDVQTPYQIIKVDGSEKNGQHKALNPNPYERVIPEG
                ************************************************************

ORF3_19AH       TLSKRIYQVNNLDDNQYGIELTVSGKTTVETKEASTPLDVVILLDNSNSMSNIRHNHAHR
ORF3_23FP       TLSKRIYQVNNLDDNQYGIELTVSGKTTVETKEASTPLDVVILLDNSNSMSNIRHNHAHR
ORF3_14CSR      TLSKRIYQVNNLDDNQYGIELTVSGKTTVETKEASTPLDVVILLDNSNSMSNIRHNHAHR
ORF3_670        TLSKRIYQVNNLDDNQYGIELTVSGKTTVETKEASTPLDVVILLDNSNSMSNIRHNHAHR
ORF3_6BF        TLSKRIYQVNNLDDNQYGIELTVSGKTTVETKEASTPLDVVILLDNSNSMSNIRHNHAHR
ORF3_6BSP       TLSKRIYQVNNLDDNQYGIELTVSGKTTVETKEASTPLDVVILLDNSNSMSNIRHNHAHR
ORF3_19FTW      TLSKRIYQVNNLDDNQYGIELTVSGKTVYERKDKSVPLDVVILLDNSNSMSNIRNKNARR
ORF3_9VSP       TLSKRIYQVNNLDDNQYGIELTVSGKTVYERKDKSVPLDVVILLDNSNSMSNIRNKNARR
ORF3_23FTW      TLSKRIYQVNNLDDNQYGIELTVSGKTVYEQKDKSVPLDVVILLDNSNSMSNIRNKNARR
ORF3_TIGR       TLSKRIYQVNNLDDNQYGIELTVSGKTVYEQKDKSVPLDVVILLDNSNSMSNIRNKNARR
                ***************************. * *: *.******************:::*:*

ORF3_19AH       AEKAGEATRALVDKITSNPDNRVALVTYGSTIFDGSEATVEKGVADANGKILNDSALWTF
ORF3_23FP       AEKAGEATRALVDKITSNPDNRVALVTYGSTIFDGSEATVEKGVADANGKILNDSALWTF
ORF3_14CSR      AEKAGEATRALVDKITSNPDNRVALVTYGSTIFDGSEATVEKGVADANGKILNDSALWTF
ORF3_670        AEKAGEATRALVDKITSNPDNRVALVTYGSTIFDGSEATVEKGVADANGKILNDSALWTF
ORF3_6BF        AEKAGEATRALVDKITSNPDNRVALVTYGSTIFDGSEATVEKGVADANGKILNDSALWTF
ORF3_6BSP       AEKAGEATRALVDKITSNPDNRVALVTYGSTIFDGSEATVEKGVADANGKILNDSALWTF
ORF3_19FTW      AERAGEATRSLIDKITSDPENRVALVTYASTIFDGTEFTVEKGVADKNGKRLNDSLFWNY
ORF3_9VSP       AERAGEATRSLIDKITSDPENRVALVTYASTIFDGTEFTVEKGVADKNGKRLNDSLFWNY
ORF3_23FTW      AERAGEATRSLIDKITSDPENRVALVTYASTIFDGTEFTVEKGVADKNGKRLNDSLFWNY
ORF3_TIGR       AERAGEATRSLIDKITSDSENRVALVTYASTIFDGTEFTVEKGVADKNGKRLNDSLFWNY
                **:******:*:*****:.:********.******:* ******** *** **** :*.:
```

Figure 142B

```
ORF3_19AH       DRTTFTAKTYNYSFLNLTSDPTDIQTIKDRIPSDAEELNKDKLMYQFGATFTQKALMTAD
ORF3_23FP       DRTTFTAKTYNYSFLNLTSDPTDIQTIKDRIPSDAEELNKDKLMYQFGATFTQKALMTAD
ORF3_14CSR      DRTTFTAKTYNYSFLNLTSDPTDIQTIKDRIPSDAEELNKDKLMYQFGATFTQKALMTAD
ORF3_670        DRTTFTAKTYNYSFLNLTSDPTDIQTIKDRIPSDAEELNKDKLMYQFGATFTQKALMTAD
ORF3_6BF        DRTTFTAKTYNYSFLNLTSDPTDIQTIKDRIPSDAEELNKDKLMYQFGATFTQKALMTAD
ORF3_6BSP       DRTTFTAKTYNYSFLNLTSDPTDIQTIKDRIPSDAEELNKDKLMYQFGATFTQKALMTAD
ORF3_19FTW      DQTSFTTNTKDYSYLKLTNDKNDIVELKNKVPTEAEDHDGNRLMYQFGATFTQKALMKAD
ORF3_9VSP       DQTSFTTNTKDYSYLKLTNDKNDIVELKNKVPTEAEDHDGNRLMYQFGATFTQKALMKAD
ORF3_23FTW      DQTSFTTNTKDYSYLKLTNDKNDIVELKNKVPTEAEDHDGNRLMYQFGATFTQKALMKAD
ORF3_TIGR       DQTSFTTNTKDYSYLKLTNDKNDIVELKNKVPTEAEDHDGNRLMYQFGATFTQKALMKAD
                *:*:**::* :**:*:**.* .**  :*:::*::**: : ::***************.**

ORF3_19AH       DILTKQARPNSKKVIFHITDGVPTMSYPINFKYTGTTQSYRTQLNNFKAKTPNSSGILLE
ORF3_23FP       DILTKQARPNSKKVIFHITDGVPTMSYPINFKYTGTTQSYRTQLNNFKAKTPNSSGILLE
ORF3_14CSR      DILTKQARPNSKKVIFHITDGVPTMSYPINFKYTGTTQSYRTQLNNFKAKTPNSSGILLE
ORF3_670        DILTKQARPNSKKVIFHITDGVPTMSYPINFKYTGTTQSYRTQLNNFKAKTPNSSGILLE
ORF3_6BF        DILTKQARPNSKKVIFHITDGVPTMSYPINFKYTGTTQSYRTQLNNFKAKTPNSSGILLE
ORF3_6BSP       DILTKQARPNSKKVIFHITDGVPTMSYPINFKYTGTTQSYRTQLNNFKAKTPNSSGILLE
ORF3_19FTW      EILTQQARQNSQKVIFHITDGVPTMSYPINFNHATFAPSYQNQLNAFFSKSPNKDGILLS
ORF3_9VSP       EILTQQARQNSQKVIFHITDGVPTMSYPINFNHATFAPSYQNQLNVFFSKSPNKDGILLS
ORF3_23FTW      EILTQQARQNSQKVIFHITDGVPTMSYPINFNHATFAPSYQNQLNAFFSKSPNKDGILLS
ORF3_TIGR       EILTQQARQNSQKVIFHITDGVPTMSYPINFNHATFAPSYQNQLNAFFSKSPNKDGILLS
                :***:*** **:*******************:::  : **:.*** * :*:**..****.

ORF3_19AH       DFVTWSADGEHKIVRGDGESYQMFTKKPVTDQYGVHQILSITSMEQRAKLVSAGYRFYGT
ORF3_23FP       DFVTWSADGEHKIVRGDGESYQMFTKKPVTDQYGVHQILSITSMEQRAKLVSAGYRFYGT
ORF3_14CSR      DFVTWSADGEHKIVRGDGESYQMFTKKPVTDQYGVHQILSITSMEQRAKLVSAGYRFYGT
ORF3_670        DFVTWSADGEHKIVRGDGESYQMFTKKPVTDQYGVHQILSITSMEQRAKLVSAGYRFYGT
ORF3_6BF        DFVTWSADGEHKIVRGDGESYQMFTKKPVTDQYGVHQILSITSMEQRAKLVSAGYRFYGT
ORF3_6BSP       DFVTWSADGEHKIVRGDGESYQMFTKKPVTDQYGVHQILSITSMEQRAKLVSAGYRFYGT
ORF3_19FTW      DFITQATSGEHTIVRGDGQSYQMFTDKTVYEK-GAPAAFPVK-PEKYSEMKAVGYAVIGD
ORF3_9VSP       DFITQATSGEHTIVRGDGQSYQMFTDKTVYEK-GAPAAFPVK-PEKYSEMKAVGYAVIGD
ORF3_23FTW      DFITQATSGEHTIVRGDGQSYQMFTDKTVYEK-GAPAAFPVK-PEKYSEMKAAGYAVIGD
ORF3_TIGR       DFITQATSGEHTIVRGDGQSYQMFTDKTVYEK-GAPAAFPVK-PEKYSEMKAAGYAVIGD
                **:* ::.***.******:******.*.* :: *.   :.:.  *: ::: :.** . *

ORF3_19AH       -----DLYLYWRDSILAYPFNSSTDWITNHGDPTTWYYNGNMAQDGYDVFTVGVGVNGDP
ORF3_23FP       -----DLYLYWRDSILAYPFNSSTDWITNHGDPTTWYYNGNMAQDGYDVFTVGVGVNGDP
ORF3_14CSR      -----DLYLYWRDSILAYPFNSSTDWITNHGDPTTWYYNGNMAQDGYDVFTVGVGVNGDP
ORF3_670        -----DLYLYWRDSILAYPFNSSTDWITNHGDPTTWYYNGNMAQDGYDVFTVGVGVNGDP
ORF3_6BF        -----DLYLYWRDSILAYPFNSSTDWITNHGDPTTWYYNGNMAQDGYDVFTVGVGVNGDP
ORF3_6BSP       -----DLYLYWRDSILAYPFNSSTDWITNHGDPTTWYYNGNMAQDGYDVFTVGVGVNGDP
ORF3_19FTW      PINGGYIWLNWRESILAYPFNSNTAKITNHGAPTRWYYNGNIAPDGYDVFTVGIGINGDP
ORF3_9VSP       PINGGYIWLNWRESILAYPFNSNTAKITNHGDPTRWYYNGNIAPDGYDVFTVGIGINGDP
ORF3_23FTW      PINGGYIWLNWRESILAYPFNSNTAKITNHGDPTRWYYNGNIAPDGYDVFTVGIGINGDP
ORF3_TIGR       PINGGYIWLNWRESILAYPFNSNTAKITNHGDPTRWYYNGNIAPDGYDVFTVGIGINGDP
                      ::* **:*********.*  ***** ** ******:* *********:*:****

ORF3_19AH       GTDEATATRFMQSISSSPDNYTNVADPSQILQELNRYFYTIVNEKKSIENGTITDPMGEL
ORF3_23FP       GTDEATATRFMQSISSSPDNYTNVADPSQILQELNRYFYTIVNEKKSIENGTITDPMGEL
ORF3_14CSR      GTDEATATRFMQSISSSPDNYTNVADPSQILQELNRYFYTIVNEKKSIENGTITDPMGEL
ORF3_670        GTDEATATRFMQSISSSPDNYTNVADPSQILQELNRYFYTIVNEKKSIENGTITDPMGEL
ORF3_6BF        GTDEATATRFMQSISSSPDNYTNVADPSQILQELNRYFYTIVNEKKSIENGTITDPMGEL
ORF3_6BSP       GTDEATATRFMQSISSSPDNYTNVADPSQILQELNRYFYTIVNEKKSIENGTITDPMGEL
ORF3_19FTW      GTDEATATSFMQSISSKPENYTNVTDTTKILEQLNRYFHTIVTEKKSIENGTITDPMGEL
ORF3_9VSP       GTDEATATSFMQSISSKPENYTNVTDTTKILEQLNRYFHTIVTEKKSIENGTITDPMGEL
ORF3_23FTW      GTDEATATSFMQSISSKPENYTNVTDTTKILEQLNRYFHTIVTEKKSIENGTITDPMGEL
ORF3_TIGR       GTDEATATSFMQSISSKPENYTNVTDTTKILEQLNRYFHTIVTEKKSIENGTITDPMGEL
                ******** *******.*:*****:*.::**::*****:***.*****************
```

Figure 142C

```
ORF3_19AH      IDFQLGADGRFDPADYTLTANDGSSLVNNVPTGGPQNDGGLLKNAKVFYDTTEKRIRVTG
ORF3_23FP      IDFQLGADGRFDPADYTLTANDGSSLVNNVPTGGPQNDGGLLKNAKVFYDTTEKRIRVTG
ORF3_14CSR     IDFQLGADGRFDPADYTLTANDGSSLVNNVPTGGPQNDGGLLKNAKVFYDTTEKRIRVTG
ORF3_670       IDFQLGADGRFDPADYTLTANDGSSLVNNVPTGGPQNDGGLLKNAKVFYDTTEKRIRVTG
ORF3_6BF       IDFQLGADGRFDPADYTLTANDGSSLVNNVPTGGPQNDGGLLKNAKVFYDTTEKRIRVTG
ORF3_6BSP      IDFQLGADGRFDPADYTLTANDGSSLVNNVPTGGPQNDGGLLKNAKVFYDTTEKRIRVTG
ORF3_19FTW     IDLQLGTDGRFDPADYTLTANDGSRLENGQAVGGPQNDGGLLKNAKVFYDTTEKRIRVTG
ORF3_9VSP      IDLQLGTDGRFDPADYTLTANDGSRLENGQAVGGPQNDGGLLKNAKVFYDTTEKRIRVTG
ORF3_23FTW     IDLQLGTDGRFDPADYTLTANDGSRLENGQAVGGPQNDGGLLKNAKVLYDTTEKRIRVTG
ORF3_TIGR      IDLQLGTDGRFDPADYTLTANDGSRLENGQAVGGPQNDGGLLKNAKVLYDTTEKRIRVTG
               **:***:**************** * *. ..**************:***********

ORF3_19AH      LYLGTGEKVTLTYNVRLNDQFVSNKFYDTNGRTTLHPKEVEKNTVRDFPIPKIRDVRKYP
ORF3_23FP      LYLGTGEKVTLTYNVRLNDQFVSNKFYDTNGRTTLHPKEVEKNTVRDFPIPKIRDVRKYP
ORF3_14CSR     LYLGTGEKVTLTYNVRLNDQFVSNKFYDTNGRTTLHPKEVEKNTVRDFPIPKIRDVRKYP
ORF3_670       LYLGTGEKVTLTYNVRLNDQFVSNKFYDTNGRTTLHPKEVEKNTVRDFPIPKIRDVRKYP
ORF3_6BF       LYLGTGEKVTLTYNVRLNDQFVSNKFYDTNGRTTLHPKEVEKNTVRDFPIPKIRDVRKYP
ORF3_6BSP      LYLGTGEKVTLTYNVRLNDQFVSNKFYDTNGRTTLHPKEVEKNTVRDFPIPKIRDVRKYP
ORF3_19FTW     LYLGTGEKVTLTYNVRLNDQFVSNKFYDTNGRTTLHPKEVEKNTVRDFPIPKIRDVRKYP
ORF3_9VSP      LYLGTGEKVTLTYNVRLNDQFVSNKFYDTNGRTTLHPKEVEKNTVRDFPIPKIRDVRKYP
ORF3_23FTW     LYLGTDEKVTLTYNVRLNDEFVSNKFYDTNGRTTLHPKEVEQNTVRDFPIPKIRDVRKYP
ORF3_TIGR      LYLGTDEKVTLTYNVRLNDEFVSNKFYDTNGRTTLHPKEVEQNTVRDFPIPKIRDVRKYP
               *****.*************:*********************:******************

ORF3_19AH      EITIPKEKKLGEIEFIKINKNDKKPLRDAVFSLQKQHPDYPDIYGAIDQNGTYQNVRTGE
ORF3_23FP      EITIPKEKKLGEIEFIKINKNDKKPLRDAVFSLQKQHPDYPDIYGAIDQNGTYQNVRTGE
ORF3_14CSR     EITIPKEKKLGEIEFIKINKNDKKPLRDAVFSLQKQHPDYPDIYGAIDQNGTYQNVRTGE
ORF3_670       EITIPKEKKLGEIEFIKINKNDKKPLRDAVFSLQKQHPDYPDIYGAIDQNGTYQNVRTGE
ORF3_6BF       EITIPKEKKLGEIEFIKINKNDKKPLRDAVFSLQKQHPDYPDIYGAIDQNGTYQNVRTGE
ORF3_6BSP      EITIPKEKKLGEIEFIKINKNDKKPLRDAVFSLQKQHPDYPDIYGAIDQNGTYQNVRTGE
ORF3_19FTW     AITIAKEKKLGEIEFIKINKNDKKPLRDAVFSLQKQHPDYPDIYGAIDQNGTYQNVRTGE
ORF3_9VSP      AITIAKEKKLGEIEFIKINKNDKKPLRDAVFSLQKQHPDYPDIYGAIDQNGTYQNVRTGE
ORF3_23FTW     EITISKEKKLGDIEFIKVNKNDKKPLRDAVFSLQKQHPDYPDIYGAIDQNGTYQNVRTGE
ORF3_TIGR      EITISKEKKLGDIEFIKVNKNDKKPLRGAVFSLQKQHPDYPDIYGAIDQNGTYQNVRTGE
                ***.******:*****:*********.*********************************

ORF3_19AH      DGKLTFKNLSDGKYRLFENSEPAGYKPVQNKPIVAFQIVNGEVRDVTSIVPQDIPAGYEF
ORF3_23FP      DGKLTFKNLSDGKYRLFENSEPAGYKPVQNKPIVAFQIVNGEVRDVTSIVPQDIPAGYEF
ORF3_14CSR     DGKLTFKNLSDGKYRLFENSEPAGYKPVQNKPIVAFQIVNGEVRDVTSIVPQDIPAGYEF
ORF3_670       DGKLTFKNLSDGKYRLFENSEPAGYKPVQNKPIVAFQIVNGEVRDVTSIVPQDIPAGYEF
ORF3_6BF       DGKLTFKNLSDGKYRLFENSEPAGYKPVQNKPIVAFQIVNGEVRDVTSIVPQDIPAGYEF
ORF3_6BSP      DGKLTFKNLSDGKYRLFENSEPAGYKPVQNKPIVAFQIVNGEVRDVTSIVPQDIPAGYEF
ORF3_19FTW     DGKLTFKNLSDGKYRLFENSEPAGYKPVQNKPIVAFQIVNGEVRDVTSIVPQDIPAGYEF
ORF3_9VSP      DGKLTFKNLSDGKYRLFENSEPAGYKPVQNKPIVAFQIVNGEVRDVTSIVPQDIPAGYEF
ORF3_23FTW     DGKLTFKNLSDGKYRLFENSEPAGYKPVQNKPIVAFQIVNGEVRDVTSIVPQDIPAGYEF
ORF3_TIGR      DGKLTFKNLSDGKYRLFENSEPAGYKPVQNKPIVAFQIVNGEVRDVTSIVPQDIPAGYEF
               ************************************************************

ORF3_19AH      TNDKHYITNEPIPPKREYPRTGGIGMLPFYLIGCMMMGGVLLYTRKNP
ORF3_23FP      TNDKHYITNEPIPPKREYPRTGGIGMLPFYLIGCMMMGGVLLYTRKNP
ORF3_14CSR     TNDKHYITNEPIPPKREYPRTGGIGMLPFYLIGCMMMGGVLLYTRKHP
ORF3_670       TNDKHYITNEPIPPKREYPRTGGIGMLPFYLIGCMMMGGVLLYTRKHP
ORF3_6BF       TNDKHYITNEPIPPKREYPRTGGIGMLPFYLIGCMMMGGVLLYTRKHP
ORF3_6BSP      TNDKHYITNEPIPPKREYPRTGGIGMLPFYLIGCMMMGGVLLYTRKHP
ORF3_19FTW     TNDKHYITNEPIPPKREYPRTGGIGMLPFYLIGCMMMGGVLLYTRKHP
ORF3_9VSP      TNDKHYITNEPIPPKREYPRTGGIGMLLFYLIGCMMMGGVLLYTRKHP
ORF3_23FTW     TNDKHYITNEPIPPKREYPRTGGIGMLPFYLIGCMMMGGVLLYTRKHP
ORF3_TIGR      TNDKHYITNEPIPPKREYPRTGGIGMLPFYLIGCMMMGGVLLYTRKHP
               *************************** ******************:*
```

Figure 143A

```
ORF4_6BF        MKSINKFLTMLAALLLTASSLFSAATVFAADNVSTAPDAVTKTLTIHKLLLSEDDLKTWD
ORF4_6BSP       MKSINKFLTMLAALLLTASSLFSAATVFAADNVSTAPDAVTKTLTIHKLLLSEDDLKTWD
ORF4_670        MKSINKFLTMLAALLLTASSLFSAATVFAADNVSTAPDAVTKTLTIHKLLLSEDDLKTWD
ORF4_14CSR      MKSINKFLTMLAALLLTASSLFSAATVFAADNVSTAPDAVTKTLTIHKLLLSEDDLKTWD
ORF4_19AH       MKSINKFLTMLAALLLTASSLFSAATVFAADNVSTAPDAVTKTLTIHKLLLSEDDLKTWD
ORF4_23FP       MKSINKFLTMLAALLLTASSLFSAATVFAADNVSTAPDAVTKTLTIHKLLLSEDDLKTWD
ORF4_23FTW      MKSINKFLTILAALLLTVSSLFSAATVFAAEQK-------TKTLTVHKLLMTDQELDAWN
ORF4_19FTW      MKSINKFLTMLAALLLTASSLFSAATVFAAGTT-------TTSVTVHKLLATDGDMDKIA
ORF4_9VSP       MKSINKFLTMLAALLLTASSLFSAATVFAAGTT-------TTSVTVHKLLATDGDMDKIA
ORF4_TIGR       MKSINKFLTMLAALLLTASSLFSAATVFAAGTT-------TTSVTVHKLLATDGDMDKIA
                *********:*******.************          *.::*:**** :: ::.

ORF4_6BF        TNGPK--GYDGTQ-----SSLKDLTGVVA--EEIPNVYFELQKYNLTDGKEKENLKDD-S
ORF4_6BSP       TNGPK--GYDGTQ-----SSLKDLTGVVA--EEIPNVYFELQKYNLTDGKEKENLKDD-S
ORF4_670        TNGPK--GYDGTQ-----SSLKDLTGVVA--EEIPNVYFELQKYNLTDGKEKENLKDD-S
ORF4_14CSR      TNGPK--GYDGTQ-----SSLKDLTGVVA--EEIPNVYFELQKYNLTDGKEKENLKDD-S
ORF4_19AH       TNGPK--GYDGTQ-----SSLKDLTGVVA--EEIPNVYFELQKYNLTDGKEKENLKDD-S
ORF4_23FP       TNGPK--GYDGTQ-----SSLKDLTGVVA--EEIPNVYFELQKYNLTDGKEKENLKDD-S
ORF4_23FTW      SDAITTAGYDGSQN---FEQFKQLQGVPQGVTEISGVAFELQSYTGPQGKEQENLTND-A
ORF4_19FTW      NELETG-NYAGNKVGVLPANAKEIAGVMFVWTNTNNEIIDENGQTLGVNIDPQTFKLSGA
ORF4_9VSP       NELETG-NYAGNKVGVLPANAKEIAGVMFVWTNTNNEIIDENGQTLGVNIDPQTFKLSGA
ORF4_TIGR       NELETG-NYAGNKVGVLPANAKEIAGVMFVWTNTNNEIIDENGQTLGVNIDPQTFKLSGA
                 .:  .  .* *.:       . *:: **      :  .  :: :  .   . : :.:. . :

ORF4_6BF        KWTTVHGGLTTKDGLKIETSTLKG-VYRIREDRTKTTYVGPNGQVLTGSKAVPALVTLPL
ORF4_6BSP       KWTTVHGGLTTKDGLKIETSTLKG-VYRIREDRTKTTYVGPNGQVLTGSKAVPALVTLPL
ORF4_670        KWTTVHGGLTTKDGLKIETSTLKG-VYRIREDRTKTTYVGPNGQVLTGSKAVPALVTLPL
ORF4_14CSR      KWTTVHGGLTTKDGLKIETSTLKG-VYRIREDRTKTTYVGPNGQVLTGSKAVPALVTLPL
ORF4_19AH       KWTTVHGGLTTKDGLKIETSTLKG-VYRIREDRTKTTYVGPNGQVLTGSKAVPALVTLPL
ORF4_23FP       KWTTVHGGLTTKDGLKIETSTLKG-VYRIREDRTKTTYVGPNGQVLTGSKAVPALVTLPL
ORF4_23FTW      VWTAVNKGVTTETGVKFDTEVLQG-TYRLVEVRKESTYVGPNGKVLTGMKAVPALITLPL
ORF4_19FTW      MPATAMKKLTEAEGAKFNTANLPAAKYKIYEIHSLSTYVGEDGATLTGSKAVPIEIELPL
ORF4_9VSP       MPATAMKKLTEAEGAKFNTANLPAAKYKIYEIHSLSTYVGEDGATLTGSKAVPIEIELPL
ORF4_TIGR       MPATAMKKLTEAEGAKFNTANLPAAKYKIYEIHSLSTYVGEDGATLTGSKAVPIEIELPL
                  ::.   :*   * *::*  *  .  *:: * :. :**** :* .*** ****  : ***

ORF4_6BF        VNNNGTVIDAHVFPKNSYNKPVVDKRIADTLNYND-------QNGLSIGTKIPYVVNTTI
ORF4_6BSP       VNNNGTVIDAHVFPKNSYNKPVVDKRIADTLNYND-------QNGLSIGTKIPYVVNTTI
ORF4_670        VNNNGTVIDAHVFPKNSYNKPVVDKRIADTLNYND-------QNGLSIGTKIPYVVNTTI
ORF4_14CSR      VNNNGTVIDAHVFPKNSYNKPVVDKRIADTLNYND-------QNGLSIGTKIPYVVNTTI
ORF4_19AH       VNNNGTVIDAHVFPKNSYNKPVVDKRIADTLNYND-------QNGLSIGTKIPYVVNTTI
ORF4_23FP       VNNNGTVIDAHVFPKNSYNKPVVDKRIADTLNYND-------QNGLSIGTKIPYVVNTTI
ORF4_23FTW      VNQNGVVENAHVYPKNSEDKPTATKTFDTAAGFVDP-----GEKGLAIGTKVPYIVTTTI
ORF4_19FTW      ND----VVDAHVYPKNTEAKPKIDKDFKGKANPDTPRVDKDTPVNHQVGDVVEYEIVTKI
ORF4_9VSP       ND----VVDAHVYPKNTEAKPKIDKDFKGKANPDTPRVDKDTPVNHQVGDVVEYEIVTKI
ORF4_TIGR       ND----VVDAHVYPKNTEAKPKIDKDFKGKANPDTPRVDKDTPVNHQVGDVVEYEIVTKI
                 :     * :***:***:  **    * :     .            .  :*  : * : *.*

ORF4_6BF        PSNATFATSFWSDEMTEGLTYN-EDVTITLNNVAMDQADYEVTKGNNGFNLKLTEAGLAK
ORF4_6BSP       PSNATFATSFWSDEMTEGLTYN-EDVTITLNNVAMDQADYEVTKGNNGFNLKLTEAGLAK
ORF4_670        PSNATFATSFWSDEMTEGLTYN-EDVTITLNNVAMDQADYEVTKGNNGFNLKLTEAGLAK
ORF4_14CSR      PSNATFATSFWSDEMTEGLTYN-EDVTITLNNVAMDQADYEVTKGNNGFNLKLTEAGLAK
ORF4_19AH       PSNATFATSFWSDEMTEGLTYN-EDVTITLNNVAMDQADYEVTKGXNGFNLKLTEAGLAK
ORF4_23FP       PSNATFATSFWSDEMTEGLTYN-EDVTITLNNVAMDQADYEVTKGINGFNLKLTEAGLAK
ORF4_23FTW      PKNSTLATAFWSDEMTEGLDYN-GDVVVNYNGQPLDNSHYTLEAGHNGFILKLNEKGLEA
ORF4_19FTW      PALANYATANWSDRMTEGLAFNKGTVKVTVDDVALEAGDYALTEVATGFDLKLTDAGLAK
ORF4_9VSP       PALANYATANWSDRMTEGLAFNKGTVKVTVDDVALEAGDYALTEVATGFDLKLTDAGLAK
ORF4_TIGR       PALANYATANWSDRMTEGLAFNKGTVKVTVDDVALEAGDYALTEVATGFDLKLTDAGLAK
                *  :. **: ***.***** :*    * :. :. .:: ..* :    .** ***.: **
```

Figure 143B

```
ORF4_6BF        INGKDADQKIQITYSATLNSLAVADIPESNDITYHYGNHQDHGNTPKPTKPN-NGQITVT
ORF4_6BSP       INGKDADQKIQITYSATLNSLAVADIPESNDITYHYGNHQDHGNTPKPTKPN-NGQITVT
ORF4_670        INGKDADQKIQITYSATLNSLAVADIPESNDITYHYGNHQDHGNTPKPTKPN-NGQITVT
ORF4_14CSR      INGKDADQKIQITYSATLNSLAVADIPESNDITYHYGNHQDHGNTPKPTKPN-NGQITVT
ORF4_19AH       INGKDADQKIQITYSATLNSLAVADIPESNDITYHYGNHQDHGNTPKPTKPN-NGQITVT
ORF4_23FP       INGKDADQKIQITYSATLNSLAVADIPESNDITYHYGNHQDHGNTPKPTKPN-NGQITVT
ORF4_23FTW      INGKDAEATITLKYTATLNALAVADVPEANDVTFHYGNNPGHGNTPKPNKPK-NGELTIT
ORF4_19FTW      VNDQNAEKTVKITYSATLNDKAIVEVPESNDVTFNYGNNPDHGNTPKPNKPNENGDLTLT
ORF4_9VSP       VNDQNAEKTVKITYSATLNDKAIVEVPESNDVTFNYGNNPDHGNTPKPNKPNENGDLTLT
ORF4_TIGR       VNDQNAEKTVKITYSATLNDKAIVEVPESNDVTFNYGNNPDHGNTPKPNKPNENGDLTLT
                :*.::*: .: :.*:****  *:.::**:**:*::***: .*******.**: **::*:*

ORF4_6BF        KTWDSQPAP---EGVKATVQLVNAKTGEKVGAP------VELSENNWTYTWSGLDNSIEY
ORF4_6BSP       KTWDSQPAP---EGVKATVQLVNAKTGEKVGAP------VELSENNWTYTWSGLDNSIEY
ORF4_670        KTWDSQPAP---EGVKATVQLVNAKTGEKVGAP------VELSENNWTYTWSGLDNSIEY
ORF4_14CSR      KTWDSQPAP---EGVKATVQLVNAKTGEKVGAP------VELSENNWTYTWSGLDNSIEY
ORF4_19AH       KTWDSQPAP---EGVKATVQLVNAKTGEKVGAP------VELSENNWTYTWSGLDNSIEY
ORF4_23FP       KTWDSQPAP---EGVKATVQLVNAKTGEKVGAP------VELSENNWTYTWSGLDNSIEY
ORF4_23FTW      KTWADAKDAPI-AGVEVTFDLVNAQTGEVVKVPGHETGIVLNQTNNWTFTATGLDNNTEY
ORF4_19FTW      KTWVDATGAPIPAGAEATFDLVNAQTGKVVQTV-------TLTTDKNTVTVNGLDKNTEY
ORF4_9VSP       KTWVDATGAPIPAGAEATFDLVNAQTGKVVQTV-------TLTTDKNTVTVNGLDKNTEY
ORF4_TIGR       KTWVDATGAPIPAGAEATFDLVNAQTGKVVQTV-------TLTTDKNTVTVNGLDKNTEY
                *** .   .    *.:.*.:****:**: * .            :: * * .***:. **

ORF4_6BF        K-VEEEYNGYSAEY-TVESKGKLGVKNWKDNNPAPINPEEPRVKTYGKKFVKVDQKDTRL
ORF4_6BSP       K-VEEEYNGYSAEY-TVESKGKLGVKNWKDNNPAPINPEEPRVKTYGKKFVKVDQKDTRL
ORF4_670        K-VEEEYNGYSAEY-TVESKGKLGVKNWKDNNPAPINPEEPRVKTYGKKFVKVDQKDTRL
ORF4_14CSR      K-VEEEYNGYSAEY-TVESKGKLGVKNWKDNNPAPINPEEPRVKTYGKKFVKVDQKDTRL
ORF4_19AH       K-VEEEYNGYSAEY-TVESKGKLGVKNWKDNNPAPINPEEPRVKTYGKKFVKVDQKDTRL
ORF4_23FP       K-VEEEYNGYSAEY-TVESKGKLGVKNWKDNNPAPINLEEPRVKTYGKKFVKVDQKDTRL
ORF4_23FTW      KFVERTIKGYSADYQTITETGKIAVKNWKDENPEPINPEEPRVKTYGKKFVKVDQKDERL
ORF4_19FTW      KFVERSIKGYSADYQEITTAGEIAVKNWKDENPKPLDPTEPKVVTYGKKFVKVNDKDNRL
ORF4_9VSP       KFVERSIKGYSADYQEITTAGEIAVKNWKDENPKPLDPTEPKVVTYGKKFVKVNDKDNRL
ORF4_TIGR       KFVERSIKGYSADYQEITTAGEIAVKNWKDENPKPLDPTEPKVVTYGKKFVKVNDKDNRL
                * **.  :****:*  :   *::.******:** *::  **:* *********::** **

ORF4_6BF        ENAQFVVKKADSN-KYIAFKSTAQQAADEKAAATAKQKLDAAVAAY---TNAADKQAAQA
ORF4_6BSP       ENAQFVVKKADSN-KYIAFKSTAQQAADEKAAATAKQKLDAAVAAY---TNAADKQAAQA
ORF4_670        ENAQFVVKKADSN-KYIAFKSTAQQAADEKAAATAKQKLDAAVAAY---TNAADKQAAQA
ORF4_14CSR      ENAQFVVKKADSN-KYIAFKSTAQQAADEKAAATAKQKLDAAVAAY---TNAADKQAAQA
ORF4_19AH       ENAQFVVKKADSN-KYIAFKSTAQQAADEKAAATAKQKLDAAVAAY---TNAADKQAAQA
ORF4_23FP       ENAQFVVKKADSN-KYIAFKSTAQQAADEKAAATAKQKLDAAVAAY---TNAADKQAAQA
ORF4_23FTW      KEAQFVVKNEQG--KYLALKSAAQQAVNEKAAAEAKQALDAAIAAY---TNAADKNAAQA
ORF4_19FTW      AGAEFVIANADNAGQYLARKADKVSQEEKQLVVTTKDALDRAVAAYNALTAQQQTQQEKE
ORF4_9VSP       AGAEFVIANADNAGQYLARKADKVSQEEKQLVVTTKDALDRAVAAYNALTAQQQTQQEKE
ORF4_TIGR       AGAEFVIANADNAGQYLARKADKVSQEEKQLVVTTKDALDRAVAAYNALTAQQQTQQEKE
                  *:**: : :.  :*:* *:   .  ::: .. :*: ** *:***   *   :.:  :

ORF4_6BF        LVDQAQQEYNVAYKEAKFGYVEVAGKDE--AMVLTSNTDGQFQISGLAAGTYKLEEIKAP
ORF4_6BSP       LVDQAQQEYNVAYKEAKFGYVEVAGKDE--AMVLTSNTDGQFQISGLAAGTYKLEEIKAP
ORF4_670        LVDQAQQEYNVAYKEAKFGYVEVAGKDE--AMVLTSNTDGQFQISGLAAGTYKLEEIKAP
ORF4_14CSR      LVDQAQQEYNVAYKEAKFGYVEVAGKDE--AMVLTSNTDGQFQISGLAAGTYKLEEIKAP
ORF4_19AH       LVDQAQQEYNVAYKEAKFGYVEVAGKDE--AMVLTSNTDGQFQISGLAAGTYKLEEIKAP
ORF4_23FP       LVDQAQQEYNVAYKEAKFGYVEVAGKDE--AMVLTSNTDGQFQISGLAAGTYKLEEIKAP
ORF4_23FTW      VVDAAQKTYNDNYRAARFGYVEVERKED--ALVLTSNTDGQFQISGLAAGSYTLEETKAP
ORF4_19FTW      KVDKAQAAYNAAVIAANNAFEWVADKDNENVVKLVSDAQGRFEITGLLAGTYYLEETKQP
ORF4_9VSP       KVDKAQAAYNAAVIAANNAFEWVADKDNENVVKLVSDAQGRFEITGLLAGTYYLEETKQP
ORF4_TIGR       KVDKAQAAYNAAVIAANNAFEWVADKDNENVVKLVSDAQGRFEITGLLAGTYYLEETKQP
                 ** **  **     *. .:  *  *::  .: *.*:::*:*:*:** **:* *** * *
```

Figure 143C

```
ORF4_6BF      EGFAKIDD-VEFVVGAGSWNQG--EFNYLKDVQKNDATKVVNKKITIPQTGGIGTIIFAV
ORF4_6BSP     EGFAKIDD-VEFVVGAGSWNQG--EFNYLKDVQKNDATKVVNKKITIPQTGGIGTIIFAV
ORF4_670      EGFAKIDD-VEFVVGAGSWNQG--EFNYLKDVQKNDATKVVNKKITIPQTGGIGTIIFAV
ORF4_14CSR    EGFAKIDD-VEFVVGAGSWNQG--EFNYLKDVQKNDATKVVNKKITIPQTGGIGTIIFAV
ORF4_19AH     EGFAKIDD-VEFVVGAGSWNQG--EFNYLKDVQKNDATKVVNKKITIPQTGGIGTIIFAV
ORF4_23FP     EGFAKIDD-VEFVVGAGSWNQG--EFNYLKDVQKNDATKVVNKKITIPQTGGIGTIIFAV
ORF4_23FTW    EGFAKLGD-VKFEVGAGSWNQG--DFNYLKDVQKNDATKVVNKKITIPQTGGIGTIIFAV
ORF4_19FTW    AGYALLTSRQKFEVTATSYSATGQGIEYTAGSGKDDATKVVNKKITIPQTGGIGTIIFAV
ORF4_9VSP     AGYALLTSRQKFEVTATSYSATGQGIEYTAGSGKDDATKVVNKKITIPQTGGIGTIIFAV
ORF4_TIGR     AGYALLTSRQKFEVTATSYSATGQGIEYTAGSGKDDATKVVNKKITIPQTGGIGTIIFAV
              *:*  :  .  :* * * *:.       ::*   .  *:************************

ORF4_6BF      AGAAIMGIAVYAYVKNNKDEDQLA
ORF4_6BSP     AGAAIMGIAVYAYVKNNKDEDQLA
ORF4_670      AGAAIMGIAVYAYVKNNKDEDQLA
ORF4_14CSR    AGAAIMGIAVYAYVKNNKDEDQLA
ORF4_19AH     AGAAIMGIAVYAYVKNNKDEDQLA
ORF4_23FP     AGAVIMGIAVYAYVKNNKDEDQLA
ORF4_23FTW    AGAVIMGIAVYAYVKNNKDEDQLA
ORF4_19FTW    AGAVIMGIAVYAYVKNNKDEDQLA
ORF4_9VSP     AGAVIMGIAVYAYVKNNKDEDQLA
ORF4_TIGR     AGAAIMGIAVYAYVKNNKDEDQLA
              ***.********************
```

Figure 144A

```
ORF5_6BSP     ------------MTMQKMQKMISRIFFVMALCFSLVWGAHAVQAQEDHTLVLQLENYQEV
ORF5_TIGR     ------------MTMQKMQKMISRIFFVMALCFSLVWGAHAVQAQEDHTLVLQLENYQEV
ORF5_6BF      ------------MTMQKMQKMISRIFFVMALCFSLVWGAHAVQAQEDHTLVLQLENYQEV
ORF5_670      ------------MTMQKMQKMISRIFFVMALCFSLVWGAHAVQAQEDHTLVLQLENYQEV
ORF5_19AH     ------------MTMQKMQKMISRIFFVMALCFSLVWGAHAVQAQEDHTLVLQLENYQEV
ORF5_14CSR    ------------MTMQKMQKMISRIFFVMALCFSLVWGAHAVQAQEDHTLVLQLENYQEV
ORF5_19FTW    ------------MTMQKMQKMISRIFFVMALCFSLVWGAHAVQAQEDHTLVLQLENYQEV
ORF5_23FTW    ------------MTMQKMQKMISRIFFVMALCFSLVWGAHAVQAQEDHTLVLQLENYQEV
ORF5_9VSP     MTMQKMQKMQKMQKMQKMQKMISRIFFVMALCFSLVWGAHAVQAQEDHTLVLQLENYQEV
ORF5_23FP     ------------MTMQKMQKMISRIFFVMALCFSLVWGAHAVQAQEDHTLVLQLENYQEV
                         .************************************************

ORF5_6BSP     VSQLPSRDGHRLQVWKLDDSYSYDDRVQIVRDLHSWDENKLSSFKKTSFEMTFLENQIEV
ORF5_TIGR     VSQLPSRDGHRLQVWKLDDSYSYDDRVQIVRDLHSWDENKLSSFKKTSFEMTFLENQIEV
ORF5_6BF      VSQLPSRDGHRLQVWKLDDSYSYDDRVQIVRDLHSWDENKLSSFKKTSFEMTFLENQIEV
ORF5_670      VSQLPSRDGHRLQVWKLDDSYSYDDRVQIVRDLHSWDENKLSSFKKTSFEMTFLENQIEV
ORF5_19AH     VSQLPSRDGHRLQVWKLDDSYSYDDRVQIVRDLHSWDENKLSSFKKTSFEMTFLENQIEV
ORF5_14CSR    VSQLPSRDGHRLQVWKLDDSYSYDDRVQIVRDLHSWDENKLSSFKKTSFEMTFLENQIEV
ORF5_19FTW    VSQLPSRDGHRLQVWKLDDSYSYDNRVQIVRDLHSWDENKLSSFKKTSFEMTFLENQIEV
ORF5_23FTW    VSQLPSRDGHRLQVWKLDDSYSYDNRVQIVRDLHSWDENKLSSFKKTSFEMTFLENQIEV
ORF5_9VSP     VSQLPSRDGHRLQVWKLDDSYSYDNRVQIVRDLHSWDENKLSSFKKTSFEMTFLENQIEV
ORF5_23FP     VSQLPSRDGHRLQVWKLDDSYSYDNRVQIVRDLHSWDENKLSSFKKTSFEMTFLENQIEV
              ************************:***********************************

ORF5_6BSP     SHIPNGLYYVRSIIQTDAVSYPAEFLFEMTDQTVEPLVIVAKKTDTMTTKVKLIKVDQDH
ORF5_TIGR     SHIPNGLYYVRSIIQTDAVSYPAEFLFEMTDQTVEPLVIVAKKTDTMTTKVKLIKVDQDH
ORF5_6BF      SHIPNGLYYVRSIIQTDAVSYPAEFLFEMTDQTVEPLVIVAKKTDTMTTKVKLIKVDQDH
ORF5_670      SHIPNGLYYVRSIIQTDAVSYPAEFLFEMTDQTVEPLVIVAKKTDTMTTKVKLIKVDQDH
ORF5_19AH     SHIPNGLYYVRSIIQTDAVSYPAEFLFEMTDQTVEPLVIVAKKTDTMTTKVKLIKVDQDH
ORF5_14CSR    SHIPNGLYYVRSIIQTDAVSYPAEFLFEMTDQTVEPLVIVAKKTDTMTTKVKLIKVDQDH
ORF5_19FTW    SHIPNGLYYVRSIIQTDAVSYPAEFLFEMTDQTVEPLVIVAKKADTVTTKVKLIKVDQDH
ORF5_23FTW    SHIPNGLYYVRSIIQTDAVSYPAEFLFEMTDQTVEPLVIVAKKADTVTTKVKLIKVDQDH
ORF5_9VSP     SHIPNGLYYVRSIIQTDAVSYPAEFLFEMTDQTVEPLVIVAKKADTVTTKVKLIKVDQDH
ORF5_23FP     SHIPNGLYYVRSIIQTDAVSYPAEFLFEMTDQTVEPLVIVAKKADTVTTKVKLIKVDQDH
              *******************************************:**:*************

ORF5_6BSP     NRLEGVGFKLVSVARDGSEKEVPLIGEYRYSSSGQVGRTLYTDKNGEIFVTNLPLGNYRF
ORF5_TIGR     NRLEGVGFKLVSVARDVSEKEVPLIGEYRYSSSGQVGRTLYTDKNGEIFVTNLPLGNYRF
ORF5_6BF      NRLEGVGFKLVSVARDGSEKEVPLIGEYRYSSSGQVGRTLYTDKNGEIFVTNLPLGNYRF
ORF5_670      NRLEGVGFKLVSVARDGSEKEVPLIGEYRYSSSGQVGRTLYTDKNGEIFVTNLPLGNYRF
ORF5_19AH     NRLEGVGFKLVSVARDGSEKEVPLIGEYRYSSSGQVGRTLYTDKNGEIFVTNLPLGNYRF
ORF5_14CSR    NRLEGVGFKLVSVARDGSEKEVPLIGEYRYSSSGQVGRTLYTDKNGEIFVTNLPLGNYRF
ORF5_19FTW    NRLEGVGFKLVSVARDGSEKEVPLIGEYRYSSSGQVGRTLYTDKNGEIVVTNLPLGTYRF
ORF5_23FTW    NRLEGVGFKLVSVARDGSEKEVPLIGEYRYSSSGQVGRTLYTDKNGEIVVTNLPLGTYRF
ORF5_9VSP     NRLEGVGFKLVSVARDGSEKEVPLIGEYRYSSSGQVGRTLYTDKNGEIVVTNLPLGTYRF
ORF5_23FP     NRLEGVGFKLVSVARDGSEKEVPLIGEYRYSSSGQVGRTLYTDKNGEIVVTNLPLGTYRF
              **************** *******************************.*******.***

ORF5_6BSP     KEVEPLAGYAVTTLDTDVQLVDHQLVTITVVNQKLPRGNVDFMKVDGRTNTSLQGAMFKV
ORF5_TIGR     KEVEPLAGYAVTTLDTDVQLVDHQLVTITVVNQKLPRGNVDFMKVDGRTNTSLQGAMFKV
ORF5_6BF      KEVEPLAGYAVTTLDTDVQLVDHQLVTITVVNQKLPRGNVDFMKVDGRTNTSLQGAMFKV
ORF5_670      KEVEPLAGYAVTTLDTDVQLVDHQLVTITVVNQKLPRGNVDFMKVDGRTNTSLQGAMFKV
ORF5_19AH     KEVEPLAGYAVTTLDTDVQLVDHQLVTITVVNQKLPRGNVDFMKVDGRTNTSLQGAMFKV
ORF5_14CSR    KEVEPLAGYAVTTLDTDVQLVDHQLVTITVVNQKLPRGNVDFMKVDGRTNTSLQGAMFKV
ORF5_19FTW    KEVEPLAGYTVTTMDTDVQLVDHQLVTITVVNQKLPRGNVDFMKVDGRTNTSLQGAMFKV
ORF5_23FTW    KEVEPLAGYTVTTMDTDVQLVDHQLVTITVVNQKLPRGNVDFMKVDGRTNTSLQGAMFKV
ORF5_9VSP     KEVEPLAGYTVTTMDTDVQLVDHQLVTITVVNQKLPRGNVDFMKVDGRTNTSLQGAMFKV
ORF5_23FP     KEVEPLAGYAVTTMDTDVQLVDHQLVTITVVNQKLPRGNVDFMKVDGRTNTSLQGAMFKV
              *********:***:**********************************************
```

Figure 144B

```
ORF5_6BSP      MKEESGHYTPVLQNGKEVVVTSGKDGRFRVEGLEYGTYYLWELQAPTGYVQLTSPVSFTI
ORF5_TIGR      MKEESGHYTPVLQNGKEVVVTSGKDGRFRVEGLEYGTYYLWELQAPTGYVQLTSPVSFTI
ORF5_6BF       MKEESGHYTPVLQNGKEVVVTSGKDGRFRVEGLEYGTYYLWELQAPTGYVQLTSPVSFTI
ORF5_670       MKEESGHYTPVLQNGKEVVVTSGKDGRFRVEGLEYGTYYLWELQAPTGYVQLTSPVSFTI
ORF5_19AH      MKEESGHYTPVLQNGKEVVVTSGKDGRFRVEGLEYGTYYLWELQAPTGYVQLTSPVSFTI
ORF5_14CSR     MKEESGHYTPVLQNGKEVVVTSGKDGRFRVEGLEYGTYYLWELQAPTGYVQLTSPVSFTI
ORF5_19FTW     MKEENGHYTPVLQNGKEVVVASGKDGRFRVEGLEYGTYYLWELQAPTGYVQLTSPVSFTI
ORF5_23FTW     MKEENGHYTPVLQNGKEVVVASGKDGRFRVEGLEYGTYYLWELQAPTGYVQLTSPVSFTI
ORF5_9VSP      MKEENGHYTPVLQNGKEVVVASGKDGRFRVEGLEYGTYYLWELQAPTGYVQLTSPVSFTI
ORF5_23FP      MKEENGHYTPVLQNGKEVVVASGKDGRFRVEGLEYGTYYLWELQAPTGYVQLTSPVSFTI
               ****.***************:***************************************

ORF5_6BSP      GKDTRKELVTVVKNNKRPRIDVPDTGEETLYILMLVAILLFGSGYYLTKKPNN
ORF5_TIGR      GKDTRKELVTVVKNNKRPRIDVPDTGEETLYILMLVAILLFGSGYYLTKKPNN
ORF5_6BF       GKDTRKELVTVVKNNKRPRIDVPDTGEETLYILMLVAILLFGSGYYLTKKPNN
ORF5_670       GKDTRKELVTVVKNNKRPRIDVPDTGEETLYILMLVAILLFGSGYYLTKKPNN
ORF5_19AH      GKDTRKELVTVVKNNKRPRIDVPDTGEETLYILMLVAILLFGSGYYLTKKPNN
ORF5_14CSR     GKDTRKELVTVVKNNKRPRIDVPDTGEETLYILMLVAILLFGSGYYLTKKPNN
ORF5_19FTW     GKDTRKELVTVVKNNKRPRIDVPDTGEETLYILMLVAILLFGSGYYLTKKTNN
ORF5_23FTW     GKDTRKELVTVVKNNKRPRIDVPDTGEETLYILMLVAILLFGSGYYLTKKTNN
ORF5_9VSP      GKDTRKELVTVVKNNKRPRIDVPDTGEETLYILMLVAILLFGSGYYLTKKTNN
ORF5_23FP      GKDTRKELVTVVKNNKRPRIDVPDTGEETLYILMLVAILLFGSGYYLTKKTNN
               **************************************************.**
```

Figure 145A

```
ORF6_23FTW      MLIKMVKTKKQKRNNLLLGVVFFIGMAVMAYPLVSRLYYRVESNQQIADFDKEKATLDEA
ORF6_TIGR       MLIKMVKTKKQKRNNLLLGVVFFIGMAVMAYPLVSRLYYRVESNQQIADFDKEKATLDEA
ORF6_6BSP       MLIKMVKTKKQKRNNLLLGVVFFIGMAVMAYPLVSRLYYRVESNQQIADFDKEKATLDEA
ORF6_6BF        MLIKMVKTKKQKRNNLLLGVVFFIGMAVMAYPLVSRLYYRVESNQQIADFDKEKATLDEA
ORF6_670        MLIKMVKTKKQKRNNLLLGVVFFIGMAVMAYPLVSRLYYRVESNQQIADFDKEKATLDEA
ORF6_19AH       MLIKMVKTKKQKRNNLLLGVVFFIGMAVMAYPLVSRLYYRVESNQQIADFDKEKATLDEA
ORF6_14CSR      MLIKMVKTKKQKRNNLLLGVVFFIGMAVMAYPLVSRLYYRVESNQQIADFDKEKATLDEA
ORF6_23FP       MLIKMAKTKKQKRNNLLLGVVFFIGIAVMAYPLVSRLYYRVESNQQIADFDKEKATLDEA
ORF6_9VSP       MLIKMAKTKKQKRNNLLLGVVFFIGIAVMAYPLVSRLYYRVESNQQIADFDKEKATLDEA
ORF6_19FTW      MLIKMAKTKKQKRNNLLLGVVFFIGMAVMAYPLVSRLYYRVESNQQIADFDKEKATLDEA
                *****.*******************:**********************************

ORF6_23FTW      DIDERMKLAQAFNDSLNNVVSGDPWSEEMKKKGRAEYARMLEIHERMGHVEIPVIDVDLP
ORF6_TIGR       DIDERMKLAQAFNDSLNNVVSGDPWSEEMKKKGRAEYARMLEIHERMGHVEIPVIDVDLP
ORF6_6BSP       DIDERMKLAQAFNDSLNNVVSGDPWSEEMKKKGRAEYARMLEIHERMGHVEIPVIDVDLP
ORF6_6BF        DIDERMKLAQAFNDSLNNVVSGDPWSEEMKKKGRAEYARMLEIHERMGHVEIPVIDVDLP
ORF6_670        DIDERMKLAQAFNDSLNNVVSGDPWSEEMKKKGRAEYARMLEIHERMGHVEIPVIDVDLP
ORF6_19AH       DIDERMKLAQAFNDSLNNVVSGDPWSEEMKKKGRAEYARMLEIHERMGHVEIPVIDVDLP
ORF6_14CSR      DIDERMKLAQAFNDSLNNVVSGDPWSEEMKKKGRAEYARMLEIHERMGHVEIPVIDVDLP
ORF6_23FP       DIDERMKLAQAFNDSLNNVVSGDPWSEEMKKKGRAEYARMLEIHERMGHVEIPAIDVDLP
ORF6_9VSP       DIDERMKLAQAFNDSLNNVVSGDPWSEEMKKKGRAEYARMLEIHERMGHVEIPAIDVDLP
ORF6_19FTW      DIDERMKLAQAFNDSLNNVVSGDPWSEEMKKKGRAEYARMLEIHERMGHVEIPAIDVDLP
                *****************************************************.******

ORF6_23FTW      VYAGTAEEVLQQGAGQLEGTSLPIGGNSTHAVITAHTGLPTAKMFTDLTKLKVGDKFYVH
ORF6_TIGR       VYAGTAEEVLQQGAGHLEGTSLPIGGNSTHAVITAHTGLPTAKMFTDLTKLKVGDKFYVH
ORF6_6BSP       VYAGTAEEVLQQGAGHLEGTSLPIGGNSTHAVITAHTGLPTAKMFTDLTKLKVGDKFYVH
ORF6_6BF        VYAGTAEEVLQQGAGHLEGTSLPIGGNSTHAVITAHTGLPTAKMFTDLTKLKVGDKFYVH
ORF6_670        VYAGTAEEVLQQGAGHLEGTSLPIGGNSTHAVITAHTGLPTAKMFTDLTKLKVGDKFYVH
ORF6_19AH       VYAGTAEEVLQQGAGHLEGTSLPIGGNSTHAVITAHTGLPTAKMFTDLTKLKVGDKFYVH
ORF6_14CSR      VYAGTAEEVLQQGAGHLEGTSLPIGGNSTHAVITAHTGLPTAKMFTDLTKLKVGDKFYVH
ORF6_23FP       VYAGTAEEVLQQGAGHLEGTSLPIGGNSTHAVITAHTGLPTAKMFTDLTKLKVGDKFYVH
ORF6_9VSP       VYAGTAEEVLQQGAGHLEGTSLPIGGNSTHAVITAHTGLPTAKMFTDLTKLKVGDKFYVH
ORF6_19FTW      VYAGTAEEVLQQGAGHLEGTSLPIGGNSTHAVITAHTGLPTAKMFTDLTKLKVGDKFYVH
                ***************:********************************************

ORF6_23FTW      NIKEVMAYQVDQVKVIEPTNFDDLLIVPGHDYVTLLTCTPYMINTHRLLVRGHRIPYVAE
ORF6_TIGR       NIKEVMAYQVDQVKVIEPTNFDDLLIVPGHDYVTLLTCTPYMINTHRLLVRGHRIPYVAE
ORF6_6BSP       NIKEVMAYQVDQVKVIEPTNFDDLLIVPGHDYVTLLTCTPYMINTHRLLVRGHRIPYVAE
ORF6_6BF        NIKEVMAYQVDQVKVIEPTNFDDLLIVPGHDYVTLLTCTPYMINTHRLLVRGHRIPYVAE
ORF6_670        NIKEVMAYQVDQVKVIEPTNFDDLLIVPGHDYVTLLTCTPYMINTHRLLVRGHRIPYVAE
ORF6_19AH       NIKEVMAYQVDQVKVIEPTNFDDLLIVPGHDYVTLLTCTPYMINTHRLLVRGHRIPYVAE
ORF6_14CSR      NIKEVMAYQVDQVKVIEPTNFDDLLIVPGHDYVTLLTCTPYMINTHRLLVRGHRIPYVAE
ORF6_23FP       NIKEVMAYQVDQVKVIEPTNFDDLLIVPGHDYVTLLTCTPYMINTHRLLVRGHRIPYVAE
ORF6_9VSP       NIKEVMAYQVDQVKVIEPTNFDDLLIVPGHDYVTLLTCTPYMINTHRLLVRGHRIPYVAE
ORF6_19FTW      NIKEVMAYQVDQVKVIEPTNFDDLLIVPGHDYVTLLTCTPYMINTHRLLVRGHRIPYVAE
                ************************************************************

ORF6_23FTW      VEEEFIAANKLSHLYRYLFYVAVGLIVILLWIIRRLRKKKKQPEKALKALKAARKEVKVE
ORF6_TIGR       VEEEFIAANKLSHLYRYLFYVAVGLIVILLWIIRRLRKKKKQPEKALKALKAARKEVKVE
ORF6_6BSP       VEEEFIAANKLSHLYRYLFYVAVGLIVILLWIIRRLRKKKKQPEKALKALKAARKEVKVE
ORF6_6BF        VEEEFIAANKLSHLYRYLFYVAVGLIVILLWIIRRLRKKKKQPEKALKALKAARKEVKVE
ORF6_670        VEEEFIAANKLSHLYRYLFYVAVGLIVILLWIIRRLRKKKKQPEKALKALKAARKEVKVE
ORF6_19AH       VEEEFIAANKLSHLYRYLFYVAVGLIVILLWIIRRLRKKKKQPEKALKALKAARKEVKVE
ORF6_14CSR      VEEEFIAANKLSHLYRYLFYVAVGLIVILLWIIRRLRKKKKQPEKALKALKAARKEVKVE
ORF6_23FP       VEEEFIAANKLSHLYRYLFYVAVGLIVILLWIIRRLRKKKRQSERALKALKEATKEVKVE
ORF6_9VSP       VEEEFIAANKLSHLYRYLFYVAVGLIVILLWIIRRLRKKKRQSERALKALKEATKEVKVE
ORF6_19FTW      VEEEFIAANKLSHLYRYLFYVAVGLIVILLWIIRRLRKKKRQSERALKALKEATKEVKVE
                ****************************************:*.*:****** * ******
```

Figure 145B

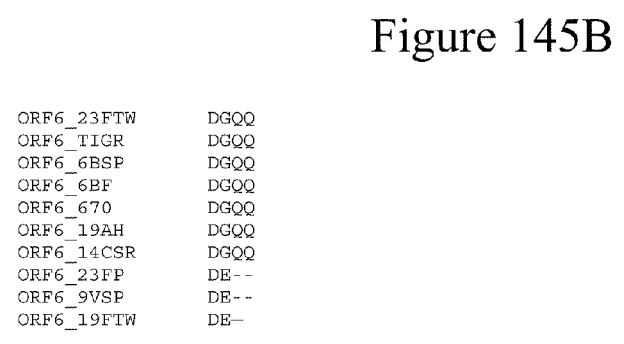

| | |
|---|---|
| ORF6_23FTW | DGQQ |
| ORF6_TIGR | DGQQ |
| ORF6_6BSP | DGQQ |
| ORF6_6BF | DGQQ |
| ORF6_670 | DGQQ |
| ORF6_19AH | DGQQ |
| ORF6_14CSR | DGQQ |
| ORF6_23FP | DE-- |
| ORF6_9VSP | DE-- |
| ORF6_19FTW | DE– |

Figure 146

```
ORF7_14CSR      MDNSRRSRKKGTKKKKHPLILLLIFLVGFAVAIYPLVSRYYYRIESNEVIKEFDETVSQM
ORF7_19AH       MDNSRRSRKKGTKKKKHPLILLLIFLVGFAVAIYPLVSRYYYRIESNEVIKEFDETVSQM
ORF7_6BF        MDNSRRSRKKGTKKKKHPLILLLIFLVGFAVAIYPLVSRYYYRIESNEVIKEFDETVSQM
ORF7_6BSP       MDNSRRSRKKGTKKKKHPLILLLIFLVGFAVAIYPLVSRYYYRIESNEVIKEFDETVSQM
ORF7_670        MDNSRRSRKKGTKKKKHPLILLLIFLVGFAVAIYPLVSRYYYRIESNEVIKEFDETVSQM
ORF7_23FTW      MDNSRRSRKKGTKKKKHPLILLLIFLVGFAVAIYPLVSRYYYRIESNEVIKEFDETVSQM
ORF7_23FP       MSKSRYSRKKSVKKKKNPFILLLIFLVGLAVAMYPLVSRYYYRIESNEVIKEFDETVSQM
ORF7_9VSP       MSKSRYSRKKSVKKKKNPFILLLIFLVGLAVAMYPLVSRYYYRIESNEVIKEFDETVSQM
ORF7_19FTW      MSKSRYSRKKSVKKKKNPFILLLIFLVGLAVAMYPLVSRYYYRIESNEVIKEFDETVSQM
ORF7_TIGR       MDNSRRSRKKGTKKKKHPLILLLIFLVGFAVAIYPLVSRYYYRIESNEVIKEFDETVSQM
                *.:** ****..****:*:*********:***:***************************

ORF7_14CSR      DKAELEERWRLAQAFNATLKPSEILDPFTEQEKKKGVSEYANMLKVHERIGYVEIPAIDQ
ORF7_19AH       DKAELEERWRLAQAFNATLKPSEILDPFTEQEKKKGVSEYANMLKVHERIGYVEIPAIDQ
ORF7_6BF        DKAELEERWRLAQAFNATLKPSEILDPFTEQEKKKGVSEYANMLKVHERIGYVEIPAIDQ
ORF7_6BSP       DKAELEERWRLAQAFNATLKPSEILDPFTEQEKKKGVSEYANMLKVHERIGYVEIPAIDQ
ORF7_670        DKAELEERWRLAQAFNATLKPSEILDPFTEQEKKKGVSEYANMLKVHERIGYVEIPAIDQ
ORF7_23FTW      DKAELEERWRLAQAFNATLKPSEILDPFTEQEKKKGVSEYANMLKVHERIGYVEIPAIDQ
ORF7_23FP       DKAELEERWRLAQAFNATLKPSEILDPFTEQEKKKGVSEYANMLKVHERIGYVEIPAIDQ
ORF7_9VSP       DKAELEERWRLAQAFNATLKPSEILDPFTEQEKKKGVSEYANMLKVHERIGYVEIPAIDQ
ORF7_19FTW      DKAELEERWRLAQAFNATLKPSEILDPFTDQEKKQGVSEYANMLKVHERIGYVEIPAIEQ
ORF7_TIGR       DKAELEERWRLAQAFNATLKPSEILDPFTEQEKKKGVSEYANMLKVHERIGYVEIPAIDQ
                *****************************:****:***********************:*

ORF7_14CSR      EIPMYVGTSEEILQKGAGLLEGASLPVGGENTHTVVTAHRGLPTAELFSQLDKMKKGDVF
ORF7_19AH       EIPMYVGTSEEILQKGAGLLEGASLPVGGENTHTVVTAHRGLPTAELFSQLDKMKKGDVF
ORF7_6BF        EIPMYVGTSEEILQKGAGLLEGASLPVGGENTHTVVTAHRGLPTAELFSQLDKMKKGDVF
ORF7_6BSP       EIPMYVGTSEEILQKGAGLLEGASLPVGGENTHTVVTAHRGLPTAELFSQLDKMKKGDVF
ORF7_670        EIPMYVGTSEEILQKGAGLLEGASLPVGGENTHTVVTAHRGLPTAELFSQLDKMKKGDVF
ORF7_23FTW      EIPMYVGTSEEILQKGAGLLEGASLPVGGENTHTVVTAHRGLPTAELFSQLDKMKKGDVF
ORF7_23FP       EIPMYVGTSEEILQKGAGLLEGASLPVGGENTHTVVTAHRGLPTAELFSQLDKMKKGDIF
ORF7_9VSP       EIPMYVGTSEEILQKGAGLLEGASLPVGGENTHTVVTAHRGLPTAELFSQLDKMKKGDIF
ORF7_19FTW      EIPMYVGTSEDILQKGAGLLEGASLPVGGENTHTVITAHRGLPTAELFSQLDKMKKGDIF
ORF7_TIGR       EIPMYVGTSEDILQKGAGLLEGASLPVGGENTHTVITAHRGLPTAELFSQLDKMKKGDIF
                **********:************************:**********************:*

ORF7_14CSR      YLHVLDQVLAYQVDQILTVEPNDFEPVLIQHGEDYATLLTCTPYMINSHRLLVRGKRIPY
ORF7_19AH       YLHVLDQVLAYQVDQILTVEPNDFEPVLIQHGEDYATLLTCTPYMINSHRLLVRGKRIPY
ORF7_6BF        YLHVLDQVLAYQVDQILTVEPNDFEPVLIQHGEDYATLLTCTPYMINSHRLLVRGKRIPY
ORF7_6BSP       YLHVLDQVLAYQVDQILTVEPNDFEPVLIQHGEDYATLLTCTPYMINSHRLLVRGKRIPY
ORF7_670        YLHVLDQVLAYQVDQILTVEPNDFEPVLIQHGEDYATLLTCTPYMINSHRLLVRGKRIPY
ORF7_23FTW      YLHVLDQVLAYQVDQILTVEPNDFEPVLIQHGKDYATLLTCTPYMINSHRLLVRGKRIPY
ORF7_23FP       YLHVLDQVLAYQVDQIVTVEPNDFEPVLIQHGEDYATLLTCTPYMINSHRLLVRGKRIPY
ORF7_9VSP       YLHVLDQVLAYQVDQIVTVEPNDFEPVLIQHGEDYATLLTCTPYMINSHRLLVRGKRIPY
ORF7_19FTW      YLHVLDQVLAYQVDQIVTVEPNDFEPVLIQHGQDYATLLTCTPYMINSHRLLVRGKRIPY
ORF7_TIGR       YLHVLDQVLAYQVDQIVTVEPNDFEPVLIQHGEDYATLLTCTPYMINSHRLLVRGKRIPY
                ***************:****************:***************************

ORF7_14CSR      TAPIAERNRAVRERGQFWLWLLLAALVMILVLSYGVYRHRRIVKGLEKQLEEHHVKG
ORF7_19AH       TAPIAERNRAVRERGQFWLWLLLAALVMILVLSYGVYRHRRIVKGLEKQLEEHHVKG
ORF7_6BF        TAPIAERNRAVRERGQFWLWLLLAALVMILVLSYGVYRHRRIVKGLEKQLEEHHVKG
ORF7_6BSP       TAPIAERNRAVRERGQFWLWLLLAALVMILVLSYGVYRHRRIVKGLEKQLEEHHVKG
ORF7_670        TAPIAERNRAVRERGQFWLWLLLAALVMILVLSYGVYRHRRIVKGLEKQLEEHHVKG
ORF7_23FTW      TAPIAERNRAVRERGQFWLWLLLAALVMILVLSYGVYRHRRIVKGLEKQLEEHHVKG
ORF7_23FP       TAPIAERNRAVRERGQFWLWLLLGAMAVILLLLYRVYRNRRIVKGLEKQLEGRHVKD
ORF7_9VSP       TAPIAERNRAVRERGQFWLWLLLGAMAVILLLLYRVYRNRRIVKGLEKQLEGRHVKD
ORF7_19FTW      TAPIAERNRAVRERGQFWLWLLLGAMAVILLLLYRVYRNRRIVKGLEKQLEGRHVKD
ORF7_TIGR       TAPIAERNRAVRERGQFWLWLLLGAMAVILLLLYRVYRNRRIVKGLEKQLEGRHVKD
                ***********************.*:.:**:* * ***:************ :***.
```

Figure 147

```
ORF8_14CSR      MSKAKLQKLLGYLLMLVALVIPVYCFGQMVLQSLGQVKGHEIFSESVTADSYQEQLQRSL
ORF8_19AH       MSKAKLQKLLGYLLMLVALVIPVYCFGQMVLQSLGQVKGHEIFSESVTADSYQEQLQRSL
ORF8_23FTW      MSKAKLQKLLGYLLMLVALVIPVYCFGQMVLQSLGQVKGHEIFSESVTADSYQEQLQRSL
ORF8_670        MSKAKLQKLLGYLLMLVALVIPVYCFGQMVLQSLGQVKGHEIFSESVTADSYQEQLQRSL
ORF8_6BF        MSKAKLQKLLGYLLMLVALVIPVYCFGQMVLQSLGQVKGHEIFSESVTADSYQEQLQRSL
ORF8_6BSP       MSKAKLQKLLGYLLMLVALVIPVYCFGQMVLQSLGQVKGHEIFSESVTADSYQEQLQRSL
ORF8_19FTW      MSRTKLRALLGYLLMLVACLIPIYCFGQMVLQSLGQVKGHATFVKSMTTEMYQEQQNHSL
ORF8_23FP       MSRTKLRALLGYLLMLVACLIPIYCFGQMVLQSLGQVKGHATFVKSMTTEMYQEQQNHSL
ORF8_9VSP       MSRTKLRALLGYLLMLVACLIPIYCFGQMVLQSLGQVKGHATFVKSMTTEMYQEQQNHSL
ORF8_TIGR       MSRTKLRALLGYLLMLVACLIPIYCFGQMVLQSLGQVKGHATFVKSMTTEMYQEQQNHSL
                **::**: ********** :**:*****************  * :*:*:: **** ::**

ORF8_14CSR      DYNQRLDSQNRIVDPFLAEGYEVNYQVSDDPDAVYGYLSIPSLEIMEPVYLGADYHHLAM
ORF8_19AH       DYNQRLDSQNRIVDPFLAEGYEVNYQVSDDPDAVYGYLSIPSLEIMEPVYLGADYHHLAM
ORF8_23FTW      DYNQRLDSQNRIVDPFLAEGYEVNYQVSDDPDAVYGYLSIPSLEIMEPVYLGADYHHLAM
ORF8_670        DYNQRLDSQNRIVDPFLAEGYEVNYQVSDDPDAVYGYLSIPSLEIMEPVYLGADYHHLAM
ORF8_6BF        DYNQRLDSQNRIVDPFLAEGYEVNYQVSDDPDAVYGYLSIPSLEIMEPVYLGADYHHLAM
ORF8_6BSP       DYNQRLDSQNRIVDPFLAEGYEVNYQVSDDPDAVYGYLSIPSLEIMEPVYLGADYHHLAM
ORF8_19FTW      AYNQRLASQNRIVDPFLAEGYEVNYQVSDDPDAVYGYLSIPSLEIMEPVYLGADYHHLGM
ORF8_23FP       AYNQRLASQNRIVDPFLAEGYEVNYQVSDDPDAVYGYLSIPSLEIMEPVYLGADYHHLGM
ORF8_9VSP       AYNQRLASQNRIVDPFLAEGYEVNYQVSDDPDAVYGYLSIPSLEIMEPVYLGADYHHLGM
ORF8_TIGR       AYNQRLASQNRIVDPFLAEGYEVNYQVSDDPDAVYGYLSIPSLEIMEPVYLGADYHHLGM
                 ***** ***************************************************.*

ORF8_14CSR      GLAHVDGTPLPVEGKGIRSVIAGHRAEPSHVFFRHLDQLKVGDALYYDNGQEIVEYQMMD
ORF8_19AH       GLAHVDGTPLPVEGKGIRSVIAGHRAEPSHVFFRHLDQLKVGDALYYDNGQEIVEYQMMD
ORF8_23FTW      GLAHVDGTPLPVEGKGIRSVIAGHRAEPSHVFFRHLDQLKVGDALYYDNGQEIVEYQMMD
ORF8_670        GLAHVDGTPLPVEGKGIRSVIAGHRAEPSHVFFRHLDQLKVGDALYYDNGQEIVEYQMMD
ORF8_6BF        GLAHVDGTPLPVEGKGIRSVIAGHRAEPSHVFFRHLDQLKVGDALYYDNGQEIVEYQMMD
ORF8_6BSP       GLAHVDGTPLPVEGKGIRSVIAGHRAEPSHVFFRHLDQLKVGDALYYDNGQEIVEYQMMD
ORF8_19FTW      GLAHVDGTPLPLDGTGIRSVIAGHRAEPSHVFFRHLDQLKVGDALYYDNGQEIVEYQMMD
ORF8_23FP       GLAHVDGTPLPLDGTGIRSVIAGHRAEPSHVFFRHLDQLKVGDALYYDNGQEIVEYQMMD
ORF8_9VSP       GLAHVDGTPLPLDGTGIRSVIAGHRAEPSHVFFRHLDQLKVGDALYYDNGQEIVEYQMMD
ORF8_TIGR       GLAHVDGTPLPLDGTGIRSVIAGHRAEPSHVFFRHLDQLKVGDALYYDNGQEIVEYQMMD
                ***********::*.*********************************************

ORF8_14CSR      TEIILPSEWEKLESVSSKNIMTLITCDPIPTFNKRLLVNFERVAVYQKSDPQTAAVARVA
ORF8_19AH       TEIILPSEWEKLESVSSKNIMTLITCDPIPTFNKRLLVNFERVAVYQKSDPQTAAVARVA
ORF8_23FTW      TEIILPSEWEKLESVSSKNIMTLITCDPIPTFNKRLLVNFERVAVYQKSDPQTAAVARVA
ORF8_670        TEIILPSEWEKLESVSSKNIMTLITCDPIPTFNKRLLVNFERVAVYQKSDPQTAAVARVA
ORF8_6BF        TEIILPSEWEKLESVSSKNIMTLITCDPIPTFNKRLLVNFERVAVYQKSDPQTAAVARVA
ORF8_6BSP       TEIILPSEWEKLESVSSKNIMTLITCDPIPTFNKRLLVNFERVAVYQKSDPQTAAVARVA
ORF8_19FTW      TEIILPSEWEKLESVSSKNIMTLITCDPIPTFNKRLLVNFERVAVYQKSDPQTAAVARVA
ORF8_23FP       TEIILPSEWEKLESVSSKNIMTLITCDPIPTFNKRLLVNFERVAVYQKSDPQTAAVARVA
ORF8_9VSP       TEIILPSEWEKLESVSSKNIMTLITCDPIPTFNKRLLVNFERVAVYQKSDPQTAAVARVA
ORF8_TIGR       TEIILPSEWEKLESVSSKNIMTLITCDPIPTFNKRLLVNFERVAVYQKSDPQTAAVARVA
                ************************************************************

ORF8_14CSR      FTKEGQSVSRVATSQWLYRGLVVLAFLGILFVLWKLARLLRGK
ORF8_19AH       FTKEGQSVSRVATSQWLYRGLVVLAFMGILFVLWKLARLLRGK
ORF8_23FTW      FTKEGQSVSRVATSQWLYRGLVVLAFLGILFVLWKLARLLRGK
ORF8_670        FTKEGQSVSRVATSQWLYRGLVVLAFLGILFVLWKLARLLRGK
ORF8_6BF        FTKEGQSVSRVATSQWLYRGLVVLAFLGILFVLWKLARLLRGK
ORF8_6BSP       FTKEGQSVSRVATSQWLYRGLVVLAFLGILFVLWKLARLLRGK
ORF8_19FTW      FTKEGQSVSRVATSQWLYRGLVVLAFLGILFVLWKLARLLRGK
ORF8_23FP       FTKEGQSVSRVATSQWLYRGLVVLAFLGILFVLWKLARLLRGK
ORF8_9VSP       FTKEGQSVSRVATSQWLYRGLVVLAFLGILFVLWKLARLLRGK
ORF8_TIGR       FTKEGQSVSRVATSQWLYRGLVVLAFLGILFVLWKLARLLRGK
                ***************************:***************
```

A

_MLNRETHMKKVRKIFQKAVAGLCCISQLTAFSSIVALA_*ETPETSPAIGKVVIKETGEGGALLGDAVFELKN
NTDGTTVSQRTEAQTGEAIFSNIKPGTYTLTEAQPPVGYKPSTKQWTVEVEKNGRTTVQGEQVENREE
ALSDQYPQTGTYPDVQTPYQIIKVDGSEKNGQHKALNPNPYERVIPEGTLSKRIYQVNNLDDNQYGIEL
TVSGKTVYEQKDKSVPLDVVILLDNSNSMSNIRNKNARRAERAGEATRSLIDKITSDSENRVALVTYAS
TIFDGTEFTVEKGVADKNGKRLNDSLFWNYDQTSFTTNTKDYSYLKLTNDKNDIVELKNKVPTEAEDHD
GNRLMYQFGATFTQKALMKADEILTQQARQNSQKVIFHITDGVPTMSYPINFNHATFAPSYQNQLNA
FFSKSPNKDGILLSDFITQATSGEHTIVRGDGQSYQMFTDKTVYEKGAPAAFPVKPEKYSEMKAAGYAVI
GDPINGGYIWLNWRESILAYPFNSNTAKITNHGDPTRWYYNGNIAPDGYDVFTVGIGINGDPGTDEATA
TSFMQSISSKPENYTNVTDTTKILEQLNRYFHTIVTEKKSIENGTITDPMGELIDLQLGTDGRFDPADYTL
TANDGSRLENGQAVGGPQNDGGLLKNAKVLYDTTEKRIRVTGLYLGTDEKVTLTYNVRLNDEFVSNKFYD
TNGRTTLHPKEVEQNTVRDFPIPKIRDVRKYPEITISKEKKLGDIEFIKVNKNDKKPLRGAVFSLQKQHPDYP
DIYGAIDQNGTYQNVRTGEDGKLTFKNLSDGKYRLFENSEPAGYKPVQNKPIVAFQIVNGEVRDVTSIVPQ
DIPAGYEFTNDKHYITNEPIPPKRE_YPRTGGIGMLPFYLIGCMMMGGVLLYTRKHP_

B

5’ cg_ggatcc_-gaa-acg-cct-gaa-acc-agt 5’ 24mer, 54 %G+C, Tm 62
_BamHI_
3’ ccg_ctcgag-aat-agg-ttc-att-ggt_ 3’ 27mer, 52 %G+C, Tm 61.6
_XhoI_

Figure 150

Figure 152
A
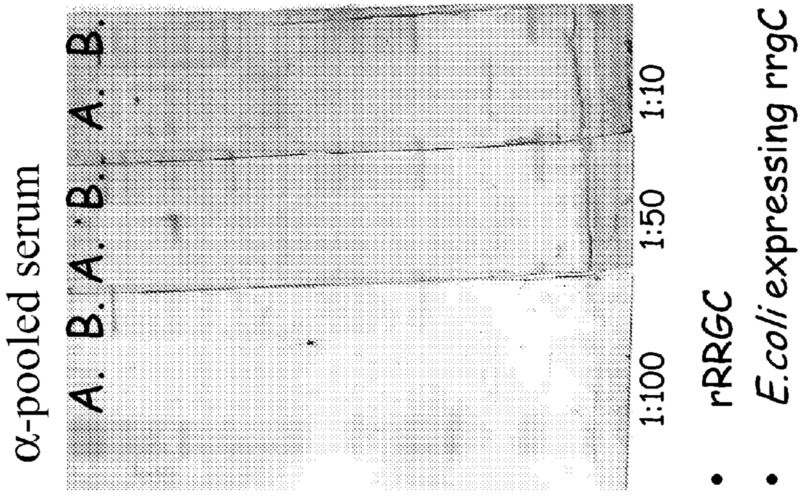
B
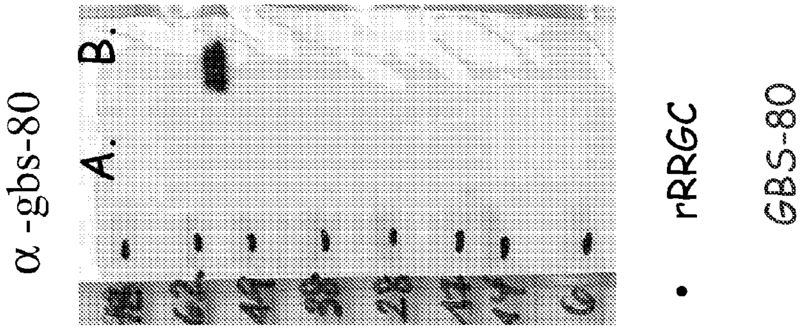

A

*MKSINKFLTMLAALLLTASSLFS**AATVFAAGTTTTSVTVHKLLATDGDMDKIANELETGNYAGNKVGVLPA
NAKEIAGVMFVWTNTNNEIIDENGQTLGVNIDPQTFKLSGAMPATAMKKLTEAEGAKFNTANLPAAKYKIY
EIHSLSTYVGEDGATLTGSKAVPIEIELPLNDVVDAHVYPKNTEAKPKIDKDFKGKANPDTPRVDKDTPVNHQV
GDVVEYEIVTKIPALANYATANWSDRMTEGLAFNKGTVKVTVDDVALEAGDYALTEVATGFDLKLTDAGLAK
VNDQNAEKTVKITYSATLNDKAIVEVPESNDVTFNYGNNPDHGNTPKPNKPNENGDLTLTKTWVDATGAPIP
AGAEATFDLVNAQTGKVVQTVTLTTDKNTVTVNGLDKNTEYKFVERSIKGYSADYQEITTAGEIAVKNWKD
ENPKPLDPTEPKVVTYGKKFVKVNDKDNRLAGAEFVIANADNAGQYLARKADKVSQEEKQLVVTTKDALDRAV
AAYNALTAQQQTQQEKEKVDKAQAAYNAAVIAANNAFEWVADKDNENVVKLVSDAQGRFEITGLLAGTY
YLEETKQPAGYALLTSRQKFEVTATSYSATGQGIEYTAGSGKDDATKVVNKKIT*IPQTGGIGTIIFAVAGAAI*
*MGIAVYAYVKNNKDEDQLA*

B

5' cg***ggatcc*-gct-gca-aca-gtt-ttt** 3' 23mer, 52.2% G+C, Tm 60.6
*BamHI*
5'*ccg***ctcgag*-agt-gat-ttt-ttt-gtt-gac** 3' 26mer, 44.4% G+C, Tm 61.7
*XhoI*

*MISRIFFVMALCFSLVWGA**HAVQAQEDHTLVLQLENYQEVVSQLPSRDGHRLQVWKLDDSYS
YDDRVQIVRDLHSWDENKLSSFKKTSFEMTFLENQIEVSHIPNGLYYVRSIIQTDAVSYPAEFLF
EMTDQTVEPLVIVAKKTDTMTTKVKLIKVDQDHNRLEGVGFKLVSVARDVSEKEVPLIGEYRYSSS
GQVGRTLYTDKNGEIFVTNLPLGNYRFKEVEPLAGYAVTTLDTDVQLVDHQLVTITVVNQKLPRGN
VDFMKVDGRTNTSLQGAMFKVMKEESGHYTPVLQNGKEVVVTSGKDGRFRVEGLEYGTYYLWELQ
APTGYVQLTSPVSFTIGKDTRKELVTVVKNNK*RPRIDVPDTGEETLYILMLVAILLFGSGYYLTKKP*
*NN*

B

5' cg***ggatcc*-cat-gca-gtc-caa-gcg-caa-gaa** 21mer, 61% G+C, Tm 60.8
*BamHI*
5' ccg***ctcgag*-ctt-gtt-att-ttt-aac-cac** 27mer, 44% G+C, Tm 58.4
*XhoI*

| | | PCR | | | | | | Sequence |
|---|---|---|---|---|---|---|---|---|
| Strain | M-type | SrtB | SrtC1 | SrtC2 | MsmRL | SipA2 | AI | |
| 2724 | 6 | + | - | - | - | - | 1 | |
| 2894 | 6 | + | - | - | - | - | 1 | |
| 3650 | 6 | + | - | - | - | - | 1 | |
| 5529 | 6 | + | - | - | - | - | 1 | |
| Dsm2071 | 23 | + | - | - | - | - | 1 | + |
| SF370 | 1 | + | + | - | - | - | 2 | literature |
| 2580 | 1 | + | + | - | - | - | 2 | |
| 2913 | 1 | + | + | - | - | - | 2 | |
| 3280 | 1 | + | + | - | - | - | 2 | |
| 3348 | 1 | + | + | - | - | - | 2 | |
| 2719 | ? | + | + | - | - | - | 2 | |
| 2721 | 3 | - | - | + | + | + | 3 | |
| 3040 | 3 | - | - | + | + | + | 3 | |
| 3135 | 3 | - | - | + | + | + | 3 | |
| 3776 | 44 ? | - | - | + | + | + | 3 | + |
| 4959 | 77 | - | - | + | + | + | 3 | + |
| 4088 | Clinical isolate | - | - | + | + | + | 3 | |
| 2728 | 12 | + | - | + | + | + | 4 | |
| 2720 | 9 | + | - | + | + | + | 4 | + |
| 2727 | 11 | + | - | + | + | + | 4 | + |
| 4436 | 28 | + | - | + | + | + | 4 | + |
| 5481 | 44 ? | + | - | + | + | + | 4 | + |
| 4538 | 50 | + | - | + | + | + | 4 | + |
| 3789 | 78 | + | - | + | + | + | 4 | + |
| 4883 | 5 | + | - | + | + | + | 4 | |
| 5476 | 89 | + | - | + | + | + | 4 | |
| 5495 | ? | + | - | + | + | + | 4 | |
| 2722 | 4 | - | - | - | - | - | ? | |
| 2723 | 5? | - | - | - | - | - | ? | |
| 2725 | 8 | - | - | + | - | - | ? | |
| 2726 | 2 | - | - | - | - | - | ? | |
| 2634 | 4 | - | - | - | - | - | ? | |
| 5531 | 75 | + | + | - | - | - | ? | In progress |

Gel filtration on Sepharyl HR 400

Immuno-gold labeling with antibodies against: A. B. C. D. E. M6_Spy0160; F. M6_Spy0159

Pili form high molecular weight
polymers in gradient SDS-PAGE gels

α-RrgB

Figure 190
*S. pneumoniae* pili proteins: sp0462 (Rrg.A)
Expression and purification:
- pET 21b+-*rrg.A-6*
- purified in soluble form (stored at –80°C; in $NaCl_{physiol.}$)
Results:
- protein conc.: 1,1 mg/ml
A
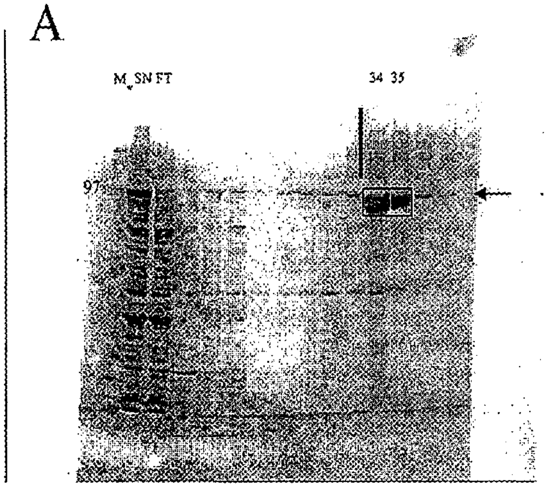
SDS-page
B
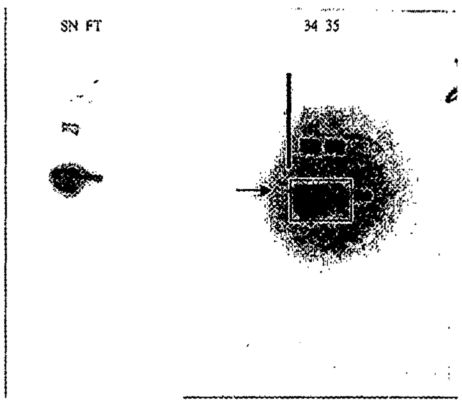
Western blot (anti-HIS)

*S. pneumoniae* pili proteins – antibody production (mice)

Sp0463 (rrgB):

α-rrgB (1/10000)

1: rrgB (E.coli background)
2: rrgC (E.coli background)
3: rrgB purified 1 µl
4: rrgB purified 5 µl
5: rrgC purified 5 µl

*S. pneumoniae* pili proteins – antibody production (mice)

Sp0464 (rrgC):

α-rrgC (1/2000)

1: rrgB (E.coli background)
2: rrgC (E.coli background)
3: rrgB purified 5 μl
4: rrgC purified 1 μl
5: rrgC purified 5 μl

*S. pneumoniae* TIGR4 pilus purification I – cultivation + digestion

S. pneumoniae TIGR4 pilus purification II - Sucrose density gradient centrifugation

*S. pneumoniae* TIGR4 pilus purification III – Gel filtration

```
14CSR     ------GTTTAGGCGCTTTTCATTATAAGTCTTATGGGACTTTTTTGATACTCAAAAAGC
670       TGAGTTGTTTAGGCGCTTTTCATTATAAGTCTTATGGGACTTTTTTGATACTCAAAAAGC
6BF       ------GTTTAGGCGCTTTTCATTATAAGTCTTATGGGACTTTTTTGATACTCAAAAAGC
6BSP      -----------GCGCTTTTCATTATAAGTCTTATGGGACTTTTTTGATACTCAAAAAGC
19AH      ------GTTTAGGCGCTTTTCATTATAAGTCTTATGGGACTTTTTTGATACTCAAAAAGC
23FPO     --------TTTAGGCGCTTTTCATTATAAGTCTTATGGGACTTTTTTGATACTCAAAAAGC
19FTW     ----------------TTTTCATTATAAATCTTATGGGACTTTTTTGATACTCAAAAAGC
9VSP      -------TTTAGGCGCTTTTCATTATAAGTCTTATGGGACTTTTTTGATACTCAAAAAGC
TIGR4     ----------TTAGGCGCTTTTCATTATAAGTCTTATGGGACTTTTTTGATACTCAAAAAGC
23FTW     -------------GCGCTTTTCATTATAAGTCTTATGGGACTTTTTTGATACTCAAAAAGC
               * * * * * * * * * *  * * * * * * * * * * * * * * * * * * * *

14CSR     CCTATAATCTCCACAGTGGGATTTACCCACTACAGAAATTATAGAGCCAGAAAAAACACT
670       CCTATAATCTCCACAGTGGGATTTACCCACTACAGAAATTATAGAGCCAGAAAAAACACT
6BF       CCTATAATCTCCACAGTGGGATTTACCCACTACAGAAATTATAGAGCCAGAAAAAACACT
6BSP      CCTATAATCTCCACAGTGGGATTTACCCACTACAGAAATTATAGAGCCAGAAAAAACACT
19AH      CCTATAATCTCCACAGTGGGATTTACCCACTACAGAAATTATAGAGCCAGAAAAAACACT
23FPO     CCTATAATCTCCACAGTGGGATTTACCCACTACAGAAATTATAGAGCCAGAAAAAACACT
19FTW     CCTATAATCTCCACAGTGGGATTTACCCACTACAGAAATTATAGAGCCAGAAAAAACACT
9VSP      CCTATAATCTCCACAGTGGGATTTACCCACTACAGAAATTATAGAGCCAGAAAAAACACT
TIGR4     CCTATAATCTCCACAGTGGGATTTACCCACTACAGAAATTATAGAGCCAGAAAAAACACT
23FTW     CCTATAATCTCCACAGTGGGATTTACCCACTACAGAAATTATAGAGCCAGAAAAAACACT
          * * * * * * * * * * * * * * * * * * * * * * * * * * * * * * *

14CSR     TTTGTTCACTAGCAGAAACTAGAGAGCAGAAGTGTTTTTCTGTTCAGATTTACCCAAAAC
670       TTTGTTCACTAGCAGAAACTAGAGAGCAGAAGTGTTTTTCTGTTCAGATTTACCCAAAAC
6BF       TTTGTTCACTAGCAGAAACTAGAGAGCAGAAGTGTTTTTCTGTTCAGATTTACCCAAAAC
6BSP      TTTGTTCACTAGCAGAAACTAGAGAGCAGAAGTGTTTTTCTGTTCAGATTTACCCAAAAC
19AH      TTTGTTCACTAGCAGAAACTAGAGAGCAGAAGTGTTTTTCTGTTCAGATTTACCCAAAAC
23FPO     TTTGTTCACTAGCAGAAACTAGAGAGCAGAAGTGTTTTTCTGTTCAGATTTACCCAAAAC
19FTW     TTTGTTCACTAGCAGAAACTAGAGAGCAGAAGTGTTTTTCTGTTCAGATTTACCCAAAAC
9VSP      TTTGTTCACTAGCAGAAACTAGAGAGCAGAAGTGTTTTTCTGTTCAGATTTACCCAAAAC
TIGR4     TTTGTTCACTAGCAGAAACTAGAGAGCAGAAGTGTTTTTCTGTTCAGATTTACCCAAAAC
23FTW     TTTGTTCACTAGCAGAAACTAGAGAGCAGAAGTGTTTTTCTGTTCAGATTTACCCAAAAC
          * * * * * * * * * * * * * * * * * * * * * * * * * * * * * * *

14CSR     TGGGAAATATGGGGATAAGAATAGAGATGGCTTAGGAAGCCCCTTTTTGTGTGTAGACAG
670       TGGGAAATATGGGGATAAGAATAGAGATGGCTTAGGAAGCCCCTTTTTGTGTGTAGACAG
6BF       TGGGAAATATGGGGATAAGAATAGAGATGGCTTAGGAAGCCCCTTTTTGTGTGTAGACAG
6BSP      TGGGAAATATGGGGATAAGAATAGAGATGGCTTAGGAAGCCCCTTTTTGTGTGTAGACAG
19AH      TGGGAAATATGGGGATAAGAATAGAGATGGCTTAGGAAGCCCCTTTTTGTGTGTAGACAG
23FPO     TGGGAAATATGGGGATAAGAATAGAGATGGCTTAGGAAGCCCCTTTTTGTGTGTAGACAG
19FTW     TGGGAAATATGGGGATAAGAATAGAGATGGCTTAGGAAGCCCCTTTTTGTGTGTAGACAG
9VSP      TGGGAAATATGGGGATAAGAATAGAGATGGCTTAGGAAGCCCCTTTTTGTGTGTAGACAG
TIGR4     TGGGAAATATGGGGATAAGAATAGAGATGGCTTAGGAAGCCCCTTTTTGTGTGTAGACAG
23FTW     TGGGAAATATGGGGATAAGAATAGAGATGGCTTAGGAAGCCCCTTTTTGTGTGTAGACAG
          * * * * * * * * * * * * * * * * * * * * * * * * * * * * * * *

14CSR     TACGATGAACTTATAACAAATAGTGAGCCTTTTTAGCAATCATTGCGACCCGTTTGTCAA
670       TACGATGAACTTATAACAAATAGTGAGCCTTTTTAGCAATCATTGCGACCCGTTTGTCAA
6BF       TACGATGAACTTATAACAAATAGTGAGCCTTTTTAGCAATCATTGCGACCCGTTTGTCAA
6BSP      TACGATGAACTTATAACAAATAGTGAGCCTTTTTAGCAATCATTGCGACCCGTTTGTCAA
19AH      TACGATGAACTTATAACAAATAGTGAGCCTTTTTAGCAATCATTGCGACCCGTTTGTCAA
23FPO     TACGATGAACTTATAACAAATAGTGAGCCTTTTTAGCAATCATTGCGACCCGTTTGTCAA
19FTW     TACGATGAACTTATAACAAATAGTGAGCCTTTTTAGCAATCATTGCGACCCGTTTGTCAA
9VSP      TACGATGAACTTATAACAAATAGTGAGCCTTTTTAGCAATCATTGCGACCCGTTTGTCAA
TIGR4     TACGATGAACTTATAACAAATAGTGAGCCTTTTTAGCAATCATTGCGACCCGTTTGTCAA
23FTW     TACGATGAACTTATAACAAATAGTGAGCCTTTTTAGCAATCATTGCGACCCGTTTGTCAA
          * * * * * * * * * * * * * * * * * * * * * * * * * * * * * * *
```

Figure 196A

```
14CSR    AAGCCTCTTTTCGGATATCTACAATTGTCTGATAGATGAGACGCTGTTGGCTAACATGCA
670      AAGCCTCTTTTCGGATATCTACAATTGTCTGATAGATGAGACGCTGTTGGCTAACATGCA
6BF      AAGCCTCTTTTCGGATATCTACAATTGTCTGATAGATGAGACGCTGTTGGCTAACATGCA
6BSP     AAGCCTCTTTTCGGATATCTACAATTGTCTGATAGATGAGACGCTGTTGGCTAACATGCA
19AH     AAGCCTCTTTTCGGATATCTACAATTGTCTGATAGATGAGACGCTGTTGGCTAACATGCA
23FPO    AAGCCTCTTTTCGGATATCTACAATTGTCTGATAGATGAGACGCTGTTGGCTAACATGCA
19FTW    AAGCCTCTTTTCGGATATCTACAATTGTCTGATAGATGAGACGCTGTTGGCTAACATGCA
9VSP     AAGCCTCTTTTCGGATATCTACAATTGTCTGATAGATGAGACGCTGTTGGCTAACATGCA
TIGR4    AAGCCTCTTTTCGGATATCTACAATTGTCTGATAGATGAGACGCTGTTGGCTAACATGCA
23FTW    AAGCCTCTTTTCGGATATCTACAATTGTCTGATAGATGAGACGCTGTTGGCTAACATGCA
         ************************************************************

14CSR    AATCTAAGGCAATCGTCAAAAAGTGATGTTTCCCTTTGGGATACTGCTTTTTAACGTAAG
670      AATCTAAGGCAATCGTCAAAAAGTGATGTTTCCCTTTGGGATACTGCTTTTTAACGTAAG
6BF      AATCTAAGGCAATCGTCAAAAAGTGATGTTTCCCTTTGGGATACTGCTTTTTAACGTAAG
6BSP     AATCTAAGGCAATCGTCAAAAAGTGATGTTTCCCTTTGGGATACTGCTTTTTAACGTAAG
19AH     AATCTAAGGCAATCGTCAAAAAGTGATGTTTCCCTTTGGGATACTGCTTTTTAACGTAAG
23FPO    AATCTAAGGCAATCGTCAAAAAGTGATGTTTCCCTTTGGGATACTGCTTTTTAACGTAAG
19FTW    AATCTAAGGCAATCGTCAAAAAGTGATGTTTCCCTTTGGGATACTGCTTTTTAACGTAAG
9VSP     AATCTAAGGCAATCGTCAAAAAGTGATGTTTCCCTTTGGGATACTGCTTTTTAACGTAAG
TIGR4    AATCTAAGGCAATCGTCAAAAAGTGATGTTTCCCTTTGGGATACTGCTTTTTAACGTAAG
23FTW    AATCTAAGGCAATCGTCAAAAAGTGATGTTTCCCTTTGGGATACTGCTTTTTAACGTAAG
         ************************************************************

14CSR    GCAGGTATTCTTTCGTTGTAATAATAATCAATGGCTCTGTCAAATGCTCCTCTGAAGGAG
670      GCAGGTATTCTTTCGTTGTAATAATAATCAATGGCTCTGTCAAATGCTCCTCTGAAGGAG
6BF      GCAGGTATTCTTTCGTTGTAATAATAATCAATGGCTCTGTCAAATGCTCCTCTGAAGGAG
6BSP     GCAGGTATTCTTTCGTTGTAATAATAATCAATGGCTCTGTCAAATGCTCCTCTGAAGGAG
19AH     GCAGGTATTCTTTCGTTGTAATAATAATCAATGGCTCTGTCAAATGCTCCTCTGAAGGAG
23FPO    GCAGGTATTCTTTCGTTGTAATAATAATCAATGGCTCTGTCAAATGCTCCTCTGAAGGAG
19FTW    GCAGGTATTCTTTCGTTGTAATAATAATCAATGGCTCTGTCAAATGCTCCTCTGAAGGAG
9VSP     GCAGGTATTCTTTCGTTGTAATAATAATCAATGGCTCTGTCAAATGCTCCTCTGAAGGAG
TIGR4    GCAGGTATTCTTTCGTTGTAATAATAATCAATGGCTCTGTCAAATGCTCCTCTGAAGGAG
23FTW    GCAGGTATTCTTTCGTTGTAATAATAATCAATGGCTCTGTCAAATGCTCCTCTGAAGGAG
         ************************************************************

14CSR    GAGGACTAATTAGAATATTGTATCCTGTAACAGAGGCAACTTTGTCAGTAAAATTCCGTA
670      GAGGACTAATTAGAATATTGTATCCTGTAACAGAGGCAACTTTGTCAGTAAAATTCCGTA
6BF      GAGGACTAATTAGAATATTGTATCCTGTAACAGAGGCAACTTTGTCAGTAAAATTCCGTA
6BSP     GAGGACTAATTAGAATATTGTATCCTGTAACAGAGGCAACTTTGTCAGTAAAATTCCGTA
19AH     GAGGACTAATTAGAATATTGTATCCTGTAACAGAGGCAACTTTGTCAGTAAAATTCCGTA
23FPO    GAGGACTAATTAGAATATTGTATCCTGTAACAGAGGCAACTTTGTCAGTAAAATTCCGTA
19FTW    GAGGACTAATTAGAATATTGTATCCTGTAACAGAGGCAACTTTGTCAGTAAAATTCCGTA
9VSP     GAGGACTAATTAGAATATTGTATCCTGTAACAGAGGCAACTTTGTCAGTAAAATTCCGTA
TIGR4    GAGGACTAATTAGAATATTGTATCCTGTAACAGAGGCAACTTTGTCAGTAAAATTCCGTA
23FTW    GAGGACTAATTAGAATATTGTATCCTGTAACAGAGGCAACTTTGTCAGTAAAATTCCGTA
         ************************************************************

14CSR    AAATAATGGACTTTATTAAGTTTACATCTGCTTGATTATTTAAAATGATAAAAATCGGGA
670      AAATAATGGACTTTATTAAGTTTACATCTGCTTGATTATTTAAAATGATAAAAATCGGGA
6BF      AAATAATGGACTTTATTAAGTTTACATCTGCTTGATTATTTAAAATGATAAAAATCGGGA
6BSP     AAATAATGGACTTTATTAAGTTTACATCTGCTTGATTATTTAAAATGATAAAAATCGGGA
19AH     AAATAATGGACTTTATTAAGTTTACATCTGCTTGATTATTTAAAATGATAAAAATCGGGA
23FPO    AAATAATGGACTTTATTAAGTTTACATCTGCTTGATTATTTAAAATGATAAAAATCGGGA
19FTW    AAATAATGGACTTTATTAAGTTTACATCTGCTTGATTATTTAAAATGATAAAAATCGGGA
9VSP     AAATAATGGACTTTATTAAGTTTACATCTGCTTGATTATTTAAAATGATAAAAATCGGGA
TIGR4    AAATAATGGACTTTATTAAGTTTACATCTGCTTGATTATTTAAAATGATAAAAATCGGGA
23FTW    AAATAATGGACTTTATTAAGTTTACATCTGCTTGATTATTTAAAATGATAAAAATCGGGA
         ************************************************************
```

Figure 196B

```
14CSR    TAGCAGGTAGTGAGGAAAAGATGGTTTCTGTCAAGTAGAGTGAGAAAAGGTACAGCCGAT
670      TAGCAGGTAGTGAGGAAAAGATGGTTTCTGTCAAGTAGAGTGAGAAAAGGTACAGCCGAT
6BF      TAGCAGGTAGTGAGGAAAAGATGGTTTCTGTCAAGTAGAGTGAGAAAAGGTACAGCCGAT
6BSP     TAGCAGGTAGTGAGGAAAAGATGGTTTCTGTCAAGTAGAGTGAGAAAAGGTACAGCCGAT
19AH     TAGCAGGTAGTGAGGAAAAGATGGTTTCTGTCAAGTAGAGTGAGAAAAGGTACAGCCGAT
23FPO    TAGCAGGTAGTGAGGAAAAGATGGTTTCTGTCAAGTAGAGTGAGAAAAGGTACAGCCGAT
19FTW    TAGCAGGTAGTGAGGAAAAGATGGTTTCTGTCAAGTAGAGTGAGAAAAGGTACAGCCGAT
9VSP     TAGCAGGTAGTGAGGAAAAGATGGTTTCTGTCAAGTAGAGTGAGAAAAGGTACAGCCGAT
TIGR4    TAGCAGGTAGTGAGGAAAAGATGGTTTCTGTCAAGTAGAGTGAGAAAAGGTACAGCCGAT
23FTW    TAGCAGGTAGTGAGGAAAAGATGGTTTCTGTCAAGTAGAGTGAGAAAAGGTACAGCCGAT
         ************************************************************

14CSR    GCTGGTCGATAACTCCTTCAATCTTCTGCTCAGTCATCCACTCTTGAACAATTGCTTTCG
670      GCTGGTCGATAACTCCTTCAATCTTCTGCTCAGTCATCCACTCTTGAACAATTGCTTTCG
6BF      GCTGGTCGATAACTCCTTCAATCTTCTGCTCAGTCATCCACTCTTGAACAATTGCTTTCG
6BSP     GCTGGTCGATAACTCCTTCAATCTTCTGCTCAGTCATCCACTCTTGAACAATTGCTTTCG
19AH     GCTGGTCGATAACTCCTTCAATCTTCTGCTCAGTCATCCACTCTTGAACAATTGCTTTCG
23FPO    GCTGGTCGATAACTCCTTCAATCTTCTGCTCAGTCATCCACTCTTGAACAATTGCTTTCG
19FTW    GCTGGTCGATAACTCCTTCAATCTTCTGCTCAGTCATCCACTCTTGAACAATTGCTTTCG
9VSP     GCTGGTCGATAACTCCTTCAATCTTCTGCTCAGTCATCCACTCTTGAACAATTGCTTTCG
TIGR4    GCTGGTCGATAACTCCTTCAATCTTCTGCTCAGTCATCCACTCTTGAACAATTGCTTTCG
23FTW    GCTGGTCGATAACTCCTTCAATCTTCTGCTCAGTCATCCACTCTTGAACAATTGCTTTCG
         ************************************************************

14CSR    AAATATGATACAGTGGCTTGTCGCTTTCAATCCCATAATGTTCGTAATAATTATAATAGG
670      AAATATGATACAGTGGCTTGTCGCTTTCAATCCCATAATGTTCGTAATAATTATAATAGG
6BF      AAATATGATACAGTGGCTTGTCGCTTTCAATCCCATAATGTTCGTAATAATTATAATAGG
6BSP     AAATATGATACAGTGGCTTGTCGCTTTCAATCCCATAATGTTCGTAATAATTATAATAGG
19AH     AAATATGATACAGTGGCTTGTCGCTTTCAATCCCATAATGTTCGTAATAATTATAATAGG
23FPO    AAATATGATACAGTGGCTTGTCGCTTTCAATCCCATAATGTTCGTAATAATTATAATAGG
19FTW    AAATATGATACAGTGGCTTGTCGCTTTCAATCCCATAATGTTCGTAATAATTATAATAGG
9VSP     AAATATGATACAGTGGCTTGTCGCTTTCAATCCCATAATGTTCGTAATAATTATAATAGG
TIGR4    AAATATGATACAGTGGCTTGTCGCTTTCAATCCCATAATGTTCGTAATAATTATAATAGG
23FTW    AAATATGATACAGTGGCTTGTCGCTTTCAATCCCATAATGTTCGTAATAATTATAATAGG
         ************************************************************

14CSR    GAACTAGATTTTGTAAACCAAACAAAAACGTTCTTGTTAAGAAAGTCAGTGCTGTTAAAA
670      GAACTAGATTTTGTAAACCAAACAAAAACGTTCTTGTTAAGAAAGTCAGTGCTGTTAAAA
6BF      GAACTAGATTTTGTAAACCAAACAAAAACGTTCTTGTTAAGAAAGTCAGTGCTGTTAAAA
6BSP     GAACTAGATTTTGTAAACCAAACAAAAACGTTCTTGTTAAGAAAGTCAGTGCTGTTAAAA
19AH     GAACTAGATTTTGTAAACCAAACAAAAACGTTCTTGTTAAGAAAGTCAGTGCTGTTAAAA
23FPO    GAACTAGATTTTGTAAACCAAACAAAAACGTTCTTGTTAAGAAAGTCAGTGCTGTTAAAA
19FTW    GAACTAGATTTTGTAAACCAAACAAAAACGTTCTTGTTAAGAAAGTCAGTGCTGTTAAAA
9VSP     GAACTAGATTTTGTAAACCAAACAAAAACGTTCTTGTTAAGAAAGTCAGTGCTGTTAAAA
TIGR4    GAACTAGATTTTGTAAACCAAACAAAAACGTTCTTGTTAAGAAAGTCAGTGCTGTTAAAA
23FTW    GAACTAGATTTTGTAAACCAAACAAAAACGTTCTTGTTAAGAAAGTCAGTGCTGTTAAAA
         ************************************************************

14CSR    AAGAAAGAGAATTCGAAATGTCATTTCCTAAGATATTCTTGAACTTGGATAGTAGATGCT
670      AAGAAAGAGAATTCGAAATGTCATTTCCTAAGATATTCTTGAACTTGGATAGTAGATGCT
6BF      AAGAAAGAGAATTCGAAATGTCATTTCCTAAGATATTCTTGAACTTGGATAGTAGATGCT
6BSP     AAGAAAGAGAATTCGAAATGTCATTTCCTAAGATATTCTTGAACTTGGATAGTAGATGCT
19AH     AAGAAAGAGAATTCGAAATGTCATTTCCTAAGATATTCTTGAACTTGGATAGTAGATGCT
23FPO    AAGAAAGAGAATTCGAAATGTCATTTCCTAAGATATTCTTGAACTTGGATAGTAGATGCT
19FTW    AAGAAAGAGAATTCGAAATGTCATTTCCTAAGATATTCTTGAACTTGGATAGTAGATGCT
9VSP     AAGAAAGAGAATTCGAAATGTCATTTCCTAAGATATTCTTGAACTTGGATAGTAGATGCT
TIGR4    AAGAAAGAGAATTCGAAATGTCATTTCCTAAGATATTCTTGAACTTGGATAGTAGATGCT
23FTW    AAGAAAGAGAATTCGAAATGTCATTTCCTAAGATATTCTTGAACTTGGATAGTAGATGCT
         ************************************************************
```

Figure 196C

```
14CSR     TTCCTCTTGTATGCTGAAGAATCAGTTGAATAGTATGAGTCTTTTTTTCTTGATTCCATT
670       TTCCTCTTGTATGCTGAAGAATCAGTTGAATAGTATGAGTCTTTTTTTCTTGATTCCATT
6BF       TTCCTCTTGTATGCTGAAGAATCAGTTGAATAGTATGAGTCTTTTTTTCTTGATTCCATT
6BSP      TTCCTCTTGTATGCTGAAGAATCAGTTGAATAGTATGAGTCTTTTTTTCTTGATTCCATT
19AH      TTCCTCTTGTATGCTGAAGAATCAGTTGAATAGTATGAGTCTTTTTTTCTTGATTCCATT
23FPO     TTCCTCTTGTATGCTGAAGAATCAGTTGAATAGTATGAGTCTTTTTTTCTTGATTCCATT
19FTW     TTCCTCTTGTATGCTGAAGAATCAGTTGAATAGTATGAGTCTTTTTTTCTTGATTCCATT
9VSP      TTCCTCTTGTATGCTGAAGAATCAGTTGAATAGTATGAGTCTTTTTTTCTTGATTCCATT
TIGR4     TTCCTCTTGTATGCTGAAGAATCAGTTGAATAGTATGAGTCTTTTTTTCTTGATTCCATT
23FTW     TTCCTCTTGTATGCTGAAGAATCAGTTGAATAGTATGAGTCTTTTTTTCTTGATTCCATT
          ************************************************************

14CSR     TGTCCTTGGAAAACGAAGAATTAGCAGAACAATAAACCAAAAAGATATAATCCAGTTCTT
670       TGTCCTTGGAAAACGAAGAATTAGCAGAACAATAAACCAAAAAGATATAATCCAGTTCTT
6BF       TGTCCTTGGAAAACGAAGAATTAGCAGAACAATAAACCAAAAAGATATAATCCAGTTCTT
6BSP      TGTCCTTGGAAAACGAAGAATTAGCAGAACAATAAACCAAAAAGATATAATCCAGTTCTT
19AH      TGTCCTTGGAAAACGAAGAATTAGCAGAACAATAAACCAAAAAGATATAATCCAGTTCTT
23FPO     TGTCCTTGGAAAACGAAGAATTAGCAGAACAATAAACCAAAAAGATATAATCCAGTTCTT
19FTW     TGTCCTTGGAAAACGAAGAATTAGCAGAACAATAAACCAAAAAGATATAATCCAGTTCTT
9VSP      TGTCCTTGGAAAACGAAGAATTAGCAGAACAATAAACCAAAAAGATATAATCCAGTTCTT
TIGR4     TGTCCTTGGAAAACGAAGAATTAGCAGAACAATAAACCAAAAAGATATAATCCAGTTCTT
23FTW     TGTCCTTGGAAAACGAAGAATTAGCAGAACAATAAACCAAAAAGATATAATCCAGTTCTT
          ************************************************************

14CSR     CCTGAGTAAAAGTCATGTTGGCATGTGGCTCTAAGTAAGTTTGGCAATGTTCCATCAAAA
670       CCTGAGTAAAAGTCATGTTGGCATGTGGCTCTAAGTAAGTTTGGCAATGTTCCATCAAAA
6BF       CCTGAGTAAAAGTCATGTTGGCATGTGGCTCTAAGTAAGTTTGGCAATGTTCCATCAAAA
6BSP      CCTGAGTAAAAGTCATGTTGGCATGTGGCTCTAAGTAAGTTTGGCAATGTTCCATCAAAA
19AH      CCTGAGTAAAAGTCATGTTGGCATGTGGCTCTAAGTAAGTTTGGCAATGTTCCATCAAAA
23FPO     CCTGAGTAAAAGTCATGTTGGCATGTGGCTCTAAGTAAGTTTGGCAATGTTCCATCAAAA
19FTW     CCTGAGTAAAAGTCATGTTGGCATGTGGCTCTAAGTAAGTTTGGCAATGTTCCATCAAAA
9VSP      CCTGAGTAAAAGTCATGTTGGCATGTGGCTCTAAGTAAGTTTGGCAATGTTCCATCAAAA
TIGR4     CCTGAGTAAAAGTCATGTTGGCATGTGGCTCTAAGTAAGTTTGGCAATGTTCCATCAAAA
23FTW     CCTGAGTAAAAGTCATGTTGGCATGTGGCTCTAAGTAAGTTTGGCAATGTTCCATCAAAA
          ************************************************************

14CSR     TCGGATACATAAAGAGGTTTTTTAATTTTTCAAACTCTTTGGACTCAGGGAACTCAAGTG
670       TCGGATACATAAAGAGGTTTTTTAATTTTTCAAACTCTTTGGACTCAGGGAACTCAAGTG
6BF       TCGGATACATAAAGAGGTTTTTTAATTTTTCAAACTCTTTGGACTCAGGGAACTCAAGTG
6BSP      TCGGATACATAAAGAGGTTTTTTAATTTTTCAAACTCTTTGGACTCAGGGAACTCAAGTG
19AH      TCGGATACATAAAGAGGTTTTTTAATTTTTCAAACTCTTTGGACTCAGGGAACTCAAGTG
23FPO     TCGGATACATAAAGAGGTTTTTTAATTTTTCAAACTCTTTGGACTCAGGGAACTCAAGTG
19FTW     TCGGATACATAAAGAGGTTTTTTAATTTTTCAAACTCTTTGGACTCAGGGAACTCAAGTG
9VSP      TCGGATACATAAAGAGGTTTTTTAATTTTTCAAACTCTTTGGACTCAGGGAACTCAAGTG
TIGR4     TCGGATACATAAAGAGGTTTTTTAATTTTTCAAACTCTTTGGACTCAGGGAACTCAAGTG
23FTW     TCGGATACATAAAGAGGTTTTTTAATTTTTCAAACTCTTTGGACTCAGGGAACTCAAGTG
          ************************************************************

14CSR     GAAATTCCCGACGTTTCCAAGTGAGTGCCACTAGTATGCTAAAATGAACATACTCGTCAG
670       GAAATTCCCGACGTTTCCAAGTGAGTGCCACTAGTATGCTAAAATGAACATACTCGTCAG
6BF       GAAATTCCCGACGTTTCCAAGTGAGTGCCACTAGTATGCTAAAATGAACATACTCGTCAG
6BSP      GAAATTCCCGACGTTTCCAAGTGAGTGCCACTAGTATGCTAAAATGAACATACTCGTCAG
19AH      GAAATTCCCGACGTTTCCAAGTGAGTGCCACTAGTATGCTAAAATGAACATACTCGTCAG
23FPO     GAAATTCCCGACGTTTCCAAGTGAGTGCCACTAGTATGCTAAAATGAACATACTCGTCAG
19FTW     GAAATTCCCGACGTTTCCAAGTGAGTGCCACTAGTATGCTAAAATGAACATACTCGTCAG
9VSP      GAAATTCCCGACGTTTCCAAGTGAGTGCCACTAGTATGCTAAAATGAACATACTCGTCAG
TIGR4     GAAATTCCCGACGTTTCCAAGTGAGTGCCACTAGTATGCTAAAATGAACATACTCGTCAG
23FTW     GAAATTCCCGACGTTTCCAAGTGAGTGCCACTAGTATGCTAAAATGAACATACTCGTCAG
          ************************************************************
```

Figure 196D

```
14CSR     GTGTGATTTCTAACAGTTCATGACTGAGTTGAGAATTAGACTGCACAATCATATGTGTGA
670       GTGTGATTTCTAACAGTTCATGACTGAGTTGAGAATTAGACTGCACAATCATATGTGTGA
6BF       GTGTGATTTCTAACAGTTCATGACTGAGTTGAGAATTAGACTGCACAATCATATGTGTGA
6BSP      GTGTGATTTCTAACAGTTCATGACTGAGTTGAGAATTAGACTGCACAATCATATGTGTGA
19AH      GTGTGATTTCTAACAGTTCATGACTGAGTTGAGAATTAGACTGCACAATCATATGTGTGA
23FPO     GTGTGATTTCTAACAGTTCATGACTGAGTTGAGAATTAGACTGCACAATCATATGTGTGA
19FTW     GTGTGATTTCTAACAGTTCATGACTGAGTTGAGAATTAGACTGCACAATCATATGTGTGA
9VSP      GTGTGATTTCTAACAGTTCATGACTGAGTTGAGAATTAGACTGCACAATCATATGTGTGA
TIGR4     GTGTGATTTCTAACAGTTCATGACTGAGTTGAGAATTAGACTGCACAATCATATGTGTGA
23FTW     GTGTGATTTCTAACAGTTCATGACTGAGTTGAGAATTAGACTGCACAATCATATGTGTGA
          ************************************************************

14CSR     CCCAATCCATACTTCCATCATTCAAATCATAAATCTCAATACCAAAATGAAACTGGAGGA
670       CCCAATCCATACTTCCATCATTCAAATCATAAATCTCAATACCAAAATGAAACTGGAGGA
6BF       CCCAATCCATACTTCCATCATTCAAATCATAAATCTCAATACCAAAATGAAACTGGAGGA
6BSP      CCCAATCCATACTTCCATCATTCAAATCATAAATCTCAATACCAAAATGAAACTGGAGGA
19AH      CCCAATCCATACTTCCATCATTCAAATCATAAATCTCAATACCAAAATGAAACTGGAGGA
23FPO     CCCAATCCATACTTCCATCATTCAAATCATAAATCTCAATACCAAAATGAAACTGGAGGA
19FTW     CCCAATCCATACTTCCATCATTCAAATCATAAATCTCAATACCAAAATGAAACTGGAGGA
9VSP      CCCAATCCATACTTCCATCATTCAAATCATAAATCTCAATACCAAAATGAAACTGGAGGA
TIGR4     CCCAATCCATACTTCCATCATTCAAATCATAAATCTCAATACCAAAATGAAACTGGAGGA
23FTW     CCCAATCCATACTTCCATCATTCAAATCATAAATCTCAATACCAAAATGAAACTGGAGGA
          ************************************************************

14CSR     GTGCAATTAAAAAACGAATGCGATATTCAGGACCAACTACTTGATTTTTCACAAGGTCCA
670       GTGCAATTAAAAAACGAATGCGATATTCAGGACCAACTACTTGATTTTTCACAAGGTCCA
6BF       GTGCAATTAAAAAACGAATGCGATATTCAGGACCAACTACTTGATTTTTCACAAGGTCCA
6BSP      GTGCAATTAAAAAACGAATGCGATATTCAGGACCAACTACTTGATTTTTCACAAGGTCCA
19AH      GTGCAATTAAAAAACGAATGCGATATTCAGGACCAACTACTTGATTTTTCACAAGGTCCA
23FPO     GTGCAATTAAAAAACGAATGCGATATTCAGGACCAACTACTTGATTTTTCACAAGGTCCA
19FTW     GTGCAATTAAAAAACGAATGCGATATTCAGGACCAACTACTTGATTTTTCACAAGGTCCA
9VSP      GTGCAATTAAAAAACGAATGCGATATTCAGGACCAACTACTTGATTTT-CACAAGGTCCA
TIGR4     GTGCAATTAAAAAACGAATGCGATATTCAGGACCAACTACTTGATTTTTCACAAGGTCCA
23FTW     GTGCAATTAAAAAACGAATGCGATATTCAGGACCAACTACTTGATTTTTCACAAGGTCCA
          ************************************************ ***********

14CSR     AACCTACTGAACGTAGTAACAAGCCACACTTTTGTCGTACGCGGTAGCCTGTTGCGATGG
670       AACCTACTGAACGTAGTAACAAGCCACACTTTTGTCGTACGCGGTAGCCTGTTGCGATGG
6BF       AACCTACTGAACGTAGTAACAAGCCACACTTTTGTCGTACGCGGTAGCCTGTTGCGATGG
6BSP      AACCTACTGAACGTAGTAACAAGCCACACTTTTGTCGTACGCGGTAGCCTGTTGCGATGG
19AH      AACCTACTGAACGTAGTAACAAGCCACACTTTTGTCGTACGCGGTAGCCTGTTGCGATGG
23FPO     AACCTACTGAACGTAGTAACAAGCCACACTTTTGTCGTACGCGGTAGCCTGTTGCGATGG
19FTW     AACCTACTGAACGTAGTAACAAGCCACACTTTTGTCGTACGCGGTAGCCTGTTGCGATGG
9VSP      AACCTACTGAACGTAGTAACAAGCCACACTTTTGTCGTACGCGGTAGCCTGTTGCGATGG
TIGR4     AACCTACTGAACGTAGTAACAAGCCACACTTTTGTCGTACGCGGTAGCCTGTTGCGATGG
23FTW     AACCTACTGAACGTAGTAACAAGCCACACTTTTGTCGTACGCGGTAGCCTGTTGCGATGG
          ************************************************************

14CSR     AAATATACTCTTTTTGTGTAAATTCGTTAAAGCTTTGATTACCTTGTAGTAGAAAGAAGC
670       AAATATACTCTTTTTGTGTAAATTCGTTAAAGCTTTGATTACCTTGTAGTAGAAAGAAGC
6BF       AAATATACTCTTTTTGTGTAAATTCGTTAAAGCTTTGATTACCTTGTAGTAGAAAGAAGC
6BSP      AAATATACTCTTTTTGTGTAAATTCGTTAAAGCTTTGATTACCTTGTAGTAGAAAGAAGC
19AH      AAATATACTCTTTTTGTGTAAATTCGTTAAAGCTTTGATTACCTTGTAGTAGAAAGAAGC
23FPO     AAATATACTCTTTTTGTGTAAATTCGTTAAAGCTTTGATTACCTTGTAGTAGAAAGAAGC
19FTW     AAATATACTCTTTTTGTGTAAATTCGTTAAAGCTTTGATTACCTTGTAGTAGAAAGAAGC
9VSP      AAATATACTCTTTTTGTGTAAATTCGTTAAAGCTTTGATTACCTTGTAGTAGAAAGAAGC
TIGR4     AAATATACTCTTTTTGTGTAAATTCGTTAAAGCTTTGATTACCTTGTAGTAGAAAGAAGC
23FTW     AAATATACTCTTTTTGTGTAAATTCGTTAAAGCTTTGATTACCTTGTAGTAGAAAGAAGC
          ************************************************************
```

Figure 196E

```
14CSR     GGAGTATTTTTAAAATAGTTGATTGGTTATAAAGCTGATGGAAGTAATAATTCGTTTGAT
670       GGAGTATTTTTAAAATAGTTGATTGGTTATAAAGCTGATGGAAGTAATAATTCGTTTGAT
6BF       GGAGTATTTTTAAAATAGTTGATTGGTTATAAAGCTGATGGAAGTAATAATTCGTTTGAT
6BSP      GGAGTATTTTTAAAATAGTTGATTGGTTATAAAGCTGATGGAAGTAATAATTCGTTTGAT
19AH      GGAGTATTTTTAAAATAGTTGATTGGTTATAAAGCTGATGGAAGTAATAATTCGTTTGAT
23FPO     GGAGTATTTTTAAAATAGTTGATTGGTTATAAAGCTGATGGAAGTAATAATTCGTTTGAT
19FTW     GGAGTATTTTTAAAATAGTTGATTGGTTATAAAGCTGATGGAAGTAATAATTCGTTTGAT
9VSP      GGAGTATTTTTAAAATAGTTGATTGGTTATAAAGCTGATGGAAGTAATAATTCGTTTGAT
TIGR4     GGAGTATTTTTAAAATAGTTGATTGGTTATAAAGCTGATGGAAGTAATAATTCGTTTGAT
23FTW     GGAGTATTTTTAAAATAGTTGATTGGTTATAAAGCTGATGGAAGTAATAATTCGTTTGAT
          ************************************************************

14CSR     GAGAATGGTGTTCGATTAATTGAACTTGTTGCGTATCTAAATTAAATGTCAACTCTTCCT
670       GAGAATGGTGTTCGATTAATTGAACTTGTTGCGTATCTAAATTAAATGTCAACTCTTCCT
6BF       GAGAATGGTGTTCGATTAATTGAACTTGTTGCGTATCTAAATTAAATGTCAACTCTTCCT
6BSP      GAGAATGGTGTTCGATTAATTGAACTTGTTGCGTATCTAAATTAAATGTCAACTCTTCCT
19AH      GAGAATGGTGTTCGATTAATTGAACTTGTTGCGTATCTAAATTAAATGTCAACTCTTCCT
23FPO     GAGAATGGTGTTCGATTAATTGAACTTGTTGCGTATCTAAATTAAATGTCAACTCTTCCT
19FTW     GAGAATGGTGTTCGATTAATTGAACTTGTTGCGTATCTAAATTAAATGTCAACTCTTCCT
9VSP      GAGAATGGTGTTCGATTAATTGAACTTGTTGCGTATCTAAATTAAATGTCAACTCTTCCT
TIGR4     GAGAATGGTGTTCGATTAATTGAACTTGTTGCGTATCTAAATTAAATGTCAACTCTTCCT
23FTW     GAGAATGGTGTTCGATTAATTGAACTTGTTGCGTATCTAAATTAAATGTCAACTCTTCCT
          ************************************************************

14CSR     CGAATGTTTCTTGTAATTCCTGCAAAATGCTTAGGAGACTTTTAGATTGTAATGAAGTTA
670       CGAATGTTTCTTGTAATTCCTGCAAAATGCTTAGGAGACTTTTAGATTGTAATGAAGTTA
6BF       CGAATGTTTCTTGTAATTCCTGCAAAATGCTTAGGAGACTTTTAGATTGTAATGAAGTTA
6BSP      CGAATGTTTCTTGTAATTCCTGCAAAATGCTTAGGAGACTTTTAGATTGTAATGAAGTTA
19AH      CGAATGTTTCTTGTAATTCCTGCAAAATGCTTAGGAGACTTTTAGATTGTAATGAAGTTA
23FPO     CGAATGTTTCTTGTAATTCCTGCAAAATGCTTAGGAGACTTTTAGATTGTAATGAAGTTA
19FTW     CGAATGTTTCTTGTAATTCCTGCAAAATGCTTAGGAGACTTTTAGATTGTAATGAAGTTA
9VSP      CGAATGTTTCTTGTAATTCCTGCAAAATGCTTAGGAGACTTTTAGATTGTAATGAAGTTA
TIGR4     CGAATGTTTCTTGTAATTCCTGCAAAATGCTTAGGAGACTTTTAGATTGTAATGAAGTTA
23FTW     CGAATGTTTCTTGTAATTCCTGCAAAATGCTTAGGAGACTTTTAGATTGTAATGAAGTTA
          ************************************************************

14CSR     AAGTAGACAGTTCATCTAGTTCAATAGACCGAATATCCAATAATATATTTAAAATGGTAA
670       AAGTAGACAGTTCATCTAGTTCAATAGACCGAATATCCAATAATATATTTAAAATGGTAA
6BF       AAGTAGACAGTTCATCTAGTTCAATAGACCGAATATCCAATAATATATTTAAAATGGTAA
6BSP      AAGTAGACAGTTCATCTAGTTCAATAGACCGAATATCCAATAATATATTTAAAATGGTAA
19AH      AAGTAGACAGTTCATCTAGTTCAATAGACCGAATATCCAATAATATATTTAAAATGGTAA
23FPO     AAGTAGACAGTTCATCTAGTTCAATAGACCGAATATCCAATAATATATTTAAAATGGTAA
19FTW     AAGTAGACAGTTCATCTAGTTCAATAGACCGAATATCCAATAATATATTTAAAATGGTAA
9VSP      AAGTAGACAGTTCATCTAGTTCAATAGACCGAATATCCAATAATATATTTAAAATGGTAA
TIGR4     AAGTAGACAGTTCATCTAGTTCAATAGACCGAATATCCAATAATATATTTAAAATGGTAA
23FTW     AAGTAGACAGTTCATCTAGTTCAATAGACCGAATATCCAATAATATATTTAAAATGGTAA
          ************************************************************

14CSR     TTTTATCTGTAATTCTTTTTTCAATGTATTTGTTTAGCATAGTTACCGAATCTTAGTTGC
670       TTTTATCTGTAATTCTTTTTTCAATGTATTTGTTTAGCATAGTTACCGAATCTTAGTTGC
6BF       TTTTATCTGTAATTCTTTTTTCAATGTATTTGTTTAGCATAGTTACCGAATCTTAGTTGC
6BSP      TTTTATCTGTAATTCTTTTTTCAATGTATTTGTTTAGCATAGTTACCGAATCTTAGTTGC
19AH      TTTTATCTGTAATTCTTTTTTCAATGTATTTGTTTAGCATAGTTACCGAATCTTAGTTGC
23FPO     TTTTATCTGTAATTCTTTTTTCAATGTATTTGTTTAGCATAGTTACCGAATCTTAGTTGC
19FTW     TTTTATCTGTAATTCTTTTTTCAATGTATTTGTTTAGCATAGTTACCGAATCTTAGTTGC
9VSP      TTTTATCTGTAATTCTTTTTTCAATGTATTTGTTTAGCATAGTTACCGAATCTTAGTTGC
TIGR4     TTTTATCTGTAATTCTTTTTTCAATGTATTTGTTTAGCATAGTTACCGAATCTTAGTTGC
23FTW     TTTTATCTGTAATTCTTTTTTCAATGTATTTGTTTAGCATAGTTACCGAATCTTAGTTGC
          ************************************************************
```

Figure 196F

```
14CSR    ATATAGATAATTTTAATTATTATAATACAAAAGAAACTAATTGTCTTGTCAAAAAGGTTG
670      ATATAGATAATTTTAATTATTATAATACAAAAGAAACTAATTGTCTTGTCAAAAAGGTTG
6BF      ATATAGATAATTTTAATTATTATAATACAAAAGAAACTAATTGTCTTGTCAAAAAGGTTG
6BSP     ATATAGATAATTTTAATTATTATAATACAAAAGAAACTAATTGTCTTGTCAAAAAGGTTG
19AH     ATATAGATAATTTTAATTATTATAATACAAAAGAAACTAATTGTCTTGTCAAAAAGGTTG
23FPO    ATATAGATAATTTTAATTATTATAATACAAAAGAAACTAATTGTCTTGTCAAAAAGGTTG
19FTW    ATATAGATAATTTTAATTATTATAATACAAAAGAAACTAATTGTCTTGTCAAAAAGGTTG
9VSP     ATATAGATAATTTTAATTATTATAATACAAAAGAAACTAATTGTCTTGTCAAAAAGGTTG
TIGR4    ATATAGATAATTTTAATTATTATAATACAAAAGAAACTAATTGTCTTGTCAAAAAGGTTG
23FTW    ATATAGATAATTTTAATTATTATAATACAAAAGAAACTAATTGTCTTGTCAAAAAGGTTG
         ************************************************************

14CSR    TGGAATTTCCGACTTTATTGATAAAACAGCATGTAATAAAAGGCATTTTAAAGATAGTAA
670      TGGAATTTCCGACTTTATTGATAAAACAGCATGTAATAAAAGGCATTTTAAAGATAGTAA
6BF      TGGAATTTCCGACTTTATTGATAAAACAGCATGTAATAAAAGGCATTTTAAAGATAGTAA
6BSP     TGGAATTTCCGACTTTATTGATAAAACAGCATGTAATAAAAGGCATTTTAAAGATAGTAA
19AH     TGGAATTTCCGACTTTATTGATAAAACAGCATGTAATAAAAGGCATTTTAAAGATAGTAA
23FPO    TGGAATTTCCGACTTTATTGATAAAACAGCATGTAATAAAAGGCATTTTAAAGATAGTAA
19FTW    TGGAATTTCCGACTTTATTGATAAAACAGCATGTAATAAAAGGCATTTTAAAGATAGTAA
9VSP     TGGAATTTCCGACTTTATTGATAAAACAGCATGTAATAAAAGGCATTTTAAAGATAGTAA
TIGR4    TGGAATTTCCGACTTTATTGATAAAACAGCATGTAATAAAAGGCATTTTAAAGATAGTAA
23FTW    TGGAATTTCCGACTTTATTGATAAAACAGCATGTAATAAAAGGCATTTTAAAGATAGTAA
         ************************************************************

14CSR    TGAGTATTGGTGGAGTTTTATGGCTTATTTTTTTATTAGAAAATATTTTTTTATCAAAT
670      TGAGTATTGGTGGAGTTTTATGGCTTATTTTTTTATTAGAAAATATTTTTTTATCAAAT
6BF      TGAGTATTGGTGGAGTTTTATGGCTTATTTTTTTATTAGAAAATATTTTTTTATCAAAT
6BSP     TGAGTATTGGTGGAGTTTTATGGCTTATTTTTTTATTAGAAAATATTTTTTTATCAAAT
19AH     TGAGTATTGGTGGAGTTTTATGGCTTATTTTTTTATTAGAAAATATTTTTTTATCAAAT
23FPO    TGAGTATTGGTGGAGTTTTATGGCTTATTTTTTTATTAGAAAATATTTTTTTATCAAAT
19FTW    TGAGTATTGGTGGAGTTTTATGGCTTATTTTTTTATTAGAAAATATTTTTTTATCAAAT
9VSP     TGAGTATTGGTGGAGTTTTATGGCTTATTTTTTTATTAGAAAATATTTTTT-ATCAAAT
TIGR4    TGAGTATTGGTGGAGTTTTATGGCTTATTTTTTTATTAGAAAATATTTTTTTATCAAAT
23FTW    TGAGTATTGGTGGAGTTTTATGGCTTATTTTTTTATTAGAAAATATTTTTTTATCAAAT
         *************************************************** ******

14CSR    ATTGTCGTTCTATAAAAAAATATGTGATAAAAATATCTATTGTGATGGAAGTTGTTTTAA
670      ATTGTCGTTCTATAAAAAAATATGTGATAAAAATATCTATTGTGATGGAAGTTGTTTTAA
6BF      ATTGTCGTTCTATAAAAAAATATGTGATAAAAATATCTATTGTGATGGAAGTTGTTTTAA
6BSP     ATTGTCGTTCTATAAAAAAATATGTGATAAAAATATCTATTGTGATGGAAGTTGTTTTAA
19AH     ATTGTCGTTCTATAAAAAAATATGTGATAAAAATATCTATTGTGATGGAAGTTGTTTTAA
23FPO    ATTGTCGTTCTATAAAAAAATATGTGATAAAAATATCTATTGTGATGGAAGTTGTTTTAA
19FTW    ATTGTCGTTCTATAAAAAAATATGTGATAAAAATATCTATTGTGATGGAAGTTGTTTTAA
9VSP     ATTGTCGTTCTATAAAAAAATATGTGATAAAAATATCTATTGTGATGGAAGTTGTTTTAA
TIGR4    ATTGTCGTTCTATAAAAAAATATGTGATAAAAATATCTATTGTGATGGAAGTTGTTTTAA
23FTW    ATTGTCGTTCTATAAAAAAATATGTGATAAAAATATCTATTGTGATGGAAGTTGTTTTAA
         ************************************************************

14CSR    TTTATACTAGGATAGTTAATAGTAATACTATACTATACTATATTGTATACAAGTGTGTCA
670      TTTATACTAGGATAGTTAATAGTAATACTATACTATACTATATTGTATACAAGTGTGTCA
6BF      TTTATACTAGGATAGTTAATAGTAATACTATACTATACTATATTGTATACAAGTGTGTCA
6BSP     TTTATACTAGGATAGTTAATAGTAATACTATACTATACTATATTGTATACAAGTGTGTCA
19AH     TTTATACTAGGATAGTTAATAGTAATACTATACTATACTATATTGTATACAAGTGTGTCA
23FPO    TTTATACTAGGATAGTTAATAGTAATACTATACTATACTATATTGTATACAAGTGTGTCA
19FTW    TTTATACTAGGATAGTTAATAGTAATACTATACTATACTATATTGTATACAAGTGTGTCA
9VSP     TTTATACTAGGATAGTTAATAGTAATACTATACTATACTATATTGTATACAAGTGTGTCA
TIGR4    TTTATACTAGGATAGTTAATAGTAATACTATACTATACTATATTGTATACAAGTGTGTCA
23FTW    TTTATACTAGGATAGTTAATAGTAATACTATACTA-----TATTGTATACAAGTGTGTCA
         ***********************************     *******************
```

Figure 196G

```
14CSR    TTGCCAGGTTGAGAAGATAGCTATAACGCACTTTTATACGCTTTTGCTACGTTTGTTAGT
670      TTGCCAGGTTGAGAAGATAGCTATAACGCACTTTTATACGCTTTTGCTACGTTTGTTAGT
6BF      TTGCCAGGTTGAGAAGATAGCTATAACGCACTTTTATACGCTTTTGCTACGTTTGTTAGT
6BSP     TTGCCAGGTTGAGAAGATAGCTATAACGCACTTTTATACGCTTTTGCTACGTTTGTTAGT
19AH     TTGCCAGGTTGAGAAGATAGCTATAACGCACTTTTATACGCTTTTGCTACGTTTGTTAGT
23FPO    TTGCCAGGTTGAGAAGATAGCTATAACGCACTTTTATACGCTTTTGCTACGTTTGTTAGT
19FTW    TTGCCAGGTTGAGAAGATAGCTATAACGCACTTTTATACGCTTTTGCTACGTTTGTTAGT
9VSP     TTGCCAGGTTGAGAAGATAGCTATAACGCACTTTTATACGCTTTTGCTACGTTTGTTAGT
TIGR4    TTGCCAGGTTGAGAAGATAGCTATAACGCACTTTTATACGCTTTTGCTACGTTTGTTAGT
23FTW    TTGCCAGGTTGAGAAGATAGCTATAACGCACTTTTATACGCTTTTGCTACGTTTGTTAGT
         ************************************************************

14CSR    GAACGGATTAACTCAG--TGAGATAAATTTTATCAGAACATAAGTAATCCGTTTCTTCGT
670      GAACGGATTAACTCAG--TGAGATAAATTTTATCAGAACATAAGTAATCCGTTTCTTCGT
6BF      GAACGGATTAACTCAG--TGAGATAAATTTTATCAGAACATAAGTAATCCGTTTCTTCGT
6BSP     GAACGGATTAACTCAG--TGAGATAAATTTTATCAGAACATAAGTAATCCGTTTCTTCGT
19AH     GAACGGATTAACTCAGCATGAGATAAATTTTATCAGAA--TAAGTAATCCGTTTCTTCGT
23FPO    GAACGGATTAACTCAGCATGAGATAAATTTTATCAGAA--TAAGTAATCCGTTTCTTCGT
19FTW    GAACGGATTAACTCAG--TGAGATAAATTTTATCAGAACATAAGTAATCCGTTTCTTCGT
9VSP     GAACGGATTAACTCAG--TGAGATAAATTTTATCAGAACATAAGTAATCCGTTTCTTCGT
TIGR4    GAACGGATTAACTCAG--TGAGATAAATTTTATCAGAACATAAGTAATCCGTTTCTTCGT
23FTW    GAACGGATTAACTCAG--TGAGATAAATTTTATCAGAACATAAGTAATCCGTTTCTTCGT
         ****************  ********************  ********************

14CSR    GTATACAGATTGAAAGTACCTATGAATCATAGAAGGATTAACTTGTTCTATGAATAATGC
670      GTATACAGATTGAAAGTACCTATGAATCATAGAAGGATTAACTTGTTCTATGAATAATGC
6BF      GTATACAGATTGAAAGTACCTATGAATCATAGAAGGATTAACTTGTTCTATGAATAATGC
6BSP     GTATACAGATTGAAAGTACCTATGAATCATAGAAGGATTAACTTGTTCTATGAATAATGC
19AH     GTATACAGATTGAAAGTACCTATGAATCATAGAAGGATTAACTTGTTCTATGAATAATGC
23FPO    GTATACAGATTGAAAGTACCTATGAATCATAGAAGGATTAACTTGTTCTATGAATAATGC
19FTW    GTATACAGATTGAAAGTACCTATGAATCATAGAAGGATTAACTTGTTCTATGAATAATGC
9VSP     GTATACAGATTGAAAGTACCTATGAATCATAGAAGGATTAACTTGTTCTATGAATAATGC
TIGR4    GTATACAGATTGAAAGTACCTATGAATCATAGAAGGATTAACTTGTTCTATGAATAATGC
23FTW    GTATACAGATTGAAAGTACCTATGAATCATAGAAGGATTAACTTGTTCTATGAATAATGC
         ************************************************************

14CSR    TTAACAGGGAGACACACATGAAAAAAGTAAGAAAGATATTTCAGAAGGCAGTTGCAGGAC
670      TTAACAGGGAGACACACATGAAAAAAGTAAGAAAGATATTTCAGAAGGCAGTTGCAGGAC
6BF      TTAACAGGGAGACACACATGAAAAAAGTAAGAAAGATATTTCAGAAGGCAGTTGCAGGAC
6BSP     TTAACAGGGAGACACACATGAAAAAAGTAAGAAAGATATTTCAGAAGGCAGTTGCAGGAC
19AH     TTAACAGGGAGACACACATGAAAAAAGTAAGAAAGATATTTCAGAAGGCAGTTGCAGGAC
23FPO    TTAACAGGGAGACACACATGAAAAAAGTAAGAAAGATATTTCAGAAGGCAGTTGCAGGAC
19FTW    TTAACAGGGAGACACACATGAAAAAAGTAAGAAAGATATTTCAGAAGGCAGTTGCAGGAC
9VSP     TTAACAGGGAGACACACATGAAAAAAGTAAGAAAGATATTTCAGAAGGCAGTTGCAGGAC
TIGR4    TTAACAGGGAGACACACATGAAAAAAGTAAGAAAGATATTTCAGAAGGCAGTTGCAGGAC
23FTW    TTAACAGGGAGACACACATGAAAAAAGTAAGAAAGATATTTCAGAAGGCAGTTGCAGGAC
         ************************************************************

14CSR    TGTGCTGTATATCTCAGTTGACAGCTTTTTCTTCGATAGTTGCTTTAGCAGAAACGCCTG
670      TGTGCTGTATATCTCAGTTGACAGCTTTTTCTTCGATAGTTGCTTTAGCAGAAACGCCTG
6BF      TGTGCTGTATATCTCAGTTGACAGCTTTTTCTTCGATAGTTGCTTTAGCAGAAACGCCTG
6BSP     TGTGCTGTATATCTCAGTTGACAGCTTTTTCTTCGATAGTTGCTTTAGCAGAAACGCCTG
19AH     TGTGCTGTATATCTCAGTTGACAGCTTTTTCTTCGATAGTTGCTTTAGCAGAAACGCCTG
23FPO    TGTGCTGTATATCTCAGTTGACAGCTTTTTCTTCGATAGTTGCTTTAGCAGAAACGCCTG
19FTW    TGTGCTGTATATCTCAGTTGACAGCTTTTTCTTCGATAGTTGCTTTAGCAGAAACGCCTG
9VSP     TGTGCTGTATATCTCAGTTGACAGCTTTTTCTTCGATAGTTGCTTTAGCAGAAACGCCTG
TIGR4    TGTGCTGTATATCTCAGTTGACAGCTTTTTCTTCGATAGTTGCTTTAGCAGAAACGCCTG
23FTW    TGTGCTGTATATCTCAGTTGACAGCTTTTTCTTCGATAGTTGCTTTAGCAGAAACGCCTG
         ************************************************************
```

Figure 196H

```
14CSR    AAACCAGTCCAGCGATAGGAAAAGTAGTGATTAAGGAGACAGGCGAAGGAGGAGCGCTTC
670      AAACCAGTCCAGCGATAGGAAAAGTAGTGATTAAGGAGACAGGCGAAGGAGGAGCGCTTC
6BF      AAACCAGTCCAGCGATAGGAAAAGTAGTGATTAAGGAGACAGGCGAAGGAGGAGCGCTTC
6BSP     AAACCAGTCCAGCGATAGGAAAAGTAGTGATTAAGGAGACAGGCGAAGGAGGAGCGCTTC
19AH     AAACCAGTCCAGCGATAGGAAAAGTAGTGATTAAGGAGACAGGCGAAGGAGGAGCGCTTC
23FPO    AAACCAGTCCAGCGATAGGAAAAGTAGTGATTAAGGAGACAGGCGAAGGAGGAGCGCTTC
19FTW    AAACCAGTCCAGCGATAGGAAAAGTAGTGATTAAGGAGACAGGCGAAGGAGGAGCGCTTC
9VSP     AAACCAGTCCAGCGATAGGAAAAGTAGTGATTAAGGAGACAGGCGAAGGAGGAGCGCTTC
TIGR4    AAACCAGTCCAGCGATAGGAAAAGTAGTGATTAAGGAGACAGGCGAAGGAGGAGCGCTTC
23FTW    AAACCAGTCCAGCGATAGGAAAAGTAGTGATTAAGGAGACAGGCGAAGGAGGAGCGCTTC
         ************************************************************

14CSR    TAGGAGATGCCGTCTTTGAGTTGAAAAACAATACGGATGGCACAACTGTTTCGCAAAGGA
670      TAGGAGATGCCGTCTTTGAGTTGAAAAACAATACGGATGGCACAACTGTTTCGCAAAGGA
6BF      TAGGAGATGCCGTCTTTGAGTTGAAAAACAATACGGATGGCACAACTGTTTCGCAAAGGA
6BSP     TAGGAGATGCCGTCTTTGAGTTGAAAAACAATACGGATGGCACAACTGTTTCGCAAAGGA
19AH     TAGGAGATGCCGTCTTTGAGTTGAAAAACAATACGGATGGCACAACTGTTTCGCAAAGGA
23FPO    TAGGAGATGCCGTCTTTGAGTTGAAAAACAATACGGATGGCACAACTGTTTCGCAAAGGA
19FTW    TAGGAGATGCCGTCTTTGAGTTGAAAAACAATACGGATGGCACAACTGTTTCGCAAAGGA
9VSP     TAGGAGATGCCGTCTTTGAGTTGAAAAACAATACGAATGGCACAACTGTTTCGCAAAGGA
TIGR4    TAGGAGATGCCGTCTTTGAGTTGAAAAACAATACGGATGGCACAACTGTTTCGCAAAGGA
23FTW    TAGGAGATGCCGTCTTTGAGTTGAAAAACAATACGGATGGCACAACTGTTTCGCAAAGGA
         *********************************** ************************

14CSR    CAGAGGCGCAAACAGGAGAAGCGATATTTTCAAACATAAAACCTGGGACATACACCTTGA
670      CAGAGGCGCAAACAGGAGAAGCGATATTTTCAAACATAAAACCTGGGACATACACCTTGA
6BF      CAGAGGCGCAAACAGGAGAAGCGATATTTTCAAACATAAAACCTGGGACATACACCTTGA
6BSP     CAGAGGCGCAAACAGGAGAAGCGATATTTTCAAACATAAAACCTGGGACATACACCTTGA
19AH     CAGAGGCGCAAACAGGAGAAGCGATATTTTCAAACATAAAACCTGGGACATACACCTTGA
23FPO    CAGAGGCGCAAACAGGAGAAGCGATATTTTCAAACATAAAACCTGGGACATACACCTTGA
19FTW    CAGAGGCGCAAACAGGAGAAGCGATATTTTCAAACATAAAACCTGGGACATACACCTTGA
9VSP     CAGAGGCGCAAACAGGAGAAGCGATATTTTCAAACATAAAACCTGGGACATACACCTTGA
TIGR4    CAGAGGCGCAAACAGGAGAAGCGATATTTTCAAACATAAAACCTGGGACATACACCTTGA
23FTW    CAGAGGCGCAAACAGGAGAAGCGATATTTTCAAACATAAAACCTGGGACATACACCTTGA
         ************************************************************

14CSR    CAGAAGCCCAACCTCCAGTTGGTTATAAACCCTCTACTAAACAATGGACTGTTGAAGTTG
670      CAGAAGCCCAACCTCCAGTTGGTTATAAACCCTCTACTAAACAATGGACTGTTGAAGTTG
6BF      CAGAAGCCCAACCTCCAGTTGGTTATAAACCCTCTACTAAACAATGGACTGTTGAAGTTG
6BSP     CAGAAGCCCAACCTCCAGTTGGTTATAAACCCTCTACTAAACAATGGACTGTTGAAGTTG
19AH     CAGAAGCCCAACCTCCAGTTGGTTATAAACCCTCTACTAAACAATGGACTGTTGAAGTTG
23FPO    CAGAAGCCCAACCTCCAGTTGGTTATAAACCCTCTACTAAACAATGGACTGTTGAAGTTG
19FTW    CAGAAGCCCAACCTCCAGTTGGTTATAAACCCTCTACTAAACAATGGACTGTTGAAGTTG
9VSP     CAGAAGCCCAACCTCCAGTTGGTTATAAACCCTCTACTAAACAACGGACTGTTGAAGTTG
TIGR4    CAGAAGCCCAACCTCCAGTTGGTTATAAACCCTCTACTAAACAATGGACTGTTGAAGTTG
23FTW    CAGAAGCCCAACCTCCAGTTGGTTATAAACCCTCTACTAAACAATGGACTGTTGAAGTTG
         ******************************************** ***************

14CSR    AGAAGAATGGTCGGACGACTGTCCAAGGTGAACAGGTAGAAAATCGAGAAGAGGCTCTAT
670      AGAAGAATGGTCGGACGACTGTCCAAGGTGAACAGGTAGAAAATCGAGAAGAGGCTCTAT
6BF      AGAAGAATGGTCGGACGACTGTCCAAGGTGAACAGGTAGAAAATCGAGAAGAGGCTCTAT
6BSP     AGAAGAATGGTCGGACGACTGTCCAAGGTGAACAGGTAGAAAATCGAGAAGAGGCTCTAT
19AH     AGAAGAATGGTCGGACGACTGTCCAAGGTGAACAGGTAGAAAATCGAGAAGAGGCTCTAT
23FPO    AGAAGAATGGTCGGACGACTGTCCAAGGTGAACAGGTAGAAAATCGAGAAGAGGCTCTAT
19FTW    AGAAGAATGGTCGGACGACTGTCCAAGGTGAACAGGTAGAAAATCGAGAAGAGGCTCTAT
9VSP     AGAAGAATGGTCGGACGACTGTCCAAGGTGAACAGGTAGAAAATCGAGAAGAGGCTCTAT
TIGR4    AGAAGAATGGTCGGACGACTGTCCAAGGTGAACAGGTAGAAAATCGAGAAGAGGCTCTAT
23FTW    AGAAGAATGGTCGGACGACTGTCCAAGGTGAACAGGTAGAAAATCGAGAAGAGGCTCTAT
         ************************************************************
```

Figure 196I

```
14CSR    CTGACCAGTATCCACAAACAGGGACTTATCCAGATGTTCAAACACCTTATCAGATTATTA
670      CTGACCAGTATCCACAAACAGGGACTTATCCAGATGTTCAAACACCTTATCAGATTATTA
6BF      CTGACCAGTATCCACAAACAGGGACTTATCCAGATGTTCAAACACCTTATCAGATTATTA
6BSP     CTGACCAGTATCCACAAACAGGGACTTATCCAGATGTTCAAACACCTTATCAGATTATTA
19AH     CTGACCAGTATCCACAAACAGGGACTTATCCAGATGTTCAAACACCTTATCAGATTATTA
23FPO    CTGACCAGTATCCACAAACAGGGACTTATCCAGATGTTCAAACACCTTATCAGATTATTA
19FTW    CTGACCAGTATCCACAAACAGGGACTTATCCAGATGTTCAAACACCTTATCAGATTATTA
9VSP     CTGACCAGTATCCACAAACAGGGACTTATCCAGATGTTCAAACACCTTATCAGATTATTA
TIGR4    CTGACCAGTATCCACAAACAGGGACTTATCCAGATGTTCAAACACCTTATCAGATTATTA
23FTW    CTGACCAGTATCCACAAACAGGGACTTATCCAGATGTTCAAACACCTTATCAGATTATTA
         ************************************************************

14CSR    AGGTAGATGGTTCGGAAAAAAACGGACAGCACAAGGCGTTGAATCCGAATCCATATGAAC
670      AGGTAGATGGTTCGGAAAAAAACGGACAGCACAAGGCGTTGAATCCGAATCCATATGAAC
6BF      AGGTAGATGGTTCGGAAAAAAACGGACAGCACAAGGCGTTGAATCCGAATCCATATGAAC
6BSP     AGGTAGATGGTTCGGAAAAAAACGGACAGCACAAGGCGTTGAATCCGAATCCATATGAAC
19AH     AGGTAGATGGTTCGGAAAAAAACGGACAGCACAAGGCGTTGAATCCGAATCCATATGAAC
23FPO    AGGTAGATGGTTCGGAAAAAAACGGACAGCACAAGGCGTTGAATCCGAATCCATATGAAC
19FTW    AGGTAGATGGTTCGGAAAAAAACGGACAGCACAAGGCGTTGAATCCGAATCCATATGAAC
9VSP     AGGTAGATGGTTCGGAAAAAAACGGACAGCACAAGGCGTTGAATCCGAATCCATATGAAC
TIGR4    AGGTAGATGGTTCGGAAAAAAACGGACAGCACAAGGCGTTGAATCCGAATCCATATGAAC
23FTW    AGGTAGATGGTTCGGAAAAAAACGGACAGCACAAGGCGTTGAATCCGAATCCATATGAAC
         ************************************************************

14CSR    GTGTGATTCCAGAAGGTACACTTTCAAAGAGAATTTATCAAGTGAATAATTTGGATGATA
670      GTGTGATTCCAGAAGGTACACTTTCAAAGAGAATTTATCAAGTGAATAATTTGGATGATA
6BF      GTGTGATTCCAGAAGGTACACTTTCAAAGAGAATTTATCAAGTGAATAATTTGGATGATA
6BSP     GTGTGATTCCAGAAGGTACACTTTCAAAGAGAATTTATCAAGTGAATAATTTGGATGATA
19AH     GTGTGATTCCAGAAGGTACACTTTCAAAGAGAATTTATCAAGTGAATAATTTGGATGATA
23FPO    GTGTGATTCCAGAAGGTACACTTTCAAAGAGAATTTATCAAGTGAATAATTTGGATGATA
19FTW    GTGTGATTCCAGAAGGTACACTTTCAAAGAGAATTTATCAAGTGAATAATTTGGATGATA
9VSP     GTGTGATTCCAGAAGGTACACTTTCAAAGAGAATTTATCAAGTGAATAATTTGGATGATA
TIGR4    GTGTGATTCCAGAAGGTACACTTTCAAAGAGAATTTATCAAGTGAATAATTTGGATGATA
23FTW    GTGTGATTCCAGAAGGTACACTTTCAAAGAGAATTTATCAAGTGAATAATTTGGATGATA
         ************************************************************

14CSR    ACCAATATGGAATCGAGTTGACGGTTAGTGGTAAAACGACGGTTGAAACGAAAGAAGCCT
670      ACCAATATGGAATCGAGTTGACGGTTAGTGGTAAAACGACGGTTGAAACGAAAGAAGCCT
6BF      ACCAATATGGAATCGAGTTGACGGTTAGTGGTAAAACGACGGTTGAAACGAAAGAAGCCT
6BSP     ACCAATATGGAATCGAGTTGACGGTTAGTGGTAAAACGACGGTTGAAACGAAAGAAGCCT
19AH     ACCAATATGGAATCGAGTTGACGGTTAGTGGTAAAACGACGGTTGAAACGAAAGAAGCCT
23FPO    ACCAATATGGAATCGAGTTGACGGTTAGTGGTAAAACGACGGTTGAAACGAAAGAAGCCT
19FTW    ACCAATATGGAATCGAATTGACGGTTAGTGGGAAAACAGTGTATGAACGAAAAGATAAGT
9VSP     ACCAATATGGAATCGAATTGACGGTTAGTGGGAAAACAGTGTATGAACGAAAAGATAAGT
TIGR4    ACCAATATGGAATCGAATTGACGGTTAGTGGGAAAACAGTGTATGAACAAAAAGATAAGT
23FTW    ACCAATATGGAATCGAATTGACGGTTAGTGGGAAAACAGTGTATGAACAAAAAGATAAGT
         **************** **************     *****   *  ****   *****    *

14CSR    CTACTCCGCTAGATGTTGTTATTCTATTAGATAACTCCAATAGTATGAGTAATATTCGAC
670      CTACTCCGCTAGATGTTGTTATTCTATTAGATAACTCCAATAGTATGAGTAATATTCGAC
6BF      CTACTCCGCTAGATGTTGTTATTCTATTAGATAACTCCAATAGTATGAGTAATATTCGAC
6BSP     CTACTCCGCTAGATGTTGTTATTCTATTAGATAACTCCAATAGTATGAGTAATATTCGAC
19AH     CTACTCCGCTAGATGTTGTTATTCTATTAGATAACTCCAATAGTATGAGTAATATTCGAC
23FPO    CTACTCCGCTAGATGTTGTTATTCTATTAGATAACTCCAATAGTATGAGTAATATTCGAC
19FTW    CTGTGCCGCTGGATGTCGTTATCTTGCTCGATAACTCAAATAGTATGAGTAACATTCGAA
9VSP     CTGTGCCGCTGGATGTCGTTATCTTGCTCGATAACTCAAATAGTATGAGTAACATTCGAA
TIGR4    CTGTGCCGCTGGATGTCGTTATCTTGCTCGATAACTCAAATAGTATGAGTAACATTCGAA
23FTW    CTGTGCCGCTGGATGTCGTTATCTTGCTCGATAACTCAAATAGTATGAGTAACATTCGAA
         **   ***** ***** *****  *  *  ******** ************** ****** 
```

Figure 196J

```
14CSR     ATAATCATGCCCATCGAGCGGAAAAAGCGGGAGAAGCGACACGAGCCCTTGTAGATAAGA
670       ATAATCATGCCCATCGAGCGGAAAAAGCGGGAGAAGCGACACGAGCCCTTGTAGATAAGA
6BF       ATAATCATGCCCATCGAGCGGAAAAAGCGGGAGAAGCGACACGAGCCCTTGTAGATAAGA
6BSP      ATAATCATGCCCATCGAGCGGAAAAAGCGGGAGAAGCGACACGAGCCCTTGTAGATAAGA
19AH      ATAATCATGCCCATCGAGCGGAAAAAGCGGGAGAAGCGACACGAGCCCTTGTAGATAAGA
23FPO     ATAATCATGCCCATCGAGCGGAAAAAGCGGGAGAAGCGACACGAGCCCTTGTAGATAAGA
19FTW     ACAAGAATGCTCGACGTGCGGAAAGAGCTGGTGAGGCGACACGTTCTCTTATTGATAAAA
9VSP      ACAAGAATGCTCGACGTGCGGAAAGAGCTGGTGAGGCGACACGTTCTCTTATTGATAAAA
TIGR4     ACAAGAATGCTCGACGTGCGGAAAGAGCTGGTGAGGCGACACGTTCTCTTATTGATAAAA
23FTW     ACAAGAATGCTCGACGTGCGGAAAGAGCTGGTGAGGCGACACGTTCTCTTATTGATAAAA
          * **  **** *  ** ******* *** ** ** ********  * *** * ***** *

14CSR     TTACCTCCAATCCAGATAATCGAGTAGCACTTGTGACTTATGGCTCAACTATCTTTGACG
670       TTACCTCCAATCCAGATAATCGAGTAGCACTTGTGACTTATGGCTCAACTATCTTTGACG
6BF       TTACCTCCAATCCAGATAATCGAGTAGCACTTGTGACTTATGGCTCAACTATCTTTGACG
6BSP      TTACCTCCAATCCAGATAATCGAGTAGCACTTGTGACTTATGGCTCAACTATCTTTGACG
19AH      TTACCTCCAATCCAGATAATCGAGTAGCACTTGTGACTTATGGCTCAACTATCTTTGACG
23FPO     TTACCTCCAATCCAGATAATCGAGTAGCACTTGTGACTTATGGCTCAACTATCTTTGACG
19FTW     TTACATCTGATCCAGAAAATAGGGTAGCGCTTGTGACTTATGCTTCCACTATCTTTGATG
9VSP      TTACATCTGATCCAGAAAATAGGGTAGCGCTTGTGACTTATGCTTCCACTATCTTTGATG
TIGR4     TTACATCTGATTCAGAAAATAGGGTAGCGCTTGTGACTTATGCTTCCACTATCTTTGATG
23FTW     TTACATCTGATCCAGAAAATAGGGTAGCGCTTGTGACTTATGCTTCCACTATCTTTGATG
          **** **  ** **** *** * ***** *************  ** *********** *

14CSR     GTTCAGAAGCTACTGTGGAAAAAGGGGTAGCAGATGCGAACGGAAAAATATTGAATGACT
670       GTTCAGAAGCTACTGTGGAAAAAGGGGTAGCAGATGCGAACGGAAAAATATTGAATGACT
6BF       GTTCAGAAGCTACTGTGGAAAAAGGGGTAGCAGATGCGAACGGAAAAATATTGAATGACT
6BSP      GTTCAGAAGCTACTGTGGAAAAAGGGGTAGCAGATGCGAACGGAAAAATATTGAATGACT
19AH      GTTCAGAAGCTACTGTGGAAAAAGGGGTAGCAGATGCGAACGGAAAAATATTGAATGACT
23FPO     GTTCAGAAGCTACTGTGGAAAAAGGGGTAGCAGATGCGAACGGAAAAATATTGAATGACT
19FTW     GGACCGAGTTTACAGTAGAAAAAGGGGTAGCAGATAAAAACGGAAAACGATTGAATGATT
9VSP      GGACCGAGTTTACAGTAGAAAAAGGGGTAGCAGATAAAAACGGAAAACGATTGAATGATT
TIGR4     GGACCGAGTTTACAGTAGAAAAAGGGGTAGCAGATAAAAACGGAAAGCGATTGAATGATT
23FTW     GGACCGAGTTTACAGTAGAAAAAGGGGTAGCAGATAAAAACGGAAAACGATTGAATGATT
          *  * **   *** ** ******************   ********   ********* *

14CSR     CAGCTTTATGGACGTTCGATCGTACGACGTTTACAGCTAAAACTTATAATTATAGCTTTT
670       CAGCTTTATGGACGTTCGATCGTACGACGTTTACAGCTAAAACTTATAATTATAGCTTTT
6BF       CAGCTTTATGGACGTTCGATCGTACGACGTTTACAGCTAAAACTTATAATTATAGCTTTT
6BSP      CAGCTTTATGGACGTTCGATCGTACGACGTTTACAGCTAAAACTTATAATTATAGCTTTT
19AH      CAGCTTTATGGACGTTCGATCGTACGACGTTTACAGCTAAAACTTATAATTATAGCTTTT
23FPO     CAGCTTTATGGACGTTCGATCGTACGACGTTTACAGCTAAAACTTATAATTATAGCTTTT
19FTW     CTCTTTTTTGGAATTATGATCAGACGAGTTTTACAACCAATACCAAAGATTATAGTTATT
9VSP      CTCTTTTTTGGAATTATGATCAGACGAGTTTTACAACCAATACCAAAGATTATAGTTATT
TIGR4     CTCTTTTTTGGAATTATGATCAGACGAGTTTTACAACCAATACCAAAGATTATAGTTATT
23FTW     CTCTTTTTTGGAATTATGATCAGACGAGTTTTACAACCAATACCAAAGATTATAGTTATT
          *   *** ****  *  ****  ****  ****** * ** **  *  ******* * **

14CSR     TAAATCTCACATCAGATCCTACTGATATTCAAACTATTAAGGATAGGATTCCATCAGATG
670       TAAATCTCACATCAGATCCTACTGATATTCAAACTATTAAGGATAGGATTCCATCAGATG
6BF       TAAATCTCACATCAGATCCTACTGATATTCAAACTATTAAGGATAGGATTCCATCAGATG
6BSP      TAAATCTCACATCAGATCCTACTGATATTCAAACTATTAAGGATAGGATTCCATCAGATG
19AH      TAAATCTCACATCAGATCCTACTGATATTCAAACTATTAAGGATAGGATTCCATCAGATG
23FPO     TAAATCTCACATCAGATCCTACTGATATTCAAACTATTAAGGATAGGATTCCATCAGATG
19FTW     TAAAGCTGACTAATGATAAGAATGACATTGTAGAATTAAAAAATAAGGTACCTACCGAGG
9VSP      TAAAGCTGACTAATGATAAGAATGACATTGTAGAATTAAAAAATAAGGTACCTACCGAGG
TIGR4     TAAAGCTGACTAATGATAAGAATGACATTGTAGAATTAAAAAATAAGGTACCTACCGAGG
23FTW     TAAAGCTGACTAATGATAAGAATGACATTGTAGAATTAAAAAATAAGGTACCTACCGAGG
          **** ** **    ***   * *** ***  *    * **  *** * * **  * ** *
```

Figure 196K

```
14CSR    CAGAGGAATTGAACAAAGACAAATTGATGTATCAATTCGGCGCGACTTTTACCCAGAAGG
670      CAGAGGAATTGAACAAAGACAAATTGATGTATCAATTCGGCGCGACTTTTACCCAGAAGG
6BF      CAGAGGAATTGAACAAAGACAAATTGATGTATCAATTCGGCGCGACTTTTACCCAGAAGG
6BSP     CAGAGGAATTGAACAAAGACAAATTGATGTATCAATTCGGCGCGACTTTTACCCAGAAGG
19AH     CAGAGGAATTGAACAAAGACAAATTGATGTATCAATTCGGCGCGACTTTTACCCAGAAGG
23FPO    CAGAGGAATTGAACAAAGACAAATTGATGTATCAATTCGGCGCGACTTTTACCCAGAAGG
19FTW    CAGAAGATCATGATGGAAATAGATTGATGTACCAATTCGGTGCCACTTTTACTCAGAAAG
9VSP     CAGAAGACCATGATGGAAATAGATTGATGTACCAATTCGGTGCCACTTTTACTCAGAAAG
TIGR4    CAGAAGACCATGATGGAAATAGATTGATGTACCAATTCGGTGCCACTTTTACTCAGAAAG
23FTW    CAGAAGACCATGATGGAAATAGATTGATGTACCAATTCGGTGCCACTTTTACTCAGAAAG
         **** **     *   * * * ********* ******** ** ******** ***** *

14CSR    CTTTGATGACCGCTGATGATATCTTGACAAAGCAGGCAAGACCAAACAGTAAAAAGGTTA
670      CTTTGATGACCGCTGATGATATCTTGACAAAGCAGGCAAGACCAAACAGTAAAAAGGTTA
6BF      CTTTGATGACCGCTGATGATATCTTGACAAAGCAGGCAAGACCAAACAGTAAAAAGGTTA
6BSP     CTTTGATGACCGCTGATGATATCTTGACAAAGCAGGCAAGACCAAACAGTAAAAAGGTTA
19AH     CTTTGATGACCGCTGATGATATCTTGACAAAGCAGGCAAGACCAAACAGTAAAAAGGTTA
23FPO    CTTTGATGACCGCTGATGATATCTTGACAAAGCAGGCAAGACCAAACAGTAAAAAGGTTA
19FTW    CTTTGATGAAGGCAGATGAGATTTTGACACAACAAGCGAGACAAAATAGTCAAAAAGTCA
9VSP     CTTTGATGAAGGCCGATGAGATTTTGACACAACAAGCGAGACAAAATAGTCAAAAAGTCA
TIGR4    CTTTGATGAAGGCAGATGAGATTTTGACACAACAAGCGAGACAAAATAGTCAAAAAGTCA
23FTW    CTTTGATGAAGGCAGATGAGATTTTGACACAACAAGCGAGACAAAATAGTCAAAAAGTCA
         *********  ** ***** ** ****** * ** ** **** *** *** **** ** *

14CSR    TTTTCCACATTACAGATGGTGTTCCGACTATGTCATATCCAATTAATTTTAAATATACAG
670      TTTTCCACATTACAGATGGTGTTCCGACTATGTCATATCCAATTAATTTTAAATATACAG
6BF      TTTTCCACATTACAGATGGTGTTCCGACTATGTCATATCCAATTAATTTTAAATATACAG
6BSP     TTTTCCACATTACAGATGGTGTTCCGACTATGTCATATCCAATTAATTTTAAATATACAG
19AH     TTTTCCACATTACAGATGGTGTTCCGACTATGTCATATCCAATTAATTTTAAATATACAG
23FPO    TTTTCCACATTACAGATGGTGTTCCGACTATGTCATATCCAATTAATTTTAAATATACAG
19FTW    TTTTCCATATTACGGATGGTGTCCCAACTATGTCGTATCCGATTAATTTTAATCATGCTA
9VSP     TTTTCCATATTACGGATGGTGTCCCAACTATGTCGTATCCGATTAATTTTAATCATGCTA
TIGR4    TTTTCCATATTACGGATGGTGTCCCAACTATGTCGTATCCGATTAATTTTAATCATGCTA
23FTW    TTTTCCATATTACGGATGGTGTCCCAACTATGTCGTATCCGATTAATTTTAATCATGCTA
         ******* ***** ******** ** ******** ***** ***********  ** *

14CSR    GAACGACGCAATCGTACAGAACTCAGCTGAATA-ATTTTAAAGCAAAAACTCCAAATAGT
670      GAACGACGCAATCGTACAGAACTCAGCTGAATA-ATTTTAAAGCAAAAACTCCAAATAGT
6BF      GAACGACGCAATCGTACAGAACTCAGCTGAATA-ATTTTAAAGCAAAAACTCCAAATAGT
6BSP     GAACGACGCAATCGTACAGAACTCAGCTGAATA-ATTTTAAAGCAAAAACTCCAAATAGT
19AH     GAACGACGCAATCGTACAGAACTCAGCTGAATA-ATTTTAAAGCAAAAACTCCAAATAGT
23FPO    GAACGACGCAATCGTACAGAACTCAGCTGAATA-ATTTTAAAGCAAAAACTCCAAATAGT
19FTW    CGTTTGCTCCATCATATCAAAATCAACTAAATGCATTTTTTAGTAAAT-CTCCTAATAAA
9VSP     CGTTTGCTCCATCATATCAAAATCAACTAAATGTATTTTTTAGTAAAT-CTCCTAATAAA
TIGR4    CGTTTGCTCCATCATATCAAAATCAACTAAATGCATTTTTTAGTAAAT-CTCCTAATAAA
23FTW    CGTTTGCTCCATCATATCAAAATCAACTAAATGCATTTTTTAGTAAAT-CTCCTAATAAA
               * * *** **   ** *** ** ***  *****  ** ***  **** ****

14CSR    AGCGGGATATTACTGGAGGACTTTGTTACATGGTCAGCAGATGGTGAACATAAGATTGTT
670      AGCGGGATATTACTGGAGGACTTTGTTACATGGTCAGCAGATGGTGAACATAAGATTGTT
6BF      AGCGGGATATTACTGGAGGACTTTGTTACATGGTCAGCAGATGGTGAACATAAGATTGTT
6BSP     AGCGGGATATTACTGGAGGACTTTGTTACATGGTCAGCAGATGGTGAACATAAGATTGTT
19AH     AGCGGGATATTACTGGAGGACTTTGTTACATGGTCAGCAGATGGTGAACATAAGATTGTT
23FPO    AGCGGGATATTACTGGAGGACTTTGTTACATGGTCAGCAGATGGTGAACATAAGATTGTT
19FTW    GATGGAATACTATTAAGTGATTTTATTACGCAAGCAACTAGTGGAGAACATACAATTGTA
9VSP     GATGGAATACTATTAAGTGATTTTATTACGCAAGCAACTAGTGGAGAACATACAATTGTA
TIGR4    GATGGAATACTATTAAGTGATTTTATTACGCAAGCAACTAGTGGAGAACATACAATTGTA
23FTW    GATGGAATACTATTAAGTGATTTTATTACGCAAGCAACTAGTGGAGAACATACAATTGTA
            ** *** ** *    ** *** ****     ** *    *** *******  *****
```

Figure 196L

```
14CSR      CGTGGAGATGGTGAAAGTTATCAGATGTTTACGAAGAAACCTGT------AACAGACCAA
670        CGTGGAGATGGTGAAAGTTATCAGATGTTTACGAAGAAACCTGT------AACAGACCAA
6BF        CGTGGAGATGGTGAAAGTTATCAGATGTTTACGAAGAAACCTGT------AACAGACCAA
6BSP       CGTGGAGATGGTGAAAGTTATCAGATGTTTACGAAGAAACCTGT------AACAGACCAA
19AH       CGTGGAGATGGTGAAAGTTATCAGATGTTTACGAAGAAACCTGT------AACAGACCAA
23FPO      CGTGGAGATGGTGAAAGTTATCAGATGTTTACGAAGAAACCTGT------AACAGACCAA
19FTW      CGCGGAGATGGGCAAAGTTACCAGATGTTTACAGATAAGACAGTTTATGAAAAAGGTGCT
9VSP       CGCGGAGATGGGCAAAGTTACCAGATGTTTACAGATAAGACAGTTTATGAAAAAGGTGCT
TIGR4      CGCGGAGATGGGCAAAGTTACCAGATGTTTACAGATAAGACAGTTTATGAAAAAGGTGCT
23FTW      CGCGGAGATGGGCAAAGTTACCAGATGTTTACAGATAAGACAGTTTATGAAAAAGGTGCT
           ** ********  ******* ***********  * **  * **      ** **

14CSR      TACGGAGTTCATCAAAT---ACTTTCAATCACCTCCATGGAGCAGAGAGCTAAATTAGTT
670        TACGGAGTTCATCAAAT---ACTTTCAATCACCTCCATGGAGCAGAGAGCTAAATTAGTT
6BF        TACGGAGTTCATCAAAT---ACTTTCAATCACCTCCATGGAGCAGAGAGCTAAATTAGTT
6BSP       TACGGAGTTCATCAAAT---ACTTTCAATCACCTCCATGGAGCAGAGAGCTAAATTAGTT
19AH       TACGGAGTTCATCAAAT---ACTTTCAATCACCTCCATGGAGCAGAGAGCTAAATTAGTT
23FPO      TACGGAGTTCATCAAAT---ACTTTCAATCACCTCCATGGAGCAGAGAGCTAAATTAGTT
19FTW      CCTGCAGCTTTCCCAGTTAAACCTGAAAAATATTCTGAAATGAAGGCGGTTGGTTATGCA
9VSP       CCTGCAGCTTTCCCAGTTAAACCTGAAAAATATTCTGAAATGAAGGCGGTTGGTTATGCA
TIGR4      CCTGCAGCTTTCCCAGTTAAACCTGAAAAATATTCTGAAATGAAGGCGGCTGGTTATGCA
23FTW      CCTGCAGCTTTCCCAGTTAAACCTGAAAAATATTCTGAAATGAAGGCGGCTGGTTATGCA
              * ** *   * * *   ** *  **     **      * **   * *   *  *

14CSR      TCAGCGGGATATAGGTTCTATGGAACTGACTTGTATTTATATTGGCGTGATAGTATTCTA
670        TCAGCGGGATATAGGTTCTATGGAACTGACTTGTATTTATATTGGCGTGATAGTATTCTA
6BF        TCAGCGGGATATAGGTTCTATGGAACTGACTTGTATTTATATTGGCGTGATAGTATTCTA
6BSP       TCAGCGGGATATAGGTTCTATGGAACTGACTTGTATTTATATTGGCGTGATAGTATTCTA
19AH       TCAGCGGGATATAGGTTCTATGGAACTGACTTGTATTTATATTGGCGTGATAGTATTCTA
23FPO      TCAGCGGGATATAGGTTCTATGGAACTGACTTGTATTTATATTGGCGTGATAGTATTCTA
19FTW      GTTATAGGCGATCCAATTAATGGTGGATATATTTGGCTTAATTGGAGAGAGAGTATTCTG
9VSP       GTTATAGGCGATCCAATTAATGGTGGATATATTTGGCTTAATTGGAGAGAGAGTATTCTG
TIGR4      GTTATAGGCGATCCAATTAATGGTGGATATATTTGGCTTAATTGGAGAGAGAGTATTCTG
23FTW      GTTATAGGCGATCCAATTAATGGTGGATATATTTGGCTTAATTGGAGAGAGAGTATTCTG
                 **  **    *  ****     *  * *   *  ***** * ** ********

14CSR      GCCTATCCATTTAACTCTAGTACCGATTGGATTACCAACCATGGTGACCCTACGACTTGG
670        GCCTATCCATTTAACTCTAGTACCGATTGGATTACCAACCATGGTGACCCTACGACTTGG
6BF        GCCTATCCATTTAACTCTAGTACCGATTGGATTACCAACCATGGTGACCCTACGACTTGG
6BSP       GCCTATCCATTTAACTCTAGTACCGATTGGATTACCAACCATGGTGACCCTACGACTTGG
19AH       GCCTATCCATTTAACTCTAGTACCGATTGGATTACCAACCATGGTGACCCTACGACTTGG
23FPO      GCCTATCCATTTAACTCTAGTACCGATTGGATTACCAACCATGGTGACCCTACGACTTGG
19FTW      GCTTATCCGTTTAATTCTAATACTGCTAAAATTACCAATCATGGTGCCCCTACAAGATGG
9VSP       GCTTATCCGTTTAATTCTAATACTGCTAAAATTACCAATCATGGTGACCCTACAAGATGG
TIGR4      GCTTATCCGTTTAATTCTAATACTGCTAAAATTACCAATCATGGTGACCCTACAAGATGG
23FTW      GCTTATCCGTTTAATTCTAATACTGCTAAAATTACCAATCATGGTGACCCTACAAGATGG
           ** ***** ***** **** *** * *   ******** ******* ****** *  ***

14CSR      TATTATAACGGAAATATGGCTCAGGATGGCTATGATGTCTTCACTGTTGGGGTTGGTGTA
670        TATTATAACGGAAATATGGCTCAGGATGGCTATGATGTCTTCACTGTTGGGGTTGGTGTA
6BF        TATTATAACGGAAATATGGCTCAGGATGGCTATGATGTCTTCACTGTTGGGGTTGGTGTA
6BSP       TATTATAACGGAAATATGGCTCAGGATGGCTATGATGTCTTCACTGTTGGGGTTGGTGTA
19AH       TATTATAACGGAAATATGGCTCAGGATGGCTATGATGTCTTCACTGTTGGGGTTGGTGTA
23FPO      TATTATAACGGAAATATGGCTCAGGATGGCTATGATGTCTTCACTGTTGGGGTTGGTGTA
19FTW      TACTATAACGGGAATATTGCTCCTGATGGGTATGATGTCTTTACGGTAGGTATTGGTATT
9VSP       TACTATAACGGGAATATTGCTCCTGATGGGTATGATGTCTTTACGGTAGGTATTGGTATT
TIGR4      TACTATAACGGGAATATTGCTCCTGATGGGTATGATGTCTTTACGGTAGGTATTGGTATT
23FTW      TACTATAACGGGAATATTGCTCCTGATGGGTATGATGTCTTTACGGTAGGTATTGGTATT
           ** ******** ***** ****  ***** *********** ** ** **  ***** *
```

Figure 196M

```
14CSR    AACGGGGATCCTGGTACGGATGAAGCAACGGCTACTAGATTTATGCAGAGCATCTCTAGT
670      AACGGGGATCCTGGTACGGATGAAGCAACGGCTACTAGATTTATGCAGAGCATCTCTAGT
6BF      AACGGGGATCCTGGTACGGATGAAGCAACGGCTACTAGATTTATGCAGAGCATCTCTAGT
6BSP     AACGGGGATCCTGGTACGGATGAAGCAACGGCTACTAGATTTATGCAGAGCATCTCTAGT
19AH     AACGGGGATCCTGGTACGGATGAAGCAACGGCTACTAGATTTATGCAGAGCATCTCTAGT
23FPO    AACGGGGATCCTGGTACGGATGAAGCAACGGCTACTAGATTTATGCAGAGCATCTCTAGT
19FTW    AACGGAGATCCTGGTACGGATGAAGCAACGGCTACTAGTTTTATGCAAAGTATTTCTAGT
9VSP     AACGGAGATCCTGGTACGGATGAAGCAACGGCTACTAGTTTTATGCAAAGTATTTCTAGT
TIGR4    AACGGAGATCCTGGTACGGATGAAGCAACGGCTACTAGTTTTATGCAAAGTATTTCTAGT
23FTW    AACGGAGATCCTGGTACGGATGAAGCAACGGCTACTAGTTTTATGCAAAGTATTTCTAGT
         ***** ******************************** ******** ** ** ******

14CSR    TCTCCTGACAACTACACTAACGTAGCAGATCCATCTCAGATTTTACAAGAATTGAATCGC
670      TCTCCTGACAACTACACTAACGTAGCAGATCCATCTCAGATTTTACAAGAATTGAATCGC
6BF      TCTCCTGACAACTACACTAACGTAGCAGATCCATCTCAGATTTTACAAGAATTGAATCGC
6BSP     TCTCCTGACAACTACACTAACGTAGCAGATCCATCTCAGATTTTACAAGAATTGAATCGC
19AH     TCTCCTGACAACTACACTAACGTAGCAGATCCATCTCAGATTTTACAAGAATTGAATCGC
23FPO    TCTCCTGACAACTACACTAACGTAGCAGATCCATCTCAGATTTTACAAGAATTGAATCGC
19FTW    AAACCTGAAAACTATACCAATGTTACTGACACGACAAAAATATTGGAACAGTTGAATCGT
9VSP     AAACCTGAAAACTATACCAATGTTACTGACACGACAAAAATATTGGAACAGTTGAATCGT
TIGR4    AAACCTGAAAACTATACCAATGTTACTGACACGACAAAAATATTGGAACAGTTGAATCGT
23FTW    AAACCTGAAAACTATACCAATGTTACTGACACGACAAAAATATTGGAACAGTTGAATCGT
            ***** ***** ** ** **  * **  *  *  * ** **  ** * ******** 

14CSR    TACTTCTATACTATCGTCAATGAGAAGAAATCTATCGAAAATGGTACGATTACAGACCCG
670      TACTTCTATACTATCGTCAATGAGAAGAAATCTATCGAAAATGGTACGATTACAGACCCG
6BF      TACTTCTATACTATCGTCAATGAGAAGAAATCTATCGAAAATGGTACGATTACAGACCCG
6BSP     TACTTCTATACTATCGTCAATGAGAAGAAATCTATCGAAAATGGTACGATTACAGACCCG
19AH     TACTTCTATACTATCGTCAATGAGAAGAAATCTATCGAAAATGGTACGATTACAGACCCG
23FPO    TACTTCTATACTATCGTCAATGAGAAGAAATCTATCGAAAATGGTACGATTACAGACCCG
19FTW    TATTTCCACACCATCGTAACTGAAAAGAAATCAATTGAGAATGGTACGATTACAGATCCG
9VSP     TATTTCCACACCATCGTAACTGAAAAGAAATCAATTGAGAATGGTACGATTACAGATCCG
TIGR4    TATTTCCACACCATCGTAACTGAAAAGAAATCAATTGAGAATGGTACGATTACAGATCCG
23FTW    TATTTCCACACCATCGTAACTGAAAAGAAATCAATTGAGAATGGTACGATTACAGATCCG
         ** *** * ** ***** * *** ******** ** ** ***************** ***

14CSR    ATGGGTGAACTAATTGATTTCCAATTGGGAGCAGATGGAAGGTTTGATCCAGCGGATTAC
670      ATGGGTGAACTAATTGATTTCCAATTGGGAGCAGATGGAAGGTTTGATCCAGCGGATTAC
6BF      ATGGGTGAACTAATTGATTTCCAATTGGGAGCAGATGGAAGGTTTGATCCAGCGGATTAC
6BSP     ATGGGTGAACTAATTGATTTCCAATTGGGAGCAGATGGAAGGTTTGATCCAGCGGATTAC
19AH     ATGGGTGAACTAATTGATTTCCAATTGGGAGCAGATGGAAGGTTTGATCCAGCGGATTAC
23FPO    ATGGGTGAACTAATTGATTTCCAATTGGGAGCAGATGGAAGGTTTGATCCAGCGGATTAC
19FTW    ATGGGTGAGTTAATTGATTTGCAATTGGGCACAGATGGAAGATTTGATCCAGCAGATTAC
9VSP     ATGGGTGAGTTAATTGATTTGCAATTGGGCACAGATGGAAGATTTGATCCAGCAGATTAC
TIGR4    ATGGGTGAGTTAATTGATTTGCAATTGGGCACAGATGGAAGATTTGATCCAGCAGATTAC
23FTW    ATGGGTGAGTTAATTGATTTGCAATTGGGCACAGATGGAAGATTTGATCCAGCAGATTAC
         ********  ********** ********  ********** *********** ******

14CSR    ACTTTAACTGCAAACGATGGTAGTTCGTTGGTGAATAATGTCCCTACTGGGGGACCACAA
670      ACTTTAACTGCAAACGATGGTAGTTCGTTGGTGAATAATGTCCCTACTGGGGGACCACAA
6BF      ACTTTAACTGCAAACGATGGTAGTTCGTTGGTGAATAATGTCCCTACTGGGGGACCACAA
6BSP     ACTTTAACTGCAAACGATGGTAGTTCGTTGGTGAATAATGTCCCTACTGGGGGACCACAA
19AH     ACTTTAACTGCAAACGATGGTAGTTCGTTGGTGAATAATGTCCCTACTGGGGGACCACAA
23FPO    ACTTTAACTGCAAACGATGGTAGTTCGTTGGTGAATAATGTCCCTACTGGGGGACCACAA
19FTW    ACTTTAACTGCAAACGATGGTAGTCGCTTGGAGAATGGACAAGCTGTAGGTGGTCCACAA
9VSP     ACTTTAACTGCAAACGATGGTAGTCGCTTGGAGAATGGACAAGCTGTAGGTGGTCCACAA
TIGR4    ACTTTAACTGCAAACGATGGTAGTCGCTTGGAGAATGGACAAGCTGTAGGTGGTCCACAA
23FTW    ACTTTAACTGCAAACGATGGTAGTCGCTTGGAGAATGGACAAGCTGTAGGTGGTCCACAA
         ************************   **** ****       **   ** ** ******
```

Figure 196N

```
14CSR     AATGATGGTGGCTTGCTAAAAAATGCAAAAGTGTTCTATGATACGACTGAGAAAAGGATT
670       AATGATGGTGGCTTGCTAAAAAATGCAAAAGTGTTCTATGATACGACTGAGAAAAGGATT
6BF       AATGATGGTGGCTTGCTAAAAAATGCAAAAGTGTTCTATGATACGACTGAGAAAAGGATT
6BSP      AATGATGGTGGCTTGCTAAAAAATGCAAAAGTGTTCTATGATACGACTGAGAAAAGGATT
19AH      AATGATGGTGGCTTGCTAAAAAATGCAAAAGTGTTCTATGATACGACTGAGAAAAGGATT
23FPO     AATGATGGTGGCTTGCTAAAAAATGCAAAAGTGTTCTATGATACGACTGAGAAAAGGATT
19FTW     AATGATGGTGGCTTGCTAAAAAATGCAAAAGTGTTCTATGATACGACTGAGAAAAGGATT
9VSP      AATGATGGTGGCTTGCTAAAAAATGCAAAAGTGTTCTATGATACGACTGAGAAAAGGATT
TIGR4     AATGATGGTGGTTTGTTAAAAAATGCAAAAGTGCTCTATGATACGACTGAGAAAAGGATT
23FTW     AATGATGGTGGTTTGTTAAAAAATGCAAAAGTGCTCTATGATACGACTGAGAAAAGGATT
          *********** *** ***************** **************************

14CSR     CGTGTAACAGGTTTGTACCTTGGAACGGGTGAAAAAGTTACATTGACTTATAATGTTCGC
670       CGTGTAACAGGTTTGTACCTTGGAACGGGTGAAAAAGTTACATTGACTTATAATGTTCGC
6BF       CGTGTAACAGGTTTGTACCTTGGAACGGGTGAAAAAGTTACATTGACTTATAATGTTCGC
6BSP      CGTGTAACAGGTTTGTACCTTGGAACGGGTGAAAAAGTTACATTGACTTATAATGTTCGC
19AH      CGTGTAACAGGTTTGTACCTTGGAACGGGTGAAAAAGTTACATTGACTTATAATGTTCGC
23FPO     CGTGTAACAGGTTTGTACCTTGGAACGGGTGAAAAAGTTACATTGACTTATAATGTTCGC
19FTW     CGTGTAACAGGTTTGTACCTTGGAACGGGTGAAAAAGTTACATTGACTTATAATGTTCGC
9VSP      CGTGTAACAGGTTTGTACCTTGGAACGGGTGAAAAAGTTACATTGACTTATAATGTTCGC
TIGR4     CGTGTAACAGGTCTGTACCTTGGAACGGATGAAAAAGTTACGTTGACCTACAATGTTCGT
23FTW     CGTGTAACAGGTCTGTACCTTGGAACGGATGAAAAAGTTACGTTGACCTACAATGTTCGT
          ************ *************** ************ ***** ** ******** 

14CSR     TTGAATGACCAATTTGTAAGCAATAAATTCTATGACACGAATGGTCGAACAACCCTACAC
670       TTGAATGACCAATTTGTAAGCAATAAATTCTATGACACGAATGGTCGAACAACCCTACAC
6BF       TTGAATGACCAATTTGTAAGCAATAAATTCTATGACACGAATGGTCGAACAACCCTACAC
6BSP      TTGAATGACCAATTTGTAAGCAATAAATTCTATGACACGAATGGTCGAACAACCCTACAC
19AH      TTGAATGACCAATTTGTAAGCAATAAATTCTATGACACGAATGGTCGAACAACCCTACAC
23FPO     TTGAATGACCAATTTGTAAGCAATAAATTCTATGACACGAATGGTCGAACAACCCTACAC
19FTW     TTGAATGACCAATTTGTAAGCAATAAATTCTATGACACGAATGGTCGAACAACCCTACAC
9VSP      TTGAATGACCAATTTGTAAGCAATAAATTCTATGACACGAATGGTCGAACAACCCTACAC
TIGR4     TTGAATGATGAGTTTGTAAGCAATAAATTTTATGATACCAATGGTCGAACAACCTTACAT
23FTW     TTGAATGATGAGTTTGTAAGCAATAAATTTTATGATACCAATGGTCGAACAACCTTACAT
          ********  * ***************** ***** ** *************** **** 

14CSR     CCTAAGGAAGTAGAAAAGAACACAGTGCGCGACTTCCCGATTCCTAAGATTCGTGATGTA
670       CCTAAGGAAGTAGAAAAGAACACAGTGCGCGACTTCCCGATTCCTAAGATTCGTGATGTA
6BF       CCTAAGGAAGTAGAAAAGAACACAGTGCGCGACTTCCCGATTCCTAAGATTCGTGATGTA
6BSP      CCTAAGGAAGTAGAAAAGAACACAGTGCGCGACTTCCCGATTCCTAAGATTCGTGATGTA
19AH      CCTAAGGAAGTAGAAAAGAACACAGTGCGCGACTTCCCGATTCCTAAGATTCGTGATGTA
23FPO     CCTAAGGAAGTAGAAAAGAACACAGTGCGCGACTTCCCGATTCCTAAGATTCGTGATGTA
19FTW     CCTAAGGAAGTAGAAAAGAACACAGTGCGCGACTTCCCGATTCCTAAGATTCGTGATGTG
9VSP      CCTAAGGAAGTAGAAAAGAACACAGTGCGCGACTTCCCGATTCCTAAGATTCGTGATGTG
TIGR4     CCTAAGGAAGTAGAACAGAACACAGTGCGCGACTTCCCGATTCCTAAGATTCGTGATGTG
23FTW     CCTAAGGAAGTAGAACAGAACACAGTGCGCGACTTCCCGATTCCTAAGATTCGTGATGTG
          *************** *******************************************

14CSR     CGAAAGTATCCAGAAATCACAATTCCAAAAGAGAAAAAACTTGGTGAAATTGAGTTTATT
670       CGAAAGTATCCAGAAATCACAATTCCAAAAGAGAAAAAACTTGGTGAAATTGAGTTTATT
6BF       CGAAAGTATCCAGAAATCACAATTCCAAAAGAGAAAAAACTTGGTGAAATTGAGTTTATT
6BSP      CGAAAGTATCCAGAAATCACAATTCCAAAAGAGAAAAAACTTGGTGAAATTGAGTTTATT
19AH      CGAAAGTATCCAGAAATCACAATTCCAAAAGAGAAAAAACTTGGTGAAATTGAGTTTATT
23FPO     CGAAAGTATCCAGAAATCACAATTCCAAAAGAGAAAAAACTTGGTGAAATTGAGTTTATT
19FTW     CGAAAATATCCAGCAATTACGATTGCAAAAGAGAAAAAACTTGGTGAAATTGAGTTTATT
9VSP      CGAAAATATCCAGCAATTACGATTGCAAAAGAGAAAAAACTTGGTGAAATTGAGTTTATT
TIGR4     CGGAAGTATCCAGAAATCACAATTTCAAAAGAGAAAAAACTTGGTGACATTGAGTTTATT
23FTW     CGGAAGTATCCAGAAATCACAATTTCAAAAGAGAAAAAACTTGGTGACATTGAGTTTATT
          ** ** ******* *** ** *** ********************** ************
```

Figure 196O

```
14CSR     AAGATCAATAAGAATGATAAAAAACCACTGAGAGATGCGGTCTTTAGTCTTCAAAAACAA
670       AAGATCAATAAGAATGATAAAAAACCACTGAGAGATGCGGTCTTTAGTCTTCAAAAACAA
6BF       AAGATCAATAAGAATGATAAAAAACCACTGAGAGATGCGGTCTTTAGTCTTCAAAAACAA
6BSP      AAGATCAATAAGAATGATAAAAAACCACTGAGAGATGCGGTCTTTAGTCTTCAAAAACAA
19AH      AAGATCAATAAGAATGATAAAAAACCACTGAGAGATGCGGTCTTTAGTCTTCAAAAACAA
23FPO     AAGATCAATAAGAATGATAAAAAACCACTGAGAGATGCGGTCTTTAGTCTTCAAAAACAA
19FTW     AAGATCAATAAGAATGATAAAAAACCACTGAGAGATGCGGTCTTTAGTCTTCAAAAACAA
9VSP      AAGATCAATAAGAATGATAAAAAACCACTGAGAGATGCGGTCTTTAGTCTTCAAAAACAA
TIGR4     AAGGTCAATAAAAATGATAAAAAACCACTGAGAGGTGCGGTCTTTAGTCTTCAAAAACAA
23FTW     AAGGTCAATAAAAATGATAAAAAACCACTGAGAGATGCGGTCTTTAGTCTTCAAAAACAA
          *** ******* ********************** *************************

14CSR     CATCCGGATTATCCAGATATTTATGGAGCTATTGATCAAAATGGCACTTATCAAAATGTG
670       CATCCGGATTATCCAGATATTTATGGAGCTATTGATCAAAATGGCACTTATCAAAATGTG
6BF       CATCCGGATTATCCAGATATTTATGGAGCTATTGATCAAAATGGCACTTATCAAAATGTG
6BSP      CATCCGGATTATCCAGATATTTATGGAGCTATTGATCAAAATGGCACTTATCAAAATGTG
19AH      CATCCGGATTATCCAGATATTTATGGAGCTATTGATCAAAATGGCACTTATCAAAATGTG
23FPO     CATCCGGATTATCCAGATATTTATGGAGCTATTGATCAAAATGGCACTTATCAAAATGTG
19FTW     CATCCGGATTATCCAGATATTTATGGAGCTATTGATCAAAATGGCACTTATCAAAATGTG
9VSP      CATCCGGATTATCCAGATATTTATGGAGCTATTGATCAAAATGGCACTTATCAAAATGTG
TIGR4     CATCCGGATTATCCAGATATTTATGGAGCTATTGATCAAAATGGCACTTATCAAAATGTG
23FTW     CATCCGGATTATCCAGATATTTATGGAGCTATTGATCAAAATGGCACTTATCAAAATGTG
          ************************************************************

14CSR     AGAACAGGTGAAGATGGTAAGTTGACCTTTAAAAATCTGTCAGATGGGAAATATCGATTA
670       AGAACAGGTGAAGATGGTAAGTTGACCTTTAAAAATCTGTCAGATGGGAAATATCGATTA
6BF       AGAACAGGTGAAGATGGTAAGTTGACCTTTAAAAATCTGTCAGATGGGAAATATCGATTA
6BSP      AGAACAGGTGAAGATGGTAAGTTGACCTTTAAAAATCTGTCAGATGGGAAATATCGATTA
19AH      AGAACAGGTGAAGATGGTAAGTTGACCTTTAAAAATCTGTCAGATGGGAAATATCGATTA
23FPO     AGAACAGGTGAAGATGGTAAGTTGACCTTTAAAAATCTGTCAGATGGGAAATATCGATTA
19FTW     AGAACAGGTGAAGATGGTAAGTTGACCTTTAAAAATCTGTCAGATGGGAAATATCGATTA
9VSP      AGAACAGGTGAAGATGGTAAGTTGACCTTTAAAAATCTGTCAGATGGGAAATATCGATTA
TIGR4     AGAACAGGTGAAGATGGTAAGTTGACCTTTAAAAATCTGTCAGATGGGAAATATCGATTA
23FTW     AGAACAGGTGAAGATGGTAAGTTGACCTTTAAAAATCTGTCAGATGGGAAATATCGATTA
          ************************************************************

14CSR     TTTGAAAATTCTGAACCAGCTGGTTATAAACCCGTTCAAAATAAGCCTATCGTTGCCTTC
670       TTTGAAAATTCTGAACCAGCTGGTTATAAACCCGTTCAAAATAAGCCTATCGTTGCCTTC
6BF       TTTGAAAATTCTGAACCAGCTGGTTATAAACCCGTTCAAAATAAGCCTATCGTTGCCTTC
6BSP      TTTGAAAATTCTGAACCAGCTGGTTATAAACCCGTTCAAAATAAGCCTATCGTTGCCTTC
19AH      TTTGAAAATTCTGAACCAGCTGGTTATAAACCCGTTCAAAATAAGCCTATCGTTGCCTTC
23FPO     TTTGAAAATTCTGAACCAGCTGGTTATAAACCCGTTCAAAATAAGCCTATCGTTGCCTTC
19FTW     TTTGAAAATTCTGAACCAGCTGGTTATAAACCCGTTCAAAATAAGCCTATCGTTGCCTTC
9VSP      TTTGAAAATTCTGAACCAGCTGGTTATAAACCCGTTCAAAATAAGCCTATCGTTGCCTTC
TIGR4     TTTGAAAATTCTGAACCAGCTGGTTATAAACCCGTTCAAAATAAGCCTATCGTTGCCTTC
23FTW     TTTGAAAATTCTGAACCAGCTGGTTATAAACCCGTTCAAAATAAGCCTATCGTTGCCTTC
          ************************************************************

14CSR     CAAATAGTAAATGGAGAAGTCAGAGATGTGACTTCAATCGTTCCACAAGATATACCAGCG
670       CAAATAGTAAATGGAGAAGTCAGAGATGTGACTTCAATCGTTCCACAAGATATACCAGCG
6BF       CAAATAGTAAATGGAGAAGTCAGAGATGTGACTTCAATCGTTCCACAAGATATACCAGCG
6BSP      CAAATAGTAAATGGAGAAGTCAGAGATGTGACTTCAATCGTTCCACAAGATATACCAGCG
19AH      CAAATAGTAAATGGAGAAGTCAGAGATGTGACTTCAATCGTTCCACAAGATATACCAGCG
23FPO     CAAATAGTAAATGGAGAAGTCAGAGATGTGACTTCAATCGTTCCACAAGATATACCAGCG
19FTW     CAAATAGTAAATGGAGAAGTCAGAGATGTGACTTCAATCGTTCCACAAGATATACCAGCG
9VSP      CAAATAGTAAATGGAGAAGTCAGAGATGTGACTTCAATCGTTCCACAAGATATACCAGCG
TIGR4     CAAATAGTAAATGGAGAAGTCAGAGATGTGACTTCAATCGTTCCACAAGATATACCAGCG
23FTW     CAAATAGTAAATGGAGAAGTCAGAGATGTGACTTCAATCGTTCCACAAGATATACCAGCG
          ************************************************************
```

Figure 196P

```
14CSR    GGTTACGAGTTTACGAATGATAAGCACTATATCACAAATGAGCCAATTCCTCCAAAAAGA
670      GGTTACGAGTTTACGAATGATAAGCACTATATCACAAATGAGCCAATTCCTCCAAAAAGA
6BF      GGTTACGAGTTTACGAATGATAAGCACTATATCACAAATGAGCCAATTCCTCCAAAAAGA
6BSP     GGTTACGAGTTTACGAATGATAAGCACTATATCACAAATGAGCCAATTCCTCCAAAAAGA
19AH     GGTTACGAGTTTACGAATGATAAGCACTATATCACAAATGAGCCAATTCCTCCAAAAAGA
23FPO    GGTTACGAGTTTACGAATGATAAGCACTATATCACAAATGAGCCAATTCCTCCAAAAAGA
19FTW    GGTTACGAGTTTACGAATGATAAGCACTATATTACCAATGAACCTATTCCTCCAAAGAGA
9VSP     GGTTACGAGTTTACGAATGATAAGCACTATATTACCAATGAACCTATTCCTCCAAAGAGA
TIGR4    GGTTACGAGTTTACGAATGATAAGCACTATATTACCAATGAACCTATTCCTCCAAAGAGA
23FTW    GGTTACGAGTTTACGAATGATAAGCACTATATTACCAATGAACCTATTCCTCCAAAGAGA
         ******************************** ** ***** ** *********** ***

14CSR    GAATATCCTCGAACTGGTGGTATCGGAATGTTGCCATTCTATCTGATAGGTTGCATGATG
670      GAATATCCTCGAACTGGTGGTATCGGAATGTTGCCATTCTATCTGATAGGTTGCATGATG
6BF      GAATATCCTCGAACTGGTGGTATCGGAATGTTGCCATTCTATCTGATAGGTTGCATGATG
6BSP     GAATATCCTCGAACTGGTGGTATCGGAATGTTGCCATTCTATCTGATAGGTTGCATGATG
19AH     GAATATCCTCGAACTGGTGGTATCGGAATGTTGCCATTCTATCTGATAGGTTGCATGATG
23FPO    GAATATCCTCGAACTGGTGGTATCGGAATGTTGCCATTCTATCTGATAGGTTGCATGATG
19FTW    GAATATCCTCGAACTGGTGGTATCGGAATGTTGCCATTCTATCTGATAGGTTGCATGATG
9VSP     GAATATCCTCGAACTGGTGGTATCGGAATGTTGCTATTCTATCTGATAGGTTGCATGATG
TIGR4    GAATATCCTCGAACTGGTGGTATCGGAATGTTGCCATTCTATCTGATAGGTTGCATGATG
23FTW    GAATATCCTCGAACTGGTGGTATCGGAATGTTGCCATTCTATCTGATAGGTTGCATGATG
         ********************************* **************************

14CSR    ATGGGAGGAGTTCTATTATACACACGGAAACATCCGTAAAGTGTAGCAATGAGAAATGAT
670      ATGGGAGGAGTTCTATTATACACACGGAAACATCCGTAAAGTGTAGCAATGAGAAATGAT
6BF      ATGGGAGGAGTTCTATTATACACACGGAAACATCCGTAAAGTGTAGCAATGAGAAATGAT
6BSP     ATGGGAGGAGTTCTATTATACACACGGAAACATCCGTAAAGTGTAGCAATGAGAAATGAT
19AH     ATGGGAGGAGTTCTATTATACACACGGAAAAATCCGTAAAGTGTAGCAATGAGAAATGAT
23FPO    ATGGGAGGAGTTCTATTATACACACGGAAAAATCCGTAAAGTGTAGCAATGAGAAATGAT
19FTW    ATGGGAGGAGTTCTATTATACACACGGAAACATCCGTAAAGTGTAG-------AAATGAT
9VSP     ATGGGAGGAGTTCTATTATACACACGGAAACATCCGTAAAGTGTAG-------AAATGAT
TIGR4    ATGGGAGGAGTTCTATTATACACACGGAAACATCCGTAAAGTGTAG-------AAATGAT
23FTW    ATGGGAGGAGTTCTATTATACACACGGAAACATCCGTAAAGTGTAG-------AAATGAT
         ****************************** ***************       *******

14CSR    AATATCGATACTCTGAGCGATACTTTTAAGAAGTAGCACTCAAGAAGAGATTTAAGTTTA
670      AATATCGATACTCTGAGCGATACTTTTAAGAAGTAGCACTCAAGAAGAGATTTAAGTTTA
6BF      AATATCGATACTCTGAGCGATACTTTTAAGAAGTAGCACTCAAGAAGAGATTTAAGTTTA
6BSP     AATATCGATACTCTGAGCGATACTTTTAAGAAGTAGCACTCAAGAAGAGATTTAAGTTTA
19AH     AATATCGATACTCTGAGCGATACTTTTAAGAAGTAGCACTCAAGAAGAGATTTAAGTTTA
23FPO    AATATCGATACTCTGAGCGATACTTTTAAGAAGTAGCACTCAAGAAGAGATTTAAGTTTA
19FTW    AATATCTATGTTCTGAACAATACTTTTAAGAAGTAGCACTCAAGAAGAGATTTAAGTTTA
9VSP     AATATCTATGTTCTGAACGATACTTTTAAGAAGTAGCACTCAAGAAGAGATTTAAGTTTA
TIGR4    AATATCTATGTTCTGAACGATACTTTTAAGAAGTAGCACTCAAGAAGAGATTTAAGTTTA
23FTW    AATATCTATGTTCTGAACGATACTTTTAAGAAGTAGCACTCAAGAAGAGATTTAAGTTTA
         ****** **  ***** * *****************************************

14CSR    CTTGGTGAAAACAGTTTTCTTCGCCAAGTAAACCACCATTGAAAGGGGAGATGTTTTCGA
670      CTTGGTGAAAACAGTTTTCTTCGCCAAGTAAACCACCATTGAAAGGGGAGATGTTTTCGA
6BF      CTTGGTGAAAACAGTTTTCTTCGCCAAGTAAACCACCATTGAAAGGGGAGATGTTTTCGA
6BSP     CTTGGTGAAAACAGTTTTCTTCGCCAAGTAAACCACCATTGAAAGGGGAGATGTTTTCGA
19AH     CTTGGTGAAAACAGTTTTCTTCGCCAAGTAAACCACCATTGAAAGGGGAGATGTTTTCGA
23FPO    CTTGGTGAAAACAGTTTTCTTCGCCAAGTAAACCACCATTGAAAGGGGAGATGTTTTCGA
19FTW    CTTGGTGAAACCAGTTTTCTTCGCCAAGTAAACCACCATTGAAAGGGGAGATGTTTTCGA
9VSP     CTTGGTGAAACCAGTTTTCTTCGCCAAGTAAACCACCATTGAAAGGGGAGATGTTTTCGA
TIGR4    CTTGGTGAAACCTGTTTTATTCGT-AAGTAAACTATCATTGAAAGGGGAGATGTTTTCGA
23FTW    CTTGGTGAAACCTGTTTTATTCGT-AAGTAAACTATCATTGAAAGGGGAGATGTTTTCGA
         ********** * ***** ****  ******** * ************************
```

Figure 196Q

```
14CSR    AAACTTGCACAGAAAAAAGGATTATTATTGTCATGTGTAATTCATTACATTGCTCACAGT
670      AAACTTGCACAGAAAAAAGGATTATTATTGTCATGTGTAATTCATTACATTGCTCACAGT
6BF      AAACTTGCACAGAAAAAAGGATTATTATTGTCATGTGTAATTCATTACATTGCTCACAGT
6BSP     AAACTTGCACAGAAAAAAGGATTATTATTGTCATGTGTAATTCATTACATTGCTCACAGT
19AH     AAACTTGCACAGAAAAAAGGATTATTATTGTCATGTGTAATTCATTACATTGCTCACAGT
23FPO    AAACTTGCACAGAAAAAAGGATTATTATTGTCATGTGTAATTCATTACATTGCTCACAGT
19FTW    AAACTTGCACAGAAAAA-GGATTATTATTGTCATGTGTAATTCATTACATTGCTCACAGT
9VSP     AAACTTGCACAGAAAAA-GGATTATTATTGTCATGTGTAATTCATTACATTGCTCACAGT
TIGR4    AAACTTGCACAGAAAAA-GGATTATTATTGTCATGTGTAATTCATTACATTGCTCACAGT
23FTW    AAACTTGCACAGAAAAA-GGATTATTATTGTCATGTGTAATTCATTACATTGCTCACAGT
         ***************** ******************************************

14CSR    TGATTTTAAGAGATATGAATAAGGAGAAATCATGAAATCAATCAACAAATTTTTAACAAT
670      TGATTTTAAGAGATATGAATAAGGAGAAATCATGAAATCAATCAACAAATTTTTAACAAT
6BF      TGATTTTAAGAGATATGAATAAGGAGAAATCATGAAATCAATCAACAAATTTTTAACAAT
6BSP     TGATTTTAAGAGATATGAATAAGGAGAAATCATGAAATCAATCAACAAATTTTTAACAAT
19AH     TGATTTTAAGAGATATGAATAAGGAGAAATCATGAAATCAATCAACAAATTTTTAACAAT
23FPO    TGATTTTAAGAGATATGAATAAGGAGAAATCATGAAATCAATCAACAAATTTTTAACAAT
19FTW    TGATTTTAAGAGATA--AATAAGGAGAAATCATGAAATCAATCAACAAATTTTTAACAAT
9VSP     TGATTTTAAGAGATA--AATAAGGAGAAATCATGAAATCAATCAACAAATTTTTAACAAT
TIGR4    TGATTTTAAGAGATATGAATAAGGAGAAATCATGAAATCAATCAACAAATTTTTAACAAT
23FTW    TGATTTTAAGAGATATGAATAAGGAGAAATCATGAAATCAATCAACAAATTTTTAACAAT
         ***************  *******************************************

14CSR    GCTTGCTGCCTTATTACTGACAGCGAGTAGCCTGTTTTCAGCTGCAACAGTTTTTGCGGC
670      GCTTGCTGCCTTATTACTGACAGCGAGTAGCCTGTTTTCAGCTGCAACAGTTTTTGCGGC
6BF      GCTTGCTGCCTTATTACTGACAGCGAGTAGCCTGTTTTCAGCTGCAACAGTTTTTGCGGC
6BSP     GCTTGCTGCCTTATTACTGACAGCGAGTAGCCTGTTTTCAGCTGCAACAGTTTTTGCGGC
19AH     GCTTGCTGCCTTATTACTGACAGCGAGTAGCCTGTTTTCAGCTGCAACAGTTTTTGCGGC
23FPO    GCTTGCTGCCTTATTACTGACAGCGAGTAGCCTGTTTTCAGCTGCAACAGTTTTTGCGGC
19FTW    GCTTGCTGCCTTATTATTGACAGCGAGTAGCCTGTTTTCAGCTGCAACAGTTTTTGCGGC
9VSP     GCTTGCTGCCTTATTACTGACAGCGAGTAGCCTGTTTTCAGCTGCAACAGTTTTTGCGGC
TIGR4    GCTTGCTGCCTTATTACTGACAGCGAGTAGCCTGTTTTCAGCTGCAACAGTTTTTGCGGC
23FTW    ACTTGCTGCCTTATTACTGACAGTGAGTAGCCTGTTCTCAGCTGCAACAGTTTTTGCGGC
          *************** ****** ************ ***********************

14CSR    GGACAATGTTAGTACAGCACCAGATGCTGTTACTAAAACTTTAACAATCCATAAGTTACT
670      GGACAATGTTAGTACAGCACCAGATGCTGTTACTAAAACTTTAACAATCCATAAGTTACT
6BF      GGACAATGTTAGTACAGCACCAGATGCTGTTACTAAAACTTTAACAATCCATAAGTTACT
6BSP     GGACAATGTTAGTACAGCACCAGATGCTGTTACTAAAACTTTAACAATCCATAAGTTACT
19AH     GGACAATGTTAGTACAGCACCAGATGCTGTTACTAAAACTTTAACAATCCATAAGTTACT
23FPO    GGACAATGTTAGTACAGCACCAGATGCTGTTACTAAAACTTTAACAATCCATAAGTTACT
19FTW    TGG-GACGACA--ACAACATCTGTTACCGTTCATAAACTATTGGCAACAGATGGGGATAT
9VSP     TGG-GACGACA--ACAACATCTGTTACCGTTCATAAACTATTGGCAACAGATGGGGATAT
TIGR4    TGG-GACGACA--ACAACATCTGTTACCGTTCATAAACTATTGGCAACAGATGGGGATAT
23FTW    GGA-ACAAAAA--ACTAAGACACTTACAGTTCATAAATTATTGATGACAGATCAAGAGCT
          *        *  **     *   * * ***  ****   **    *   **       *

14CSR    GCTCTCA---GAAGATGATTTAAAGACTTGGGATACAAACGGTCCTAA-AGGATATGATG
670      GCTCTCA---GAAGATGATTTAAAGACTTGGGATACAAACGGTCCTAA-AGGATATGATG
6BF      GCTCTCA---GAAGATGATTTAAAGACTTGGGATACAAACGGTCCTAA-AGGATATGATG
6BSP     GCTCTCA---GAAGATGATTTAAAGACTTGGGATACAAACGGTCCTAA-AGGATATGATG
19AH     GCTCTCA---GAAGATGATTTAAAGACTTGGGATACAAACGGTCCTAA-AGGATATGATG
23FPO    GCTCTCA---GAAGATGATTTAAAGACTTGGGATACAAACGGTCCTAA-AGGATATGATG
19FTW    GGATAAAATTGCAAATGAGTTAGAAACAGGTAACTATGCTGGTAATAA-AGTGGGTGTTC
9VSP     GGATAAAATTGCAAATGAGTTAGAAACAGGTAACTATGCTGGTAATAA-AGTGGGTGTTC
TIGR4    GGATAAAATTGCAAATGAGTTAGAAACAGGTAACTATGCTGGTAATAA-AGTGGGTGTTC
23FTW    TGAC------GCTTGGAATTCTGATGCGATTACTACTGCAGGTTATGACGGTTCGCAAAA
                   *      * *   *  *             ***  * *  *
```

Figure 196R

```
14CSR           GAACTCAATCTAGTTTAAAAGATTTAACTGGAGTTGTAGCTG----AGGAAATTCCAAAT
670             GAACTCAATCTAGTTTAAAAGATTTAACTGGAGTTGTAGCTG----AGGAAATTCCAAAT
6BF             GAACTCAATCTAGTTTAAAAGATTTAACTGGAGTTGTAGCTG----AGGAAATTCCAAAT
6BSP            GAACTCAATCTAGTTTAAAAGATTTAACTGGAGTTGTAGCTG----AGGAAATTCCAAAT
19AH            GAACTCAATCTAGTTTAAAAGATTTAACTGGAGTTGTAGCTG----AGGAAATTCCAAAT
23FPO           GAACTCAATCTAGTTTAAAAGATTTAACTGGAGTTGTAGCTG----AGGAAATTCCAAAT
19FTW           TACCTGCA---AATGCAAAAGAAATTGCCGGTGTTATGTTCGTTTGGACAAATACTAATA
9VSP            TACCTGCA---AATGCAAAAGAAATTGCCGGTGTTATGTTCGTTTGGACAAATACTAATA
TIGR4           TACCTGCA---AATGCAAAAGAAATTGCCGGTGTTATGTTCGTTTGGACAAATACTAATA
23FTW           T-TTTGAA---CAGTTCAAACAACTTCAAGGTGTTCCACAAG---GAGTAACCGAAATCT
                    *  *         *** *  *    ** ***      *       **     *

14CSR           GTATACTT-------TGAATTACAAAAGTATA-ATTTGACTGATGGT--AAGGAAAAAGA
670             GTATACTT-------TGAATTACAAAAGTATA-ATTTGACTGATGGT--AAGGAAAAAGA
6BF             GTATACTT-------TGAATTACAAAAGTATA-ATTTGACTGATGGT--AAGGAAAAAGA
6BSP            GTATACTT-------TGAATTACAAAAGTATA-ATTTGACTGATGGT--AAGGAAAAAGA
19AH            GTATACTT-------TGAATTACAAAAGTATA-ATTTGACTGATGGT--AAGGAAAAAGA
23FPO           GTATACTT-------TGAATTACAAAAGTATA-ATTTGACTGATGGT--AAGGAAAAAGA
19FTW           ATGAAATTATTGATGAAAATGGCCAAACTCTAGGAGTGAATATTGATCCACAAACATTTA
9VSP            ATGAAATTATTGATGAAAATGGCCAAACTCTAGGAGTGAATATTGATCCACAAACATTTA
TIGR4           ATGAAATTATTGATGAAAATGGCCAAACTCTAGGAGTGAATATTGATCCACAAACATTTA
23FTW           CTGGTGTTGC--ATTCGAGTTACAGAGTTATACGGGTCCTCAAGGA--AAAGAACAAGAA
                 *    **         * *  *  *  * ** .  *       *    *   * *   *

14CSR           AAATCTTAAAGATGATAGTAAATGGACAACAGTTCATGGTGGTTTGACAACTAAAGATGG
670             AAATCTTAAAGATGATAGTAAATGGACAACAGTTCATGGTGGTTTGACAACTAAAGATGG
6BF             AAATCTTAAAGATGATAGTAAATGGACAACAGTTCATGGTGGTTTGACAACTAAAGATGG
6BSP            AAATCTTAAAGATGATAGTAAATGGACAACAGTTCATGGTGGTTTGACAACTAAAGATGG
19AH            AAATCTTAAAGATGATAGTAAATGGACAACAGTTCATGGTGGTTTGACAACTAAAGATGG
23FPO           AAATCTTAAAGATGATAGTAAATGGACAACAGTTCATGGTGGTTTGACAACTAAAGATGG
19FTW           AACTCTCAGGGGCAATGCCGGC--AACTGCAATGAAAAAATTAACAGAAGCTGAA---GG
9VSP            AACTCTCAGGGGCAATGCCGGC--AACTGCAATGAAAAAATTAACAGAAGCTGAA---GG
TIGR4           AACTCTCAGGGGCAATGCCGGC--AACTGCAATGAAAAAATTAACAGAAGCTGAA---GG
23FTW           AA-TTTAACGAATGATGCGGTTTGGACTGCGGTTAATAAAGGTGTGACGACTGAAACAGG
                ** * * *      **         **  *  *  *              ** **   **

14CSR           ACTTAAAATTGAAACCAGTACTCTTAAAGGTGT---GTATCGTATTCGTGAGGATAGAAC
670             ACTTAAAATTGAAACCAGTACTCTTAAAGGTGT---GTATCGTATTCGTGAGGATAGAAC
6BF             ACTTAAAATTGAAACCAGTACTCTTAAAGGTGT---GTATCGTATTCGTGAGGATAGAAC
6BSP            ACTTAAAATTGAAACCAGTACTCTTAAAGGTGT---GTATCGTATTCGTGAGGATAGAAC
19AH            ACTTAAAATTGAAACCAGTACTCTTAAAGGTGT---GTATCGTATTCGTGAGGATAGAAC
23FPO           ACTTAAAATTGAAACCAGTACTCTTAAAGGTGT---GTATCGTATTCGTGAGGATAGAAC
19FTW           AGCTAAATTTAACACGGCAAATTTACCAGCTGCTAAGTATAAAATTTATGAAATTCACAG
9VSP            AGCTAAATTTAACACGGCAAATTTACCAGCTGCTAAGTATAAAATTTATGAAATTCACAG
TIGR4           AGCTAAATTTAACACGGCAAATTTACCAGCTGCTAAGTATAAAATTTATGAAATTCACAG
23FTW           TGTTAAATTTGATACTGAAGTTTTACAAGGGAC---ATATCGTCTTGTCGAAGTACGTAA
                   **** ** * **      * *   **        ***    **   **       *

14CSR           AAAGACTACCTATGTTGGTCCTAATGGGCAAGTATTAACAGGTTCAAAAGCCGTACCTGC
670             AAAGACTACCTATGTTGGTCCTAATGGGCAAGTATTAACAGGTTCAAAAGCCGTACCTGC
6BF             AAAGACTACCTATGTTGGTCCTAATGGGCAAGTATTAACAGGTTCAAAAGCCGTACCTGC
6BSP            AAAGACTACCTATGTTGGTCCTAATGGGCAAGTATTAACAGGTTCAAAAGCCGTACCTGC
19AH            AAAGACTACCTATGTTGGTCCTAATGGGCAAGTATTAACAGGTTCAAAAGCCGTACCTGC
23FPO           AAAGACTACCTATGTTGGTCCTAATGGGCAAGTATTAACAGGTTCAAAAGCCGTACCTGC
19FTW           TTTATCAACTTATGTCGGTGAAGATGGAGCAACCTTAACAGGTTCTAAAGCAGTTCCAAT
9VSP            TTTATCAACTTATGTCGGTGAAGATGGAGCAACCTTAACAGGTTCTAAAGCAGTTCCAAT
TIGR4           TTTATCAACTTATGTCGGTGAAGATGGAGCAACCTTAACAGGTTCTAAAGCAGTTCCAAT
23FTW           AGAATCGACTTATGTCGGTCCAAATGGTAAAGTTTTAACAGGTATGAAAGCTGTTCCTGC
                     * ** ***** ***    ****   *   *********   ***** ** **
```

Figure 196S

```
14CSR    TCTTGTAACTCTTCCACTTGTTAACAATAATGGTACAGTAATTGATGCACATGTTTTCCC
670      TCTTGTAACTCTTCCACTTGTTAACAATAATGGTACAGTAATTGATGCACATGTTTTCCC
6BF      TCTTGTAACTCTTCCACTTGTTAACAATAATGGTACAGTAATTGATGCACATGTTTTCCC
6BSP     TCTTGTAACTCTTCCACTTGTTAACAATAATGGTACAGTAATTGATGCACATGTTTTCCC
19AH     TCTTGTAACTCTTCCACTTGTTAACAATAATGGTACAGTAATTGATGCACATGTTTTCCC
23FPO    TCTTGTAACTCTTCCACTTGTTAACAATAATGGTACAGTAATTGATGCACATGTTTTCCC
19FTW    TGAAATTGAATTACCATT---------GAACGATGTTGTGGA---TGCGCATGTGTATCC
9VSP     TGAAATTGAATTACCATT---------GAACGATGTTGTGGA---TGCGCATGTGTATCC
TIGR4    TGAAATTGAATTACCATT---------GAACGATGTTGTGGA---TGCGCATGTGTATCC
23FTW    TTTAATTACTCTGCCGCTTGTAAACCAAAATGGTGTTGTAGAAAATGCACATGTCTATCC
         *    *     * **  *          ** * *   **      *** ***** *  **

14CSR    TAAAAATTCATATAATAAACCAGTTGTAGATAAAAGAATTGCTGATACTTTGAATTATAA
670      TAAAAATTCATATAATAAACCAGTTGTAGATAAAAGAATTGCTGATACTTTGAATTATAA
6BF      TAAAAATTCATATAATAAACCAGTTGTAGATAAAAGAATTGCTGATACTTTGAATTATAA
6BSP     TAAAAATTCATATAATAAACCAGTTGTAGATAAAAGAATTGCTGATACTTTGAATTATAA
19AH     TAAAAATTCATATAATAAACCAGTTGTAGATAAAAGAATTGCTGATACTTTGAATTATAA
23FPO    TAAAAATTCATATAATAAACCAGTTGTAGATAAAAGAATTGCTGATACTTTGAATTATAA
19FTW    AAAAAATACAGAAGCAAAGCCAAAAATTGATAAAGATTTCAAAGGTAAAGCAAATCCAGA
9VSP     AAAAAATACAGAAGCAAAGCCAAAAATTGATAAAGATTTCAAAGGTAAAGCAAATCCAGA
TIGR4    AAAAAATACAGAAGCAAAGCCAAAAATTGATAAAGATTTCAAAGGTAAAGCAAATCCAGA
23FTW    AAAGAATTCTGAAGACAAACCTACAGCAACGAAAACATTTGATACTGCAGCAGGTTTCGT
          ** *** *  *    ** **          ***    *      *        *

14CSR    CGATCAA---------AATGGTCTGTCTATCGGTACTAAAATCCCATATGTTGT----TA
670      CGATCAA---------AATGGTCTGTCTATCGGTACTAAAATCCCATATGTTGT----TA
6BF      CGATCAA---------AATGGTCTGTCTATCGGTACTAAAATCCCATATGTTGT----TA
6BSP     CGATCAA---------AATGGTCTGTCTATCGGTACTAAAATCCCATATGTTGT----TA
19AH     CGATCAA---------AATGGTCTGTCTATCGGTACTAAAATCCCATATGTTGT----TA
23FPO    CGATCAA---------AATGGTCTGTCTATCGGTACTAAAATCCCATATGTTGT----TA
19FTW    TACACCACGTGTAGATAAAGATACACCTGTGAACCACCAAGTTGGAGATGTTGTAGAGTA
9VSP     TACACCACGTGTAGATAAAGATACACCTGTGAACCACCAAGTTGGAGATGTTGTAGAGTA
TIGR4    TACACCACGTGTAGATAAAGATACACCTGTGAACCACCAAGTTGGAGATGTTGTAGAGTA
23FTW    AGATCCAGGTG---AAAAAGGTTTAGCAATTGGCACTAAGGTACCGTATATTGT----TA
             * *         ** * *    *  *        *  *     ** ****    **

14CSR    ATACAACAATTCCAAGTAATGCAACATT---------TGCAACTTCATTTTGGTCAGATG
670      ATACAACAATTCCAAGTAATGCAACATT---------TGCAACTTCATTTTGGTCAGATG
6BF      ATACAACAATTCCAAGTAATGCAACATT---------TGCAACTTCATTTTGGTCAGATG
6BSP     ATACAACAATTCCAAGTAATGCAACATT---------TGCAACTTCATTTTGGTCAGATG
19AH     ATACAACAATTCCAAGTAATGCAACATT---------TGCAACTTCATTTTGGTCAGATG
23FPO    ATACAACAATTCCAAGTAATGCAACATT---------TGCAACTTCATTTTGGTCAGATG
19FTW    CGA-AATTGTTACAAAAATTCCAGCACTTGCTAATTATGCAACAGCAAACTGGAGCGATA
9VSP     CGA-AATTGTTACAAAAATTCCAGCACTTGCTAATTATGCAACAGCAAACTGGAGCGATA
TIGR4    CGA-AATTGTTACAAAAATTCCAGCACTTGCTAATTATGCAACAGCAAACTGGAGCGATA
23FTW    CAACAACTATTCCGAAAAACTCAACTCT---------TGCAACAGCTTTCTGGTCAGATG
           * **   ** * *  *   ** *  *         ******  *    ***   ***

14CSR    AAATGACAGAAGGTCTAACTTATAATGAAGA-GTAACAA---TTACTTTGAATAATGTAG
670      AAATGACAGAAGGTCTAACTTATAATGAAGATGTAACAA---TTACTTTGAATAATGTAG
6BF      AAATGACAGAAGGTCTAACTTATAATGAAGATGTAACAA---TTACTTTGAATAATGTAG
6BSP     AAATGACAGAAGGTCTAACTTATAATGAAGATGTAACAA---TTACTTTGAATAATGTAG
19AH     AAATGACAGAAGGTCTAACTTATAATGAAGATGTAACAA---TTACTTTGAATAATGTAG
23FPO    AAATGACAGAAGGTCTAACTTATAATGAAGATGTAACAA---TTACTTTGAATAATGTAG
19FTW    GAATGACTGAAGGTTTGGCATTCAACAAAGGTACAGTGAAAGTAACTGTTGATGATGTTG
9VSP     GAATGACTGAAGGTTTGGCATTCAACAAAGGTACAGTGAAAGTAACTGTTGATGATGTTG
TIGR4    GAATGACTGAAGGTTTGGCATTCAACAAAGGTACAGTGAAAGTAACTGTTGATGATGTTG
23FTW    AAATGACAGAAGGTCTAGATTATAATGGTGATGTAGTT---GTTAATTATAATGGTCAAC
          ****** ****** *    *  **    *    *       * * *    **  *
```

Figure 196T

```
14CSR    CTATGGATCAAGCTGATTATGAAGTCACTAAAGGAAATAATGGCTTTAACTTAAAATTAA
670      CTATGGATCAAGCTGATTATGAAGTCACTAAAGGAAATAATGGCTTTAACTTAAAATTAA
6BF      CTATGGATCAAGCTGATTATGAAGTCACTAAAGGAAATAATGGCTTTAACTTAAAATTAA
6BSP     CTATGGATCAAGCTGATTATGAAGTCACTAAAGGAAATAATGGCTTTAACTTAAAATTAA
19AH     CTATGGATCAAGCTGATTATGAAGTCACTAAAGGAAYTAATGGCTTTAACTTAAAATTAA
23FPO    CTATGGATCAAGCTGATTATGAAGTCACTAAAGGAATTAATGGCTTTAACTTAAAATTAA
19FTW    CACTTGAAGCAGGTGATTATGCTCTAACAGAAGTAGCAACTGGTTTTGATTTGAAATTAA
9VSP     CACTTGAAGCAGGTGATTATGCTCTAACAGAAGTAGCAACTGGTTTTGATTTGAAATTAA
TIGR4    CACTTGAAGCAGGTGATTATGCTCTAACAGAAGTAGCAACTGGTTTTGATTTGAAATTAA
23FTW    CGCTTGATAATTCTCATTACACATTAGAAGCAGGTCATAATGGCTTTATCTTGAAGTTAA
         *  * **     * ****     *      **     * *** ***    ** ** ****

14CSR    CAGAAGCAGGTTTAGCTAAAATTAATGGTAAGGATGCAGACCAAAAAATCCAAATTACTT
670      CAGAAGCAGGTTTAGCTAAAATTAATGGTAAGGATGCAGACCAAAAAATCCAAATTACTT
6BF      CAGAAGCAGGTTTAGCTAAAATTAATGGTAAGGATGCAGACCAAAAAATCCAAATTACTT
6BSP     CAGAAGCAGGTTTAGCTAAAATTAATGGTAAGGATGCAGACCAAAAAATCCAAATTACTT
19AH     CAGAAGCAGGTTTAGCTAAAATTAATGGTAAGGATGCAGACCAAAAAATCCAAATTACTT
23FPO    CAGAAGCAGGTTTAGCTAAAATTAATGGTAAGGATGCAGACCAAAAAATCCAAATTACTT
19FTW    CAGATGCTGGTTTAGCTAAAGTGAATGACCAAAACGCTGAAAAAACTGTGAAAATCACTT
9VSP     CAGATGCTGGTTTAGCTAAAGTGAATGACCAAAACGCTGAAAAAACTGTGAAAATCACTT
TIGR4    CAGATGCTGGTTTAGCTAAAGTGAATGACCAAAACGCTGAAAAAACTGTGAAAATCACTT
23FTW    ATGAAAAAGGTCTGGAAGCAATCAACGGTAAAGATGCAGAAGCAACAATTACGTTGAAGT
          **     *** * *     * * ** *    *   * ** **    **   *      * *  *

14CSR    ACTCAGCTACTTTGAACTCACTTGCTGTTGCAGACATTCCTGAAAGTAACGATATTACAT
670      ACTCAGCTACTTTGAACTCACTTGCTGTTGCAGACATTCCTGAAAGTAACGATATTACAT
6BF      ACTCAGCTACTTTGAACTCACTTGCTGTTGCAGACATTCCCGAAAGTAACGATATTACAT
6BSP     ACTCAGCTACTTTGAACTCACTTGCTGTTGCAGACATTCCTGAAAGTAACGATATTACAT
19AH     ACTCAGCTACTTTGAACTCACTTGCTGTTGCAGACATTCCTGAAAGTAACGATATTACAT
23FPO    ACTCAGCTACTTTGAACTCACTTGCTGTTGCAGACATTCCTGAAAGTAACGATATTACAT
19FTW    ATTCGGCAACATTGAATGACAAAGCAATTGTAGAAGTACCAGAATCTAATGATGTAACAT
9VSP     ATTCGGCAACATTGAATGACAAAGCAATTGTAGAAGTACCAGAATCTAATGATGTAACAT
TIGR4    ATTCGGCAACATTGAATGACAAAGCAATTGTAGAAGTACCAGAATCTAATGATGTAACAT
23FTW    ATACTGCAACTTTAAATGCTCTTGCTGTTGCTGATGTGCCAGAAGCGAATGATGTAACAT
         *  * ** ** ** **        **  ***  **  * ** ***    ** *** * ****

14CSR    ATCATTACGGAAATCATCAAGATCATGGGAATACTCCAAAACCAACTAAACC---TAATA
670      ATCATTACGGAAATCATCAAGATCATGGGAATACTCCAAAACCAACTAAACC---TAATA
6BF      ATCATTACGGAAATCATCAAGATCATGGGAATACTCCAAAACCAACTAAACC---TAATA
6BSP     ATCATTACGGAAATCATCAAGATCATGGGAATACTCCAAAACCAACTAAACC---TAATA
19AH     ATCATTACGGAAATCATCAAGATCATGGGAATACTCCAAAACCAACTAAACC---TAATA
23FPO    ATCATTACGGAAATCATCAAGATCATGGGAATACTCCAAAACCAACTAAACC---TAATA
19FTW    TTAACTATGGTAATAATCCAGATCACGGGAATACTCCAAAGCCGAATAAGCCAAATGAAA
9VSP     TTAACTATGGTAATAATCCAGATCACGGGAATACTCCAAAGCCGAATAAGCCAAATGAAA
TIGR4    TTAACTATGGTAATAATCCAGATCACGGGAATACTCCAAAGCCGAATAAGCCAAATGAAA
23FTW    TCCATTATGGAAACAACCCAGGTCATGGTAACACTCCAAAACCAAACAAACC---TAAAA
            * ** ** **   * * ** *** ** ** ******** ** *  ** **    * * *

14CSR    ATGGTCAAATTACAGTAACTAAGACATGGG---------ACAGTCA-ACCTGCTCCTGAGG
670      ATGGTCAAATTACAGTAACTAAGACATGGG---------ACAGTCA-ACCTGCTCCTGAGG
6BF      ATGGTCAAATTACAGTAACTAAGACATGGG---------ACAGTCA-ACCTGCTCCTGAGG
6BSP     ATGGTCAAATTACAGTAACTAAGACATGGG---------ACAGTCA-ACCTGCTCCTGAGG
19AH     ATGGTCAAATTACAGTAACTAAGACATGGG---------ACAGTCA-ACCTGCTCCTGAGG
23FPO    ATGGTCAAATTACAGTAACTAAGACATGGG---------ACAGTCA-ACCTGCTCCTGAGG
19FTW    ACGGCGATTTGACATTGACCAAGACATGGGTTGATGCTACAGGTGCACCAATTCCGGCTG
9VSP     ACGGCGATTTGACATTGACCAAGACATGGGTTGATGCTACAGGTGCACCAATTCCGGCTG
TIGR4    ACGGCGATTTGACATTGACCAAGACATGGGTTGATGCTACAGGTGCACCAATTCCGGCTG
23FTW    ACGGTGAACTTACAATTACTAAAACATGGGCTGATGCTAAAGATGCTCCTAT---AGCAG
         * **   *   * *** * ** ** *******           * **      **       *  *
```

Figure 196U

```
14CSR   GGGTGAAAGCGACTGTTCAACTTGTAAATGCCAAGACTGGTGAGAAAGTCGGTGCTCC--
670     GGGTGAAAGCGACTGTTCAACTTGTAAATGCCAAGACTGGTGAGAAAGTCGGTGCTCC--
6BF     GGGTGAAAGCGACTGTTCAACTTGTAAATGCCAAGACTGGTGAGAAAGTCGGTGCTCC--
6BSP    GGGTGAAAGCGACTGTTCAACTTGTAAATGCCAAGACTGGTGAGAAAGTCGGTGCTCC--
19AH    GGGTGAAAGCGACTGTTCAACTTGTAAATGCCAAGACTGGTGAGAAAGTCGGTGCTCC--
23FPO   GGGTGAAAGCGACTGTTCAACTTGTAAATGCCAAGACTGGTGAGAAAGTCGGTGCTCC--
19FTW   GAGCTGAAGCAACGTTCGATTTGGTTAATGCTCAGACTGGTAAAGTTGTACAAAC-----
9VSP    GAGCTGAAGCAACGTTCGATTTGGTTAATGCTCAGACTGGTAAAGTTGTACAAAC-----
TIGR4   GAGCTGAAGCAACGTTCGATTTGGTTAATGCTCAGACTGGTAAAGTTGTACAAAC-----
23FTW   GTGTAGAAGTAACTTTTGATTTGGTAAATGCTCAGACAGGTGAGGTCGTTAAAGTACCTG
        * *   ***  **  *  *  * ** *****  **** *** *    **

14CSR   -------------TGTAGAACTTTC---AGAAAATAATTGGACATATACTTGGAGTGGTC
670     -------------TGTAGAACTTTC---AGAAAATAATTGGACATATACTTGGAGTGGTC
6BF     -------------TGTAGAACTTTC---AGAAAATAATTGGACATATACTTGGAGTGGTC
6BSP    -------------TGTAGAACTTTC---AGAAAATAATTGGACATATACTTGGAGTGGTC
19AH    -------------TGTAGAACTTTC---AGAAAATAATTGGACATATACTTGGAGTGGTC
23FPO   -------------TGTAGAACTTTC---AGAAAATAATTGGACATATACTTGGAGTGGTC
19FTW   -------------TGTAACTTTGAC---AACAGACAAAAATACAGTTACTGTTAACGGAT
9VSP    -------------TGTAACTTTGAC---AACAGACAAAAATACAGTTACTGTTAACGGAT
TIGR4   -------------TGTAACTTTGAC---AACAGACAAAAATACAGTTACTGTTAACGGAT
23FTW   GACATGAAACAGGTATTGTATTGAATCAAACAAATAATTGGACATTTACTGCTACAGGTC
                     * *     *      *  * * **    ***  ****   *  **

14CSR   TAGATAATTCTATTGAATACAAAGTTGAAGAA--GAATAT-AATGGATACTCAGCTGAAT
670     TAGATAATTCTATTGAATACAAAGTTGAAGAA--GAATAT-AATGGATACTCAGCTGAAT
6BF     TAGATAATTCTATTGAATACAAAGTTGAAGAA--GAATAT-AATGGATACTCAGCTGAAT
6BSP    TAGATAATTCTATTGAATACAAAGTTGAAGAA--GAATAT-AATGGATACTCAGCTGAAT
19AH    TAGATAATTCTATTGAATACAAAGTTGAAGAA--GAATAT-AATGGATACTCAGCTGAAT
23FPO   TAGATAATTCTATTGAATACAAAGTTGAAGAA--GAATAT-AATGGATACTCAGCTGAAT
19FTW   TGGATAAAAATACAGAATATAAATTCGTTGAACGTAGTATAAAAGGGTATTCAGCAGATT
9VSP    TGGATAAAAATACAGAATATAAATTCGTTGAACGTAGTATAAAAGGGTATTCAGCAGATT
TIGR4   TGGATAAAAATACAGAATATAAATTCGTTGAACGTAGTATAAAAGGGTATTCAGCAGATT
23FTW   TTGATAATAATACAGAATATAAATTTGTTGAACGGACAATTAAGGGATATTCTGCAGATT
        * *****   **  ***** *** * *  ***   *  ** ** ** ** ** ** ** *

14CSR   ACACAGTAGAGAGCAAA---GGGAAGTTGGGGGTAAAAAACTGGAAAGATAATAACCCAG
670     ACACAGTAGAGAGCAAA---GGGAAGTTGGGGGTAAAAAACTGGAAAGATAATAACCCAG
6BF     ACACAGTAGAGAGCAAA---GGGAAGTTGGGGGTAAAAAACTGGAAAGATAATAACCCAG
6BSP    ACACAGTAGAGAGCAAA---GGGAAGTTGGGGGTAAAAAACTGGAAAGATAATAACCCAG
19AH    ACACAGTAGAGAGCAAA---GGGAAGTTGGGGGTAAAAAACTGGAAAGATAATAACCCAG
23FPO   ACACAGTAGAGAGCAAA---GGGAAGTTGGGGGTAAAAAACTGGAAAGATAATAACCCAG
19FTW   ATCAAGAAATCACTACAGCTGGAGAAATTGCTGTCAAGAACTGGAAAGACGAAAATCCAA
9VSP    ATCAAGAAATCACTACAGCTGGAGAAATTGCTGTCAAGAACTGGAAAGACGAAAATCCAA
TIGR4   ATCAAGAAATCACTACAGCTGGAGAAATTGCTGTCAAGAACTGGAAAGACGAAAATCCAA
23FTW   ACCAAACAATTACTGAAACAGGAAAAATTGCTGTTAAAAACTGGAAAGATGAAAATCCAG
        *   *  *   *    *   **  *  * *  ** ** ***********  * ** ***

14CSR   CTCCAATCAATC-TGAAGAACCACGTGTAAAAACATACGGTAAAAAGTTTGTCAAAGTAG
670     CTCCAATCAATCCTGAAGAACCACGTGTAAAAACATACGGTAAAAAGTTTGTCAAAGTAG
6BF     CTCCAATCAATCCTGAAGAACCACGTGTAAAAACATACGGTAAAAAGTTTGTCAAAGTAG
6BSP    CTCCAATCAATCCTGAAGAACCACGTGTAAAAACATACGGTAAAAAGTTTGTCAAAGTAG
19AH    CTCCAATCAATCCTGAAGAACCACGTGTAAAAACATACGGTAAAAAGTTTGTCAAAGTAG
23FPO   CTCCAATCAATCTTGAAGAACCACGTGTAAAAACATACGGTAAAAAGTTTGTCAAAGTAG
19FTW   AACCACTTGATCCAACAGAGCCAAAAGTTGTTACATATGGTAAAAAGTTTGTCAAAGTTA
9VSP    AACCACTTGATCCAACAGAGCCAAAAGTTGTTACATATGGTAAAAAGTTTGTCAAAGTTA
TIGR4   AACCACTTGATCCAACAGAGCCAAAAGTTGTTACATATGGTAAAAAGTTTGTCAAAGTTA
23FTW   AACCAATAAATCCTGAAGAGCCACGTGTAAAAACATATGGTAAAAAATTCGTTAAGGTTG
          *** *  ***    *** ***   **    ***** ******** ** ** ** **
```

Figure 196V

```
14CSR     ACCAAAAAGATACTCGTCTAGAAAATGCGCAGTTCGTTGTTAAAAAAGCAGATAGC---A
670       ACCAAAAAGATACTCGTCTAGAAAATGCGCAGTTCGTTGTTAAAAAAGCAGATAGC---A
6BF       ACCAAAAAGATACTCGTCTAGAAAATGCGCAGTTCGTTGTTAAAAAAGCAGATAGC---A
6BSP      ACCAAAAAGATACTCGTCTAGAAAATGCGCAGTTCGTTGTTAAAAAAGCAGATAGC---A
19AH      ACCAAAAAGATACTCGTCTAGAAAATGCGCAGTTCGTTGTTAAAAAAGCAGATAGC---A
23FPO     ACCAAAAAGATACTCGTCTAGAAAATGCGCAGTTCGTTGTTAAAAAAGCAGATAGC---A
19FTW     ATGATAAAGATAATCGTTTAGCTGGGGCAGAATTTGTAATTGCAAATGCTGATAATGCTG
9VSP      ATGATAAAGATAATCGTTTAGCTGGGGCAGAATTTGTAATTGCAAATGCTGATAATGCTG
TIGR4     ATGATAAAGATAATCGTTTAGCTGGGGCAGAATTTGTAATTGCAAATGCTGATAATGCTG
23FTW     ACCAAAAAGACGAACGCTTAAAAGAAGCACAATTCGTTGTGAAGAATG--AGCAA----G
          *  * *****    **  **      **  *  * **  *    ** *     *

14CSR     ATAAATATATTGCCTTTAAGTCAACTGCACAACAAGCT--GCAGATGAAAAAGCAGCAGC
670       ATAAATATATTGCCTTTAAGTCAACTGCACAACAAGCT--GCAGATGAAAAAGCAGCAGC
6BF       ATAAATATATTGCCTTTAAGTCAACTGCACAACAAGCT--GCAGATGAAAAAGCAGCAGC
6BSP      ATAAATATATTGCCTTTAAGTCAACTGCACAACAAGCT--GCAGATGAAAAAGCAGCAGC
19AH      ATAAATATATTGCCTTTAAGTCAACTGCACAACAAGCT--GCAGATGAAAAAGCAGCAGC
23FPO     ATAAATATATTGCCTTTAAGTCAACTGCACAACAAGCT--GCAGATGAAAAAGCAGCAGC
19FTW     GTCAATATTTAGCACGTAAAGCAG--ATAAAGTGAGTCAAGAAGAGAAGCAGTTGGTTGT
9VSP      GTCAATATTTAGCACGTAAAGCAG--ATAAAGTGAGTCAAGAAGAGAAGCAGTTGGTTGT
TIGR4     GTCAATATTTAGCACGTAAAGCAG--ATAAAGTGAGTCAAGAAGAGAAGCAGTTGGTTGT
23FTW     GGAAATATCTTGCACTCAAATCTGCAGCACAACAAGCT--GTAAATGAGAAAGCTGCCGC
             ***** * **    **  *      * *   **    * * *  *  *    *  *

14CSR     AACTGCAAAACAAAAATTGGATGCAGCGGTAGCAGCTTACA---CAAATGCTGCAGATAA
670       AACTGCAAAACAAAAATTGGATGCAGCGGTAGCAGCTTACA---CAAATGCTGCAGATAA
6BF       AACTGCAAAACAAAAATTGGATGCAGCGGTAGCAGCTTACA---CAAATGCTGCAGATAA
6BSP      AACTGCAAAACAAAAATTGGATGCAGCGGTAGCAGCTTACA---CAAATGCTGCAGATAA
19AH      AACTGCAAAACAAAAATTGGATGCAGCGGTAGCAGCTTACA---CAAATGCTGCAGATAA
23FPO     AACTGCAAAACAAAAATTGGATGCAGCGGTAGCAGCTTACA---CAAATGCTGCAGATAA
19FTW     TACAACAAAGGATGCTTTAGATAGAGCAGTTGCTGCTTATAACGCTCTTACTGCACAACA
9VSP      TACAACAAAGGATGCTTTAGATAGAGCAGTTGCTGCTTATAACGCTCTTACTGCACAACA
TIGR4     TACAACAAAGGATGCTTTAGATAGAGCAGTTGCTGCTTATAACGCTCTTACTGCACAACA
23FTW     AGAAGCGAAACAAGCGCTAGATGCAGCGATAGCAGCCTATA---CAAATGCTGCA-GATA
               * **  *     * ***  ***  * ** ** ** *   *   * *****    *

14CSR     GCAAGCCGCTCAA------GCTCTAGTAGATCAAGCACAGCAAGAATACAATGTAGCTTA
670       GCAAGCCGCTCAA------GCTCTAGTAGATCAAGCACAGCAAGAATACAATGTAGCTTA
6BF       GCAAGCCGCTCAA------GCTCTAGTAGATCAAGCACAGCAAGAATACAATGTAGCTTA
6BSP      GCAAGCCGCTCAA------GCTCTAGTAGATCAAGCACAGCAAGAATACAATGTAGCTTA
19AH      GCAAGCCGCTCAA------GCTCTAGTAGATCAAGCACAGCAAGAATACAATGTAGCTTA
23FPO     GCAAGCCGCTCAA------GCTCTAGTAGATCAAGCACAGCAAGAATACAATGTAGCTTA
19FTW     ACAAACTCAGCAAGAAAAAGAGAAAGTTGACAAAGCTCAAGCTGCTTATAATGCTGCTGT
9VSP      ACAAACTCAGCAAGAAAAAGAGAAAGTTGACAAAGCTCAAGCTGCTTATAATGCTGCTGT
TIGR4     ACAAACTCAGCAAGAAAAAGAGAAAGTTGACAAAGCTCAAGCTGCTTATAATGCTGCTGT
23FTW     A-AAATGCAGCAC----AAGCTGTAGTAGATGCTGCGCAAAAAACATATAATGACAATTA
            **      **       *    *** **    ** **       ** ****    *

14CSR     CAAAGAAGCCAA------ATTTGGTTATGTTGAAGTAGCTGGAAAAGATGAAGCAATGGT
670       CAAAGAAGCCAA------ATTTGGTTATGTTGAAGTAGCTGGAAAAGATGAAGCAATGGT
6BF       CAAAGAAGCCAA------ATTTGGTTATGTTGAAGTAGCTGGAAAAGATGAAGCAATGGT
6BSP      CAAAGAAGCCAA------ATTTGGTTATGTTGAAGTAGCTGGAAAAGATGAAGCAATGGT
19AH      CAAAGAAGCCAA------ATTTGGTTATGTTGAAGTAGCTGGAAAAGATGAAGCAATGGT
23FPO     CAAAGAAGCCAA------ATTTGGTTATGTTGAAGTAGCTGGAAAAGATGAAGCAATGGT
19FTW     GATTGCTGCCAACAATGCATTTGAATGGGTGGCAGATAAGGACAATGAAAATGTTGTGAA
9VSP      GATTGCTGCCAACAATGCATTTGAATGGGTGGCAGATAAGGACAATGAAAATGTTGTGAA
TIGR4     GATTGCTGCCAACAATGCATTTGAATGGGTGGCAGATAAGGACAATGAAAATGTTGTGAA
23FTW     CAGAGCAGCTAG------ATTTGGCTATGTAGAAGTAGAGAGAAAAGAAGATGCGTTAGT
           *  *  ** *       *****  *  ** * **        ** **  * *   *
```

Figure 196W

```
14CSR           TCTTACTTCTAATACGGATGGTCAATTCCAAATTTCAGGTCTTGCTGCTGGTACTTATAA
670             TCTTACTTCTAATACGGATGGTCAATTCCAAATTTCAGGTCTTGCTGCTGGTACTTATAA
6BF             TCTTACTTCTAATACGGATGGTCAATTCCAAATTTCAGGTCTTGCTGCTGGTACTTATAA
6BSP            TCTTACTTCTAATACGGATGGTCAATTCCAAATTTCAGGTCTTGCTGCTGGTACTTATAA
19AH            TCTTACTTCTAATACGGATGGTCAATTCCAAATTTCAGGTCTTGCTGCTGGTACTTATAA
23FPO           TCTTACTTCTAATACGGATGGTCAATTCCAAATTTCAGGTCTTGCTGCTGGTACTTATAA
19FTW           ATTAGTTTCTGATGCACAAGGTCGCTTTGAAATTACAGGCCTTCTTGCAGGTACATATTA
9VSP            ATTAGTTTCTGATGCACAAGGTCGCTTTGAAATTACAGGCCTTCTTGCAGGTACATATTA
TIGR4           ATTAGTTTCTGATGCACAAGGTCGCTTTGAAATTACAGGCCTTCTTGCAGGTACATATTA
23FTW           TCTTACTTCTAACACTGATGGTCAATTCCAAATTTCAGGTCTTGCTGCTGGAAGCTACAC
                  *   **** *  *  * ****  **  ***** **** ***  *** ** *  **

14CSR           ATTAGAAGAAATTAAAGCTCCAGAAGGTTTTGCGAAAAT---TGATGATGTAGAATTTGT
670             ATTAGAAGAAATTAAAGCTCCAGAAGGTTTTGCGAAAAT---TGATGATGTAGAATTTGT
6BF             ATTAGAAGAAATTAAAGCTCCAGAAGGTTTTGCGAAAAT---TGATGATGTAGAATTTGT
6BSP            ATTAGAAGAAATTAAAGCTCCAGAAGGTTTTGCGAAAAT---TGATGATGTAGAATTTGT
19AH            ATTAGAAGAAATTAAAGCTCCAGAAGGTTTTGCGAAAAT---TGATGATGTAGAATTTGT
23FPO           ATTAGAAGAAATTAAAGCTCCAGAAGGTTTTGCGAAAAT---TGATGATGTAGAATTTGT
19FTW           CTTAGAAGAAACAAAACAGCCTGCTGGTTATGCATTACTAACTAGCCGTCAGAAATTTGA
9VSP            CTTAGAAGAAACAAAACAGCCTGCTGGTTATGCATTACTAACTAGTCGTCAGAAATTTGA
TIGR4           CTTAGAAGAAACAAAACAGCCTGCTGGTTATGCATTACTAACTAGCCGTCAGAAATTTGA
23FTW           GTTGGAAGAAACAAAAGCTCCAGAAGGCTTTGCAAAACT---TGGAGATGTGAAGTTTGA
                 ** *******  ***   ** *  ** * ***   * *   *     *    * ****

14CSR           TGTTGGAGCAGGTTCTTG------GAATCAAGGTGAGTTTAATTACTTAAAAGATGTTCA
670             TGTTGGAGCAGGTTCTTG------GAATCAAGGTGAGTTTAATTACTTAAAAGATGTTCA
6BF             TGTTGGAGCAGGTTCTTG------GAATCAAGGTGAGTTTAATTACTTAAAAGATGTTCA
6BSP            TGTTGGAGCAGGTTCTTG------GAATCAAGGTGAGTTTAATTACTTAAAAGATGTTCA
19AH            TGTTGGAGCAGGTTCTTG------GAATCAAGGTGAGTTTAATTACTTAAAAGATGTTCA
23FPO           TGTTGGAGCAGGTTCTTG------GAATCAAGGTGAGTTTAATTACTTAAAAGATGTTCA
19FTW           AGTCACTGCAACTTCTTATTCAGCGACTGGACAAGGCATTGAGTATACTGCTGGTTCAGG
9VSP            AGTCACTGCAACTTCTTATTCAGCGACTGGACAAGGCATTGAGTATACTGCTGGTTCAGG
TIGR4           AGTCACTGCAACTTCTTATTCAGCGACTGGACAAGGCATTGAGTATACTGCTGGTTCAGG
23FTW           GGTTGGAGCAGGTTCTTG------GAATCAAGGTGATTTCAATTATTTAAAAGATGTTCA
                 **    ***  *****       ** *  *   *   *  * **       * *

14CSR           AAAGAATGACGCTACAAAAGTAGTCAACAAAAAAATCACTATCCCACAAACGGGTGGTAT
670             AAAGAATGACGCTACAAAAGTAGTCAACAAAAAAATCACTATCCCACAAACGGGTGGTAT
6BF             AAAGAATGACGCTACAAAAGTAGTCAACAAAAAAATCACTATCCCACAAACGGGTGGTAT
6BSP            AAAGAATGACGCTACAAAAGTAGTCAACAAAAAAATCACTATCCCACAAACGGGTGGTAT
19AH            AAAGAATGACGCTACAAAAGTAGTCAACAAAAAAATCACTATCCCACAAACGGGTGGTAT
23FPO           AAAGAATGACGCTACAAAAGTAGTCAACAAAAAAATCACGATCCCACAAACGGGTGGTAT
19FTW           TAAAGATGACGCTACAAAAGTAGTCAACAAAAAAATCACGATCCCACAAACGGGTGGTAT
9VSP            TAAAGATGACGCTACAAAAGTAGTCAACAAAAAAATCACGATCCCACAAACGGGTGGTAT
TIGR4           TAAAGATGACGCTACAAAAGTAGTCAACAAAAAAATCACTATCCCACAAACGGGTGGTAT
23FTW           GAAGAACGACGCTACAAAAGTAGTCAACAAAAAAATCACGATCCCTCAAACGGGTGGTAT
                 **  * ******************************** ***** **************

14CSR           TGGTACAATTATCTTTGCTGTAGCGGGGGCTGCGATTATGGGTATTGCAGTGTACGCATA
670             TGGTACAATTATCTTTGCTGTAGCGGGGGCTGCGATTATGGGTATTGCAGTGTACGCATA
6BF             TGGTACAATTATCTTTGCTGTAGCGGGGGCTGCGATTATGGGTATTGCAGTGTACGCATA
6BSP            TGGTACAATTATCTTTGCTGTAGCGGGGGCTGCGATTATGGGTATTGCAGTGTACGCATA
19AH            TGGTACAATTATCTTTGCTGTAGCGGGGGCTGCGATTATGGGTATTGCAGTGTACGCATA
23FPO           TGGTACAATTATCTTTGCTGTAGCAGGGGCTGTGATTATGGGTATTGCAGTGTACGCATA
19FTW           TGGTACAATTATCTTTGCTGTAGCAGGGGCTGTGATTATGGGTATTGCAGTGTACGCATA
9VSP            TGGTACAATTATCTTTGCTGTAGCAGGGGCTGTGATTATGGGTATTGCAGTGTACGCATA
TIGR4           TGGTACAATTATCTTTGCTGTAGCGGGGGCTGCGATTATGGGTATTGCAGTGTACGCATA
23FTW           TGGTACAATTATCTTTGCTGTAGCGGGGGCTGTGATTATGGGTATTGCAGTGTACGCATA
                ************************ ******* ***************************
```

Figure 196X

```
14CSR     TGTTAAAAACAACAAAGATGAGGATCAACTTGCTTAAGTAAGAGAGAAAGGAGCCATTGA
670       TGTTAAAAACAACAAAGATGAGGATCAACTTGCTTAAGTAAGAGAGAAAGGAGCCATTGA
6BF       TGTTAAAAACAACAAAGATGAGGATCAACTTGCTTAAGTAAGAGAGAAAGGAGCCATTGA
6BSP      TGTTAAAAACAACAAAGATGAGGATCAACTTGCTTAAGTAAGAGAGAAAGGAGCCATTGA
19AH      TGTTAAAAACAACAAAGATGAGGATCAACTTGCTTAAGTAAGAGAGAAAGGAGCCATTGA
23FPO     TGTTAAAAACAACAAAGATGAGGATCAACTTGCTTAAGTAAGAGAGAAAGGAGCCATTGA
19FTW     TGTTAAAAACAACAAAGATGAGGATCAACTTGCTTAAGTAAGAGAGAAAGGAGCCATTGA
9VSP      TGTTAAAAACAACAAAGATGAGGATCAACTTGCTTAAGTAAGAGAGAAAGGAGCCATTGA
TIGR4     TGTTAAAAACAACAAAGATGAGGATCAACTTGCTTAAGTAAGAGAGAAAGGAGCCATTGA
23FTW     TGTTAAAAACAACAAAGATGAGGATCAACTTGCTTAAGTAAGAGAGAAAGGAGCCATTGA
          ************************************************************

14CSR     TGACAATGCAGAAAATGCAGAAAATG----------------------------------
670       TGACAATGCAGAAAATGCAGAAAATG----------------------------------
6BF       TGACAATGCAGAAAATGCAGAAAATG----------------------------------
6BSP      TGACAATGCAGAAAATGCAGAAAATG----------------------------------
19AH      TGACAATGCAGAAAATGCAGAAAATG----------------------------------
23FPO     TGACAATGCAGAAAATGCAGAAAATG----------------------------------
19FTW     TGACAATGCAGAAAATGCAGAAAATG----------------------------------
9VSP      TGACAATGCAGAAAATGCAGAAAATGCAGAAAATGCAGAAAATGCAGAAAATGCAGAAAA
TIGR4     TGACAATGCAGAAAATGCAGAAAATG----------------------------------
23FTW     TGACAATGCAGAAAATGCAGAAAATG----------------------------------
          **************************

14CSR     --ATTAGTCGTATCTTCTTTGTTATGGCTCTGTGTTTTTCTCTTGTATGGGGTGCACATG
670       --ATTAGTCGTATCTTCTTTGTTATGGCTCTGTGTTTTTCTCTTGTATGGGGTGCACATG
6BF       --ATTAGTCGTATCTTCTTTGTTATGGCTCTGTGTTTTTCTCTTGTATGGGGTGCACATG
6BSP      --ATTAGTCGTATCTTCTTTGTTATGGCTCTGTGTTTTTCTCTTGTATGGGGTGCACATG
19AH      --ATTAGTCGTATCTTCTTTGTTATGGCTCTGTGTTTTTCTCTTGTATGGGGTGCACATG
23FPO     --ATTAGTCGTATCTTCTTTGTTATGGCTCTGTGTTTTTCTCTTGTATGGGGTGCACATG
19FTW     --ATTAGTCGTATCTTCTTTGTTATGGCTCTGTGTTTTTCTCTTGTATGGGGTGCACATG
9VSP      TGATTAGTCGTATCTTCTTTGTTATGGCTCTGTGTTTTTCTCTTGTATGGGGTGCACATG
TIGR4     --ATTAGTCGTATCTTCTTTGTTATGGCTCTGTGTTTTTCTCTTGTATGGGGTGCACATG
23FTW     --ATTAGTCGTATCTTCTTTGTTATGGCTCTGTGTTTTTCTCTTGTATGGGGTGCACATG
            **********************************************************

14CSR     CAGTCCAAGCGCAAGAAGATCACACGTTGGTCTTGCAATTGGAGAACTATCAGGAGGTGG
670       CAGTCCAAGCGCAAGAAGATCACACGTTGGTCTTGCAATTGGAGAACTATCAGGAGGTGG
6BF       CAGTCCAAGCGCAAGAAGATCACACGTTGGTCTTGCAATTGGAGAACTATCAGGAGGTGG
6BSP      CAGTCCAAGCGCAAGAAGATCACACGTTGGTCTTGCAATTGGAGAACTATCAGGAGGTGG
19AH      CAGTCCAAGCGCAAGAAGATCACACGTTGGTCTTGCAATTGGAGAACTATCAGGAGGTGG
23FPO     CAGTCCAAGCGCAAGAAGATCACACGTTGGTCTTGCAATTGGAGAACTATCAGGAGGTGG
19FTW     CAGTCCAAGCGCAAGAAGATCACACGTTGGTCTTGCAATTGGAGAACTATCAGGAGGTGG
9VSP      CAGTCCAAGCGCAAGAAGATCACACGTTGGTCTTGCAATTGGAGAACTATCAGGAGGTGG
TIGR4     CAGTCCAAGCGCAAGAAGATCACACGTTGGTCTTGCAATTGGAGAACTATCAGGAGGTGG
23FTW     CAGTCCAAGCGCAAGAAGATCACACGTTGGTCTTGCAATTGGAGAACTATCAGGAGGTGG
          ************************************************************

14CSR     TTAGTCAATTGCCATCTCGTGATGGTCATCGGTTGCAAGTATGGAAGTTGGATGATTCGT
670       TTAGTCAATTGCCATCTCGTGATGGTCATCGGTTGCAAGTATGGAAGTTGGATGATTCGT
6BF       TTAGTCAATTGCCATCTCGTGATGGTCATCGGTTGCAAGTATGGAAGTTGGATGATTCGT
6BSP      TTAGTCAATTGCCATCTCGTGATGGTCATCGGTTGCAAGTATGGAAGTTGGATGATTCGT
19AH      TTAGTCAATTGCCATCTCGTGATGGTCATCGGTTGCAAGTATGGAAGTTGGATGATTCGT
23FPO     TTAGTCAATTGCCATCTCGTGATGGTCATCGGTTGCAGGTATGGAAGTTGGATGATTCGT
19FTW     TTAGTCAATTGCCATCTCGTGATGGTCATCGGTTGCAGGTATGGAAGTTGGATGATTCGT
9VSP      TTAGTCAATTGCCATCTCGTGATGGTCATCGGTTGCAAGTATGGAAGTTGGATGATTCGT
TIGR4     TTAGTCAATTGCCATCTCGTGATGGTCATCGGTTGCAAGTATGGAAGTTGGATGATTCGT
23FTW     TTAGTCAATTGCCATCTCGTGATGGTCATCGGTTGCAGGTATGGAAGTTGGATGATTCGT
          ************************************* **********************
```

Figure 196Y

```
14CSR    ATTCCTATGATGATCGGGTGCAAATTGTAAGAGACTTGCATTCGTGGGATGAGAATAAAC
670      ATTCCTATGATGATCGGGTGCAAATTGTAAGAGACTTGCATTCGTGGGATGAGAATAAAC
6BF      ATTCCTATGATGATCGGGTGCAAATTGTAAGAGACTTGCATTCGTGGGATGAGAATAAAC
6BSP     ATTCCTATGATGATCGGGTGCAAATTGTAAGAGACTTGCATTCGTGGGATGAGAATAAAC
19AH     ATTCCTATGATGATCGGGTGCAAATTGTAAGAGACTTGCATTCGTGGGATGAGAATAAAC
23FPO    ATTCCTATGATAATCGGGTGCAAATTGTGAGAGACTTGCATTCGTGGGATGAGAATAAAC
19FTW    ATTCCTATGATAATCGGGTGCAAATTGTGAGAGACTTGCATTCGTGGGATGAGAATAAAC
9VSP     ATTCCTATGATAATCGGGTGCAAATTGTGAGAGACTTGCATTCGTGGGATGAGAATAAAC
TIGR4    ATTCCTATGATGATCGGGTGCAAATTGTAAGAGACTTGCATTCGTGGGATGAGAATAAAC
23FTW    ATTCCTATGATAATCGGGTGCAAATTGTGAGAGACTTGCATTCGTGGGATGAGAATAAAC
         *********** **************** *******************************

14CSR    TTTCTTCTTTCAAAAAGACTTCGTTTGAGATGACCTTCCTTGAGAATCAGATTGAAGTAT
670      TTTCTTCTTTCAAAAAGACTTCGTTTGAGATGACCTTCCTTGAGAATCAGATTGAAGTAT
6BF      TTTCTTCTTTCAAAAAGACTTCGTTTGAGATGACCTTCCTTGAGAATCAGATTGAAGTAT
6BSP     TTTCTTCTTTCAAAAAGACTTCGTTTGAGATGACCTTCCTTGAGAATCAGATTGAAGTAT
19AH     TTTCTTCTTTCAAAAAGACTTCGTTTGAGATGACCTTCCTTGAGAATCAGATTGAAGTAT
23FPO    TTTCTTCTTTCAAAAAGACTTCGTTTGAGATGACCTTCCTTGAGAATCAGATTGAAGTAT
19FTW    TTTCTTCTTTCAAAAAGACTTCGTTTGAGATGACCTTCCTTGAGAATCAGATTGAAGTAT
9VSP     TTTCTTCTTTCAAAAAGACTTCGTTTGAGATGACCTTCCTTGAGAATCAGATTGAAGTAT
TIGR4    TTTCTTCTTTCAAAAAGACTTCGTTTGAGATGACCTTCCTTGAGAATCAGATTGAAGTAT
23FTW    TTTCTTCTTTCAAAAAGACTTCGTTTGAGATGACCTTCCTTGAGAATCAGATTGAAGTAT
         ************************************************************

14CSR    CTCATATTCCAAATGGTCTTTACTATGTTCGCTCTATTATCCAGACGGATGCGGTTTCTT
670      CTCATATTCCAAATGGTCTTTACTATGTTCGCTCTATTATCCAGACGGATGCGGTTTCTT
6BF      CTCATATTCCAAATGGTCTTTACTATGTTCGCTCTATTATCCAGACGGATGCGGTTTCTT
6BSP     CTCATATTCCAAATGGTCTTTACTATGTTCGCTCTATTATCCAGACGGATGCGGTTTCTT
19AH     CTCATATTCCAAATGGTCTTTACTATGTTCGCTCTATTATCCAGACGGATGCGGTTTCTT
23FPO    CTCATATTCCAAATGGTCTTTACTATGTTCGCTCTATTATCCAGACGGATGCGGTTTCTT
19FTW    CTCATATTCCAAATGGTCTTTACTATGTTCGCTCTATTATCCAGACGGATGCGGTTTCTT
9VSP     CTCATATTCCAAATGGTCTTTACTATGTTCGCTCTATTATCCAGACGGATGCGGTTTCTT
TIGR4    CTCATATTCCAAATGGTCTTTACTATGTTCGCTCTATTATCCAGACGGATGCGGTTTCTT
23FTW    CTCATATTCCAAATGGTCTTTACTATGTTCGCTCTATTATCCAGACGGATGCGGTTTCTT
         ************************************************************

14CSR    ATCCAGCTGAATTTCTTTTTGAAATGACAGATCAAACGGTAGAGCCTTTGGTCATTGTAG
670      ATCCAGCTGAATTTCTTTTTGAAATGACAGATCAAACGGTAGAGCCTTTGGTCATTGTAG
6BF      ATCCAGCTGAATTTCTTTTTGAAATGACAGATCAAACGGTAGAGCCTTTGGTCATTGTAG
6BSP     ATCCAGCTGAATTTCTTTTTGAAATGACAGATCAAACGGTAGAGCCTTTGGTCATTGTAG
19AH     ATCCAGCTGAATTTCTTTTTGAAATGACAGATCAAACGGTAGAGCCTTTGGTCATTGTAG
23FPO    ATCCAGCTGAATTTCTTTTTGAAATGACAGATCAGACGGTAGAGCCTTTGGTCATTGTAG
19FTW    ATCCAGCTGAATTTCTTTTTGAAATGACAGATCAGACGGTAGAGCCTTTGGTCATTGTAG
9VSP     ATCCAGCTGAATTTCTTTTTGAAATGACAGATCAGACGGTAGAGCCTTTGGTCATTGTAG
TIGR4    ATCCAGCTGAATTTCTTTTTGAAATGACAGATCAAACGGTAGAGCCTTTGGTCATTGTAG
23FTW    ATCCAGCTGAATTTCTTTTTGAAATGACAGATCAGACGGTAGAGCCTTTGGTCATTGTAG
         ********************************** *************************

14CSR    CGAAAAAAACAGATACAATGACAACAAAGGTGAAGCTGATAAAGGTGGATCAAGACCACA
670      CGAAAAAAACAGATACAATGACAACAAAGGTGAAGCTGATAAAGGTGGATCAAGACCACA
6BF      CGAAAAAAACAGATACAATGACAACAAAGGTGAAGCTGATAAAGGTGGATCAAGACCACA
6BSP     CGAAAAAAACAGATACAATGACAACAAAGGTGAAGCTGATAAAGGTGGATCAAGACCACA
19AH     CGAAAAAAACAGATACAATGACAACAAAGGTGAAGCTGATAAAGGTGGATCAAGACCACA
23FPO    CGAAAAAAGCAGATACGGTGACAACAAAGGTGAAGCTGATAAAGGTGGATCAAGACCACA
19FTW    CGAAAAAAGCAGATACGGTGACAACAAAGGTGAAGCTGATAAAGGTGGATCAAGACCACA
9VSP     CGAAAAAAGCAGATACGGTGACAACAAAGGTGAAGCTGATAAAGGTGGATCAAGACCACA
TIGR4    CGAAAAAAACAGATACAATGACAACAAAGGTGAAGCTGATAAAGGTGGATCAAGACCACA
23FTW    CGAAAAAAGCAGATACGGTGACAACAAAGGTGAAGCTGATAAAGGTGGATCAAGACCACA
         ******** *******  ******************************************
```

Figure 196Z

```
14CSR    ATCGCTTGGAGGGTGTCGGCTTTAAATTGGTATCAGTAGCAAGAGATGGTTCTGAAAAAG
670      ATCGCTTGGAGGGTGTCGGCTTTAAATTGGTATCAGTAGCAAGAGATGGTTCTGAAAAAG
6BF      ATCGCTTGGAGGGTGTCGGCTTTAAATTGGTATCAGTAGCAAGAGATGGTTCTGAAAAAG
6BSP     ATCGCTTGGAGGGTGTCGGCTTTAAATTGGTATCAGTAGCAAGAGATGGTTCTGAAAAAG
19AH     ATCGCTTGGAGGGTGTCGGCTTTAAATTGGTATCAGTAGCAAGAGATGGTTCTGAAAAAG
23FPO    ATCGCTTGGAGGGTGTCGGCTTTAAATTGGTATCAGTAGCAAGAGATGGTTCTGAAAAAG
19FTW    ATCGCTTGGAGGGTGTCGGCTTTAAATTGGTATCAGTAGCAAGAGATGGTTCTGAAAAAG
9VSP     ATCGCTTGGAGGGTGTCGGCTTTAAATTGGTATCAGTAGCAAGAGATGGTTCTGAAAAAG
TIGR4    ATCGCTTGGAGGGTGTCGGCTTTAAATTGGTATCAGTAGCAAGAGATGTTTCTGAAAAAG
23FTW    ATCGCTTGGAGGGTGTCGGCTTTAAATTGGTATCAGTAGCAAGAGATGGTTCTGAAAAAG
         ************************************************ ***********

14CSR    AGGTTCCCTTGATTGGAGAATACCGTTACAGTTCTTCTGGTCAAGTAGGGAGAACTCTCT
670      AGGTTCCCTTGATTGGAGAATACCGTTACAGTTCTTCTGGTCAAGTAGGGAGAACTCTCT
6BF      AGGTTCCCTTGATTGGAGAATACCGTTACAGTTCTTCTGGTCAAGTAGGGAGAACTCTCT
6BSP     AGGTTCCCTTGATTGGAGAATACCGTTACAGTTCTTCTGGTCAAGTAGGGAGAACTCTCT
19AH     AGGTTCCCTTGATTGGAGAATACCGTTACAGTTCTTCTGGTCAAGTAGGGAGAACTCTCT
23FPO    AGGTTCCCTTGATTGGAGAATACCGTTACAGTTCTTCTGGTCAAGTAGGGAGAACTCTCT
19FTW    AGGTTCCCTTGATTGGAGAATACCGTTACAGTTCTTCTGGTCAAGTAGGGAGAACTCTCT
9VSP     AGGTTCCCTTGATTGGAGAATACCGTTACAGTTCTTCTGGTCAAGTAGGGAGAACTCTCT
TIGR4    AGGTTCCCTTGATTGGAGAATACCGTTACAGTTCTTCTGGTCAAGTAGGGAGAACTCTCT
23FTW    AGGTTCCCTTGATTGGAGAATACCGTTACAGTTCTTCTGGTCAAGTAGGGAGAACTCTCT
         ************************************************************

14CSR    ATACTGATAAAAATGGAGAGATTTTTGTGACAAATCTTCCTCTTGGGAACTATCGTTTCA
670      ATACTGATAAAAATGGAGAGATTTTTGTGACAAATCTTCCTCTTGGGAACTATCGTTTCA
6BF      ATACTGATAAAAATGGAGAGATTTTTGTGACAAATCTTCCTCTTGGGAACTATCGTTTCA
6BSP     ATACTGATAAAAATGGAGAGATTTTTGTGACAAATCTTCCTCTTGGGAACTATCGTTTCA
19AH     ATACTGATAAAAATGGAGAGATTTTTGTGACAAATCTTCCTCTTGGGAACTATCGTTTCA
23FPO    ATACTGATAAAAATGGAGAGATTGTTGTGACAAATCTTCCTCTTGGGACCTATCGTTTCA
19FTW    ATACTGATAAAAATGGAGAGATTGTTGTGACAAATCTTCCTCTTGGGACCTATCGTTTCA
9VSP     ATACTGATAAAAATGGAGAGATTGTTGTGACAAATCTTCCTCTTGGGACCTATCGTTTCA
TIGR4    ATACTGATAAAAATGGAGAGATTTTTGTGACAAATCTTCCTCTTGGGAACTATCGTTTCA
23FTW    ATACTGATAAAAATGGAGAGATTGTTGTGACAAATCTTCCTCTTGGGACCTATCGTTTCA
         *********************** ************************* **********

14CSR    AGGAGGTGGAGCCACTGGCAGGCTATGCTGTTACGACGCTGGATACGGATGTCCAGCTGG
670      AGGAGGTGGAGCCACTGGCAGGCTATGCTGTTACGACGCTGGATACGGATGTCCAGCTGG
6BF      AGGAGGTGGAGCCACTGGCAGGCTATGCTGTTACGACGCTGGATACGGATGTCCAGCTGG
6BSP     AGGAGGTGGAGCCACTGGCAGGCTATGCTGTTACGACGCTGGATACGGATGTCCAGCTGG
19AH     AGGAGGTGGAGCCACTGGCAGGCTATGCTGTTACGACGCTGGATACGGATGTCCAGCTGG
23FPO    AGGAGGTGGAGCCACTGGCAGGCTATGCTGTTACGACGATGGATACGGATGTCCAGTTGG
19FTW    AGGAGGTGGAGCCACTGGCAGGCTATACTGTTACGACGATGGATACGGATGTCCAGTTGG
9VSP     AGGAGGTGGAGCCACTGGCAGGCTATACTGTTACGACGATGGATACGGATGTCCAGTTGG
TIGR4    AGGAGGTGGAGCCACTGGCAGGCTATGCTGTTACGACGCTGGATACGGATGTCCAGCTGG
23FTW    AGGAGGTGGAGCCACTGGCAGGCTATACTGTTACGACGATGGATACGGATGTCCAGTTGG
         ************************** *********** ***************** ***

14CSR    TAGATCATCAGCTGGTGACGATTACGGTTGTCAATCAGAAATTACCACGTGGCAATGTTG
670      TAGATCATCAGCTGGTGACGATTACGGTTGTCAATCAGAAATTACCACGTGGCAATGTTG
6BF      TAGATCATCAGCTGGTGACGATTACGGTTGTCAATCAGAAATTACCACGTGGCAATGTTG
6BSP     TAGATCATCAGCTGGTGACGATTACGGTTGTCAATCAGAAATTACCACGTGGCAATGTTG
19AH     TAGATCATCAGCTGGTGACGATTACGGTTGTCAATCAGAAATTACCACGTGGCAATGTTG
23FPO    TAGATCATCAGCTGGTGACGATTACGGTTGTCAATCAGAAATTACCACGTGGCAATGTTG
19FTW    TAGATCATCAGCTGGTGACGATTACGGTTGTCAATCAGAAATTACCACGTGGCAATGTTG
9VSP     TAGATCATCAGCTGGTGACGATTACGGTTGTCAATCAGAAATTACCACGTGGCAATGTTG
TIGR4    TAGATCATCAGCTGGTGACGATTACGGTTGTCAATCAGAAATTACCACGTGGCAATGTTG
23FTW    TAGATCATCAGCTGGTGACGATTACGGTTGTCAATCAGAAATTACCACGTGGCAATGTTG
         ************************************************************
```

Figure 196AA

```
14CSR    ACTTTATGAAGGTGGATGGTCGGACCAATACCTCTCTTCAAGGGGCAATGTTCAAAGTCA
670      ACTTTATGAAGGTGGATGGTCGGACCAATACCTCTCTTCAAGGGGCAATGTTCAAAGTCA
6BF      ACTTTATGAAGGTGGATGGTCGGACCAATACCTCTCTTCAAGGGGCAATGTTCAAAGTCA
6BSP     ACTTTATGAAGGTGGATGGTCGGACCAATACCTCTCTTCAAGGGGCAATGTTCAAAGTCA
19AH     ACTTTATGAAGGTGGATGGTCGGACCAATACCTCTCTTCAAGGGGCAATGTTCAAAGTCA
23FPO    ACTTTATGAAGGTGGATGGTCGGACCAATACCTCTCTTCAAGGGGCAATGTTCAAAGTCA
19FTW    ACTTTATGAAGGTGGATGGTAGGACCAATACCTCTCTTCAAGGGGCAATGTTCAAAGTCA
9VSP     ACTTTATGAAGGTGGATGGTAGGACCAATACCTCTCTTCAAGGGGCAATGTTCAAAGTCA
TIGR4    ACTTTATGAAGGTGGATGGTCGGACCAATACCTCTCTTCAAGGGGCAATGTTCAAAGTCA
23FTW    ACTTTATGAAGGTGGATGGTCGGACCAATACCTCTCTTCAAGGGGCAATGTTCAAAGTCA
         ******************** ***************************************

14CSR    TGAAAGAAGAAAGCGGACACTATACTCCTGTTCTTCAAAATGGTAAGGAAGTAGTTGTAA
670      TGAAAGAAGAAAGCGGACACTATACTCCTGTTCTTCAAAATGGTAAGGAAGTAGTTGTAA
6BF      TGAAAGAAGAAAGCGGACACTATACTCCTGTTCTTCAAAATGGTAAGGAAGTAGTTGTAA
6BSP     TGAAAGAAGAAAGCGGACACTATACTCCTGTTCTTCAAAATGGTAAGGAAGTAGTTGTAA
19AH     TGAAAGAAGAAAGCGGACACTATACTCCTGTTCTTCAAAATGGTAAGGAAGTAGTTGTAA
23FPO    TGAAAGAAGAAAACGGACACTATACTCCTGTTCTTCAAAATGGTAAGGAAGTAGTTGTGG
19FTW    TGAAAGAAGAAAACGGACACTATACTCCTGTTCTTCAAAATGGTAAGGAAGTAGTTGTGG
9VSP     TGAAAGAAGAAAACGGACACTATACTCCTGTTCTTCAAAATGGTAAGGAAGTAGTTGTGG
TIGR4    TGAAAGAAGAAAGCGGACACTATACTCCTGTTCTTCAAAATGGTAAGGAAGTAGTTGTAA
23FTW    TGAAAGAAGAAAACGGACACTATACTCCTGTTCTTCAAAATGGTAAGGAAGTAGTTGTGG
         ************ *********************************************

14CSR    CATCAGGGAAAGATGGTCGTTTCCGAGTGGAAGGTCTAGAGTATGGGACATACTATTTAT
670      CATCAGGGAAAGATGGTCGTTTCCGAGTGGAAGGTCTAGAGTATGGGACATACTATTTAT
6BF      CATCAGGGAAAGATGGTCGTTTCCGAGTGGAAGGTCTAGAGTATGGGACATACTATTTAT
6BSP     CATCAGGGAAAGATGGTCGTTTCCGAGTGGAAGGTCTAGAGTATGGGACATACTATTTAT
19AH     CATCAGGGAAAGATGGTCGTTTCCGAGTGGAAGGTCTAGAGTATGGGACATACTATTTAT
23FPO    CATCAGGGAAAGATGGTCGTTTCCGAGTGGAAGGTCTAGAGTATGGGACATACTATTTAT
19FTW    CATCAGGGAAAGATGGTCGTTTCCGAGTGGAAGGTCTAGAGTATGGGACATACTATTTAT
9VSP     CATCAGGGAAAGATGGTCGTTTCCGAGTGGAAGGTCTAGAGTATGGGACATACTATTTAT
TIGR4    CATCAGGGAAAGATGGTCGTTTCCGAGTGGAAGGTCTAGAGTATGGGACATACTATTTAT
23FTW    CATCAGGGAAAGATGGTCGTTTCCGAGTGGAAGGTCTAGAGTATGGGACATACTATTTAT
         ************************************************************

14CSR    GGGAGCTCCAAGCTCCAACTGGTTATGTTCAATTAACATCGCCTGTTTCCTTTACAATCG
670      GGGAGCTCCAAGCTCCAACTGGTTATGTTCAATTAACATCGCCTGTTTCCTTTACAATCG
6BF      GGGAGCTCCAAGCTCCAACTGGTTATGTTCAATTAACATCGCCTGTTTCCTTTACAATCG
6BSP     GGGAGCTCCAAGCTCCAACTGGTTATGTTCAATTAACATCGCCTGTTTCCTTTACAATCG
19AH     GGGAGCTCCAAGCTCCAACTGGTTATGTTCAATTAACATCGCCTGTTTCCTTTACAATCG
23FPO    GGGAGCTCCAAGCTCCAACTGGTTATGTTCAATTAACATCGCCTGTTTCCTTTACAATCG
19FTW    GGGAGCTCCAAGCTCCAACTGGTTATGTTCAATTAACATCGCCTGTTTCCTTTACAATCG
9VSP     GGGAGCTCCAAGCTCCAACTGGTTATGTTCAATTAACATCGCCTGTTTCCTTTACAATCG
TIGR4    GGGAGCTCCAAGCTCCAACTGGTTATGTTCAATTAACATCGCCTGTTTCCTTTACAATCG
23FTW    GGGAGCTCCAAGCTCCAACTGGTTATGTTCAATTAACATCGCCTGTTTCCTTTACAATCG
         ************************************************************

14CSR    GGAAAGATACTCGTAAGGAACTGGTAACAGTGGTTAAAAATAACAAGCGACCACGGATTG
670      GGAAAGATACTCGTAAGGAACTGGTAACAGTGGTTAAAAATAACAAGCGACCACGGATTG
6BF      GGAAAGATACTCGTAAGGAACTGGTAACAGTGGTTAAAAATAACAAGCGACCACGGATTG
6BSP     GGAAAGATACTCGTAAGGAACTGGTAACAGTGGTTAAAAATAACAAGCGACCACGGATTG
19AH     GGAAAGATACTCGTAAGGAACTGGTAACAGTGGTTAAAAATAACAAGCGACCACGGATTG
23FPO    GGAAAGATACTCGTAAGGAACTGGTAACAGTGGTTAAAAATAACAAGCGACCACGGATTG
19FTW    GGAAAGATACTCGTAAGGAACTGGTAACAGTGGTTAAAAATAACAAGCGACCACGGATTG
9VSP     GGAAAGATACTCGTAAGGAACTGGTAACAGTGGTTAAAAATAACAAGCGACCACGGATTG
TIGR4    GGAAAGATACTCGTAAGGAACTGGTAACAGTGGTTAAAAATAACAAGCGACCACGGATTG
23FTW    GGAAAGATACTCGTAAGGAACTGGTAACAGTGGTTAAAAATAACAAGCGACCACGGATTG
         ************************************************************
```

Figure 196AB

```
14CSR      ATGTGCCAGATACAGGGGAAGAAACCTTGTATATCTTGATGCTTGTTGCCATTTTGTTGT
670        ATGTGCCAGATACAGGGGAAGAAACCTTGTATATCTTGATGCTTGTTGCCATTTTGTTGT
6BF        ATGTGCCAGATACAGGGGAAGAAACCTTGTATATCTTGATGCTTGTTGCCATTTTGTTGT
6BSP       ATGTGCCAGATACAGGGGAAGAAACCTTGTATATCTTGATGCTTGTTGCCATTTTGTTGT
19AH       ATGTGCCAGATACAGGGGAAGAAACCTTGTATATCTTGATGCTTGTTGCCATTTTGTTGT
23FPO      ATGTGCCAGATACAGGGGAAGAAACCTTGTATATCTTGATGCTTGTTGCCATTTTGTTGT
19FTW      ATGTGCCAGATACAGGGGAAGAAACCTTGTATATCTTGATGCTTGTTGCCATTTTGTTGT
9VSP       ATGTGCCAGATACAGGGGAAGAAACCTTGTATATCTTGATGCTTGTTGCCATTTTGTTGT
TIGR4      ATGTGCCAGATACAGGGGAAGAAACCTTGTATATCTTGATGCTTGTTGCCATTTTGTTGT
23FTW      ATGTGCCAGATACAGGGGAAGAAACCTTGTATATCTTGATGCTTGTTGCCATTTTGTTGT
           ************************************************************

14CSR      TTGGTAGTGGTTATTATCTTACGAAAAAACCAAATAACTGATATTCAATGTACATCATTA
670        TTGGTAGTGGTTATTATCTTACGAAAAAACCAAATAACTGATATTCAATGTACATCATTA
6BF        TTGGTAGTGGTTATTATCTTACGAAAAAACCAAATAACTGATATTCAATGTACATCATTA
6BSP       TTGGTAGTGGTTATTATCTTACGAAAAAACCAAATAACTGATATTCAATGTACATCATTA
19AH       TTGGTAGTGGTTATTATCTTACGAAAAAACCAAATAACTGATATTCAATGTACATCATTA
23FPO      TTGGTAGTGGCTATTATCTTACGAAAAAAACAAATAACTGATATTCAATGTACATCATTA
19FTW      TTGGTAGTGGCTATTATCTTACGAAAAAAACAAATAACTGATATTCAATGTACATCATTA
9VSP       TTGGTAGTGGCTATTATCTTACGAAAAAAACAAATAACTGATATTCAATGTACATCATTA
TIGR4      TTGGTAGTGGTTATTATCTTACGAAAAAACCAAATAACTGATATTCAATGTACATCATTA
23FTW      TTGGTAGTGGCTATTATCTTACGAAAAAAACAAATAACTGATATTCAATGTACATCATTA
           ********** ****************** ******************************

14CSR      TGAAAAAGATAGCAGGCTGAAGGGAAGACCAGAGTACTCTGAGGTGATGTTAATCAGGAA
670        TGAAAAAGATAGCAGGCTGAAGGGAAGACCAGAGTACTCTGAGGTGATGTTAATCAGGAA
6BF        TGAAAAAGATAGCAGGCTGAAGGGAAGACCAGAGTACTCTGAGGTGATGTTAATCAGGAA
6BSP       TGAAAAAGATAGCAGGCTGAAGGGAAGACCAGAGTACTCTGAGGTGATGTTAATCAGGAA
19AH       TGAAAAAGATAGCAGGCTGAAGGGAAGACCAGAGTACTCTGAGGTGATGTTAATCAGGAA
23FPO      TGAAAAAGATAGCAGGCTGAAGGGAAGACCAGAGTACTCTGAGGTGATGTTAATCAGGAA
19FTW      TGAAAAAGATAGCAGGCTGAAGGGAAGACCAGAGTACTCTGAGGTGATGTTAATCAGGAA
9VSP       TGAAAAAGATAGCAGGCTGAAGGGAAGACCAGAGTACTCTGAGGTGATGTTAATCAGGAA
TIGR4      TGAAAAAGATAGCAGGCTGAAGGGAAGACCAGAGTACTCTGAGGTGATGTTAATCAGGAA
23FTW      TGAAAAAGATAGCAGGCTGAAGGGAAGACCAGAGTACTCTGAGGTGATGTTAATCAGGAA
           ************************************************************

14CSR      TCATGGTGATGTGGCATGAATCACAATAACGGATATGAGGCTGGGCAGATTGTGCCAGCC
670        TCATGGTGATGTGGCATGAATCACAATAACGGATATGAGGCTGGGCAGATTGTGCCAGCC
6BF        TCATGGTGATGTGGCATGAATCACAATAACGGATATGAGGCTGGGCAGATTGTGCCAGCC
6BSP       TCATGGTGATGTGGCATGAATCACAATAACGGATATGAGGCTGGGCAGATTGTGCCAGCC
19AH       TCATGGTGATGTGGCATGAATCACAATAACGGATATGAGGCTGGGCAGATTGTGCCAGCC
23FPO      TCATGGTGATTTGGCATGAATCATAATAACGGATATGAGGCTGGGCAGATTGTGCCAGCC
19FTW      TCATGGTGATTTGGCATGAATCATAATAACGGATATGAGGCTGGGCAGATTGTGCCAGCC
9VSP       TCATGGTGATTTGGCATGAATCATAATAACGGATATGAGGCTGGGCAGATTGTGCCAGCC
TIGR4      TCATGGTGATGTGGCATGAATCACAATAACGGATATGAGGCTGGGCAGATTGTGCCAGCC
23FTW      TCATGGTGATTTGGCATGAATCACAATAACGGATATGAGGCTGGGCAGATTGTGCCAGCC
           ********** ************ ************************************

14CSR      TCATTGTGGGTTATTGTTTGTAAAACGATAGGACTGGTCTGGTAATCATTTTAGGAATGG
670        TCATTGTGGGTTATTGTTTGTAAAACGATAGGACTGGTCTGGTAATCATTTTAGGAATGG
6BF        TCATTGTGGGTTATTGTTTGTAAAACGATAGGACTGGTCTGGTAATCATTTTAGGAATGG
6BSP       TCATTGTGGGTTATTGTTTGTAAAACGATAGGACTGGTCTGGTAATCATTTTAGGAATGG
19AH       TCATTGTGGGTTATTGTTTGTAAAACGATAGGACTGGTCTGGTAATCATTTTAGGAATGG
23FPO      TCATTGTGGGTTATTGTTTGTAAAACGATAGGACTGGTCTGGTAATCATTTTAGGAATGG
19FTW      TCATTGTGGGTTATTGTTTGTAAAACGATAGGACTGGTCTGGTAATCATTTTAGGAATGG
9VSP       TCATTGTGGGTTATTGTTTGTAAAACGATAGGACTGGTCTGGTAATCATTTTAGGAATGG
TIGR4      TCATTGTGGGTTATTGTTTGTAAAACGATAGGACTGGTCTGGTAATCATTTTAGGAATGG
23FTW      TCATTGTGGGTTATTGTTTGTAAAACGATAGGACTGGTCTGGTAATCATTTTAGGAATGG
           ************************************************************
```

Figure 196AC

```
14CSR     ACAGGACTGGGATTCTGATTTAAAATGGATGGTGAATCAGAAAGAAATGAGATTTTCTCG
670       ACAGGACTGGGATTCTGATTTAAAATGGATGGTGAATCAGAAAGAAATGAGATTTTCTCG
6BF       ACAGGACTGGGATTCTGATTTAAAATGGATGGTGAATCAGAAAGAAATGAGATTTTCTCG
6BSP      ACAGGACTGGGATTCTGATTTAAAATGGATGGTGAATCAGAAAGAAATGAGATTTTCTCG
19AH      ACAGGACTGGGATTCTGATTTAAAATGGATGGTGAATCAGAAAGAAATGAGATTTTCTCG
23FPO     ACAGGACTGGGATTCTGATTTAAAATGGATGGTGAATCAGAAAGAAATGAGATTTTCTCG
19FTW     ACAGGACTGGGATTCTGATTTAAAATGGATGGTGAATCAGAAAGAAATGAGATTTTCTCG
9VSP      ACAGGACTGGGATTCTGATTTAAAATGGATGGTGAATCAGAAAGAAATGAGATTTTCTCG
TIGR4     ACAGGACTGGGATTCTGATTTAAAATGGATGGTGAATCAGAAAGAAATGAGATTTTCTCG
23FTW     ACAGGACTGGGATTCTGATTTAAAATGGATGGTGAATCAGAAAGAAATGAGATTTTCTCG
          ************************************************************

14CSR     TTTCTCTTAGCAGATAGGATTGTCTGTTAGGAAAAGCGATAAAATGATGAGTTTGAAGAT
670       TTTCTCTTAGCAGATAGGATTGTCTGTTAGGAAAAGCGATAAAATGATGAGTTTGAAGAT
6BF       TTTCTCTTAGCAGATAGGATTGTCTGTTAGGAAAAGCGATAAAATGATGAGTTTGAAGAT
6BSP      TTTCTCTTAGCAGATAGGATTGTCTGTTAGGAAAAGCGATAAAATGATGAGTTTGAAGAT
19AH      TTTCTCTTAGCAGATAGGATTGTCTGTTAGGAAAAGCGATAAAATGATGAGTTTGAAGAT
23FPO     TTTCTCTTAGCAGATAGGATTGTCTGTTAGGAAAAGCGATAAAATGATGAGTTTGAAGTT
19FTW     TTTCTCTTAGCAGATAGGATTGTCTGTTAGGAAAAGCGATAAAATGATGAGTTTGAAGTT
9VSP      TTTCTCTTAGCAGATAGGATTGTCTGTTAGGAAAAGCGATAAAATGATGAGTTTGAAGTT
TIGR4     TTTCTCTTAGCAGATAGGATTGTCTGTTAGGAAAAGCGATAAAATGATGAGTTTGAAGAT
23FTW     TTTCTCTTAGCAGATAGGATTGTCTGTTAGGAAAAGCGATAAAATGATGAGTTTGAAGAT
          ********************************************************** *

14CSR     AAAGGGATGCTGATAAAAA-TGGTAAAAACAAAAAAGCAAAAACGAAATAATCTCCTATT
670       AAAGGGATGCTGATAAAAA-TGGTAAAAACAAAAAAGCAAAAACGAAATAATCTCCTATT
6BF       AAAGGGATGCTGATAAAAA-TGGTAAAAACAAAAAAGCAAAAACGAAATAATCTCCTATT
6BSP      AAAGGGATGCTGATAAAAA-TGGTAAAAACAAAAAAGCAAAAACGAAATAATCTCCTATT
19AH      AAAGGGATGCTGATAAAAA-TGGTAAAAACAAAAAAGCAAAAACGAAATAATCTCCTATT
23FPO     AAAGGAATGCTGATAAAAAATGGCAAAAACAAAAAAGCAAAAACGAAACAATCTCCTATT
19FTW     AAAGGAATGCTGATAAAAAATGGCAAAAACAAAAAAGCAAAAACGAAACAATCTCCTATT
9VSP      AAAGGAATGCTGATAAAAAATGGCAAAAACAAAAAAGCAAAAACGAAACAATCTCCTATT
TIGR4     AAAGGGATGCTGATAAAAA-TGGTAAAAACAAAAAAGCAAAAACGAAATAATCTCCTATT
23FTW     AAAGGGATGCTGATAAAAA-TGGTAAAAACAAAAAAGCAAAAACGAAATAATCTCCTATT
          ***** ************* *** ************************ ***********

14CSR     AGGAGTGGTATTTTTCATTGGAATGGCGGTAATGGCGTATCCGCTGGTGTCTCGCTTGTA
670       AGGAGTGGTATTTTTCATTGGAATGGCGGTAATGGCGTATCCGCTGGTGTCTCGCTTGTA
6BF       AGGAGTGGTATTTTTCATTGGAATGGCGGTAATGGCGTATCCGCTGGTGTCTCGCTTGTA
6BSP      AGGAGTGGTATTTTTCATTGGAATGGCGGTAATGGCGTATCCGCTGGTGTCTCGCTTGTA
19AH      AGGAGTGGTATTTTTCATTGGAATGGCGGTAATGGCGTATCCGCTGGTGTCTCGCTTGTA
23FPO     AGGAGTGGTATTTTTCATTGGAATAGCGGTAATGGCGTATCCGCTGGTGTCTCGCTTGTA
19FTW     AGGAGTGGTATTTTTCATTGGAATGGCGGTAATGGCGTATCCGCTGGTGTCTCGCTTGTA
9VSP      AGGAGTGGTATTTTTCATTGGAATAGCGGTAATGGCGTATCCGCTGGTGTCTCGCTTGTA
TIGR4     AGGAGTGGTATTTTTCATTGGAATGGCGGTAATGGCGTATCCGCTGGTGTCTCGCTTGTA
23FTW     AGGAGTGGTATTTTTCATTGGAATGGCGGTAATGGCGTATCCGCTGGTGTCTCGCTTGTA
          *********************** ************************************

14CSR     TTATCGAGTGGAATCAAATCAACAAATTGCTGACTTTGATAAGGAAAAAGCAACGTTGGA
670       TTATCGAGTGGAATCAAATCAACAAATTGCTGACTTTGATAAGGAAAAAGCAACGTTGGA
6BF       TTATCGAGTGGAATCAAATCAACAAATTGCTGACTTTGATAAGGAAAAAGCAACGTTGGA
6BSP      TTATCGAGTGGAATCAAATCAACAAATTGCTGACTTTGATAAGGAAAAAGCAACGTTGGA
19AH      TTATCGAGTGGAATCAAATCAACAAATTGCTGACTTTGATAAGGAAAAAGCAACGTTGGA
23FPO     TTATCGAGTGGAATCAAATCAACAAATTGCTGACTTTGATAAGGAAAAAGCAACGTTGGA
19FTW     TTATCGAGTGGAATCAAATCAACAAATTGCTGACTTTGATAAGGAAAAAGCAACGTTGGA
9VSP      TTATCGAGTGGAATCAAATCAACAAATTGCTGACTTTGATAAGGAAAAAGCAACGTTGGA
TIGR4     TTATCGAGTGGAATCAAATCAACAAATTGCTGACTTTGATAAGGAAAAAGCAACGTTGGA
23FTW     TTATCGAGTGGAATCAAATCAACAAATTGCTGACTTTGATAAGGAAAAAGCAACGTTGGA
          ************************************************************
```

Figure 196AD

```
14CSR     TGAGGCTGACATTGATGAACGAATGAAATTGGCACAAGCCTTCAATGACTCTTTGAATAA
670       TGAGGCTGACATTGATGAACGAATGAAATTGGCACAAGCCTTCAATGACTCTTTGAATAA
6BF       TGAGGCTGACATTGATGAACGAATGAAATTGGCACAAGCCTTCAATGACTCTTTGAATAA
6BSP      TGAGGCTGACATTGATGAACGAATGAAATTGGCACAAGCCTTCAATGACTCTTTGAATAA
19AH      TGAGGCTGACATTGATGAACGAATGAAATTGGCACAAGCCTTCAATGACTCTTTGAATAA
23FPO     TGAGGCTGACATTGATGAACGAATGAAATTGGCACAAGCCTTCAATGACTCTTTGAATAA
19FTW     TGAGGCTGACATTGATGAACGAATGAAATTGGCACAAGCCTTCAATGACTCTTTGAATAA
9VSP      TGAGGCTGACATTGATGAACGAATGAAATTGGCACAAGCCTTCAATGACTCTTTGAATAA
TIGR4     TGAGGCTGACATTGATGAACGAATGAAATTGGCACAAGCCTTCAATGACTCTTTGAATAA
23FTW     TGAGGCTGACATTGATGAACGAATGAAATTGGCACAAGCCTTCAATGACTCTTTGAATAA
          ************************************************************

14CSR     TGTAGTGAGTGGCGATCCTTGGTCGGAAGAAATGAAGAAAAAAGGGCGAGCAGAGTATGC
670       TGTAGTGAGTGGCGATCCTTGGTCGGAAGAAATGAAGAAAAAAGGGCGAGCAGAGTATGC
6BF       TGTAGTGAGTGGCGATCCTTGGTCGGAAGAAATGAAGAAAAAAGGGCGAGCAGAGTATGC
6BSP      TGTAGTGAGTGGCGATCCTTGGTCGGAAGAAATGAAGAAAAAAGGGCGAGCAGAGTATGC
19AH      TGTAGTGAGTGGCGATCCTTGGTCGGAAGAAATGAAGAAAAAAGGGCGAGCAGAGTATGC
23FPO     TGTAGTGAGTGGCGATCCTTGGTCGGAAGAAATGAAGAAAAAAGGGCGAGCAGAGTATGC
19FTW     TGTAGTGAGTGGCGATCCTTGGTCGGAAGAAATGAAGAAAAAAGGGCGAGCAGAGTATGC
9VSP      TGTAGTGAGTGGCGATCCTTGGTCGGAAGAAATGAAGAAAAAAGGGCGAGCAGAGTATGC
TIGR4     TGTAGTGAGTGGCGATCCTTGGTCGGAAGAAATGAAGAAAAAAGGGCGAGCAGAGTATGC
23FTW     TGTAGTGAGTGGCGATCCTTGGTCGGAAGAAATGAAGAAAAAAGGGCGAGCAGAGTATGC
          ************************************************************

14CSR     ACGTATGTTAGAAATCCATGAGCGGATGGGGCATGTGGAAATCCCCGTTATTGACGTGGA
670       ACGTATGTTAGAAATCCATGAGCGGATGGGGCATGTGGAAATCCCCGTTATTGACGTGGA
6BF       ACGTATGTTAGAAATCCATGAGCGGATGGGGCATGTGGAAATCCCCGTTATTGACGTGGA
6BSP      ACGTATGTTAGAAATCCATGAGCGGATGGGGCATGTGGAAATCCCCGTTATTGACGTGGA
19AH      ACGTATGTTAGAAATCCATGAGCGGATGGGGCATGTGGAAATCCCCGTTATTGACGTGGA
23FPO     ACGCATGTTAGAAATCCATGAGCGGATGGGGCATGTGGAAATCCCTGCTATTGATGTAGA
19FTW     ACGCATGTTAGAAATCCATGAGCGGATGGGGCATGTGGAAATCCCTGCTATTGATGTAGA
9VSP      ACGCATGTTAGAAATCCATGAGCGGATGGGGCATGTGGAAATCCCTGCTATTGATGTAGA
TIGR4     ACGTATGTTAGAAATCCATGAGCGGATGGGGCATGTGGAAATCCCCGTTATTGACGTGGA
23FTW     ACGTATGTTAGAAATCCATGAGCGGATGGGGCATGTGGAAATCCCCGTTATTGACGTGGA
          *** ***************************************** * ****** ** **

14CSR     TTTGCCGGTTTATGCTGGTACTGCTGAAGAGGTATTGCAGCAAGGGGCTGGGCATCTAGA
670       TTTGCCGGTTTATGCTGGTACTGCTGAAGAGGTATTGCAGCAAGGGGCTGGGCATCTAGA
6BF       TTTGCCGGTTTATGCTGGTACTGCTGAAGAGGTATTGCAGCAAGGGGCTGGGCATCTAGA
6BSP      TTTGCCGGTTTATGCTGGTACTGCTGAAGAGGTATTGCAGCAAGGGGCTGGGCATCTAGA
19AH      TTTGCCGGTTTATGCTGGTACTGCTGAAGAGGTATTGCAGCAAGGGGCTGGGCATCTAGA
23FPO     TTTGCCGGTTTATGCTGGTACTGCTGAAGAGGTATTGCAGCAAGGCGCTGGACATCTAGA
19FTW     TTTGCCGGTTTATGCTGGTACTGCTGAAGAGGTATTGCAGCAAGGCGCTGGACATCTAGA
9VSP      TTTGCCGGTTTATGCTGGTACTGCTGAAGAGGTATTGCAGCAAGGCGCTGGACATCTAGA
TIGR4     TTTGCCGGTTTATGCTGGTACTGCTGAAGAGGTATTGCAGCAAGGGGCTGGGCATCTAGA
23FTW     TTTGCCGGTTTATGCTGGTACTGCTGAAGAGGTATTGCAGCAAGGGGCTGGGCAGCTAGA
          ********************************************* ***** ** *****

14CSR     GGGAACTTCTCTGCCGATCGGAGGCAATTCGACCCATGCGGTGATTACGGCACATACAGG
670       GGGAACTTCTCTGCCGATCGGAGGCAATTCGACCCATGCGGTGATTACGGCACATACAGG
6BF       GGGAACTTCTCTGCCGATCGGAGGCAATTCGACCCATGCGGTGATTACGGCACATACAGG
6BSP      GGGAACTTCTCTGCCGATCGGAGGCAATTCGACCCATGCGGTGATTACGGCACATACAGG
19AH      GGGAACTTCTCTGCCGATCGGAGGCAATTCGACCCATGCGGTGATTACGGCACATACAGG
23FPO     GGGAACTTCTCTACCGATCGGAGGCAATTCGACCCATGCGGTGATTACGGCACATACAGG
19FTW     GGGAACTTCTCTACCGATCGGAGGCAATTCGACCCATGCGGTGATTACGGCACATACAGG
9VSP      GGGAACTTCTCTACCGATCGGAGGCAATTCGACCCATGCGGTGATTACGGCACATACAGG
TIGR4     GGGAACTTCTCTGCCGATCGGAGGCAATTCGACCCATGCGGTGATTACGGCACATACAGG
23FTW     GGGAACTTCTCTGCCGATCGGAGGCAATTCGACCCATGCGGTGATTACGGCACATACAGG
          ************ ***********************************************
```

Figure 196AE

```
14CSR    TTTGCCAACAGCTAAGATGTTTACGGATTTGACCAAACTTAAAGTTGGGGATAAGTTTTA
670      TTTGCCAACAGCTAAGATGTTTACGGATTTGACCAAACTTAAAGTTGGGGATAAGTTTTA
6BF      TTTGCCAACAGCTAAGATGTTTACGGATTTGACCAAACTTAAAGTTGGGGATAAGTTTTA
6BSP     TTTGCCAACAGCTAAGATGTTTACGGATTTGACCAAACTTAAAGTTGGGGATAAGTTTTA
19AH     TTTGCCAACAGCGAAGATGTTTACGGATTTGACCAAACTTAAAGTTGGGGATAAGTTTTA
23FPO    TTTGCCAACGGCTAAGATGTTTACGGATTTGACCAAACTTAAAGTTGGGGATAAGTTTTA
19FTW    TTTGCCAACGGCTAAGATGTTTACGGATTTGACCAAACTTAAAGTTGGGGATAAGTTTTA
9VSP     TTTGCCAACGGCTAAGATGTTTACGGATTTGACCAAACTTAAAGTTGGGGATAAGTTTTA
TIGR4    TTTGCCAACAGCTAAGATGTTTACGGATTTGACCAAACTTAAAGTTGGGGATAAGTTTTA
23FTW    TTTGCCAACAGCTAAGATGTTTACGGATTTGACCAAACTTAAAGTTGGGGATAAGTTTTA
         ********* ** ***********************************************

14CSR    TGTGCACAATATCAAGGAAGTGATGGCCTATCAAGTGGATCAAGTAAAGGTGATTGAGCC
670      TGTGCACAATATCAAGGAAGTGATGGCCTATCAAGTGGATCAAGTAAAGGTGATTGAGCC
6BF      TGTGCACAATATCAAGGAAGTGATGGCCTATCAAGTGGATCAAGTAAAGGTGATTGAGCC
6BSP     TGTGCACAATATCAAGGAAGTGATGGCCTATCAAGTGGATCAAGTAAAGGTGATTGAGCC
19AH     TGTGCACAATATCAAGGAAGTGATGGCCTATCAAGTGGATCAAGTAAAGGTGATTGAGCC
23FPO    TGTGCACAATATCAAGGAAGTGATGGCCTATCAAGTGGATCAAGTAAAGGTGATTGAGCC
19FTW    TGTGCACAATATCAAGGAAGTGATGGCCTATCAAGTGGATCAAGTAAAGGTGATTGAGCC
9VSP     TGTGCACAATATCAAGGAAGTGATGGCCTATCAAGTGGATCAAGTAAAGGTGATTGAGCC
TIGR4    TGTGCACAATATCAAGGAAGTGATGGCCTATCAAGTGGATCAAGTAAAGGTGATTGAGCC
23FTW    TGTGCACAATATCAAGGAAGTGATGGCCTATCAAGTGGATCAAGTAAAGGTGATTGAGCC
         ************************************************************

14CSR    GACGAACTTTGATGATTTATTGATTGTACCAGGTCATGATTATGTGACCTTGCTGACTTG
670      GACGAACTTTGATGATTTATTGATTGTACCAGGTCATGATTATGTGACCTTGCTGACTTG
6BF      GACGAACTTTGATGATTTATTGATTGTACCAGGTCATGATTATGTGACCTTGCTGACTTG
6BSP     GACGAACTTTGATGATTTATTGATTGTACCAGGTCATGATTATGTGACCTTGCTGACTTG
19AH     GACGAACTTTGATGATTTATTGATTGTACCAGGTCATGATTATGTGACCTTGCTGACTTG
23FPO    GACGAACTTTGATGATTTATTGATTGTACCAGGTCATGATTATGTGACCTTGCTGACCTG
19FTW    GACGAACTTTGATGATTTATTGATTGTACCAGGTCATGATTATGTGACCTTGCTGACCTG
9VSP     GACGAACTTTGATGATTTATTGATTGTACCAGGTCATGATTATGTGACCTTGCTGACCTG
TIGR4    GACGAACTTTGATGATTTATTGATTGTACCAGGTCATGATTATGTGACCTTGCTGACTTG
23FTW    GACGAACTTTGATGATTTATTGATTGTACCAGGTCATGATTATGTGACCTTGCTGACTTG
         ********************************************************* **

14CSR    TACGCCATACATGATCAATACCCATCGTCTATTGGTTCGGGGGCATCGGATACCGTACGT
670      TACGCCATACATGATCAATACCCATCGTCTATTGGTTCGGGGGCATCGGATACCGTACGT
6BF      TACGCCATACATGATCAATACCCATCGTCTATTGGTTCGGGGGCATCGGATACCGTACGT
6BSP     TACGCCATACATGATCAATACCCATCGTCTATTGGTTCGGGGGCATCGGATACCGTACGT
19AH     TACGCCATACATGATCAATACCCATCGTCTATTGGTTCGGGGGCATCGGATACCGTACGT
23FPO    TACGCCATACATGATCAATACCCATCGTCTATTGGTTCGGGGGCATCGGATACCGTACGT
19FTW    TACGCCATACATGATCAATACCCATCGTCTATTGGTTCGGGGGCATCGGATACCGTACGT
9VSP     TACGCCATACATGATCAATACCCATCGTCTATTGGTTCGGGGGCATCGGATACCGTACGT
TIGR4    TACGCCATACATGATCAATACCCATCGTCTATTGGTTCGGGGGCATCGGATACCGTACGT
23FTW    TACGCCATACATGATCAATACCCATCGTCTATTGGTTCGGGGGCATCGGATACCGTACGT
         ************************************************************

14CSR    AGCAGAGGTTGAGGAAGAATTTATTGCAGCAAACAAACTCAGTCATCTCTATCGCTACCT
670      AGCAGAGGTTGAGGAAGAATTTATTGCAGCAAACAAACTCAGTCATCTCTATCGCTACCT
6BF      AGCAGAGGTTGAGGAAGAATTTATTGCAGCAAACAAACTCAGTCATCTCTATCGCTACCT
6BSP     AGCAGAGGTTGAGGAAGAATTTATTGCAGCAAACAAACTCAGTCATCTCTATCGCTACCT
19AH     AGCAGAGGTTGAGGAAGAATTTATTGCAGCAAACAAACTCAGTCATCTCTATCGCTACCT
23FPO    AGCAGAGGTTGAGGAAGAATTTATTGCGGCAAACAAACTCAGTCATCTCTATCGCTACCT
19FTW    AGCAGAGGTTGAGGAAGAATTTATTGCGGCAAACAAACTCAGTCATCTCTATCGCTACCT
9VSP     AGCAGAGGTTGAGGAAGAATTTATTGCGGCAAACAAACTCAGTCATCTCTATCGCTACCT
TIGR4    AGCAGAGGTTGAGGAAGAATTTATTGCAGCAAACAAACTCAGTCATCTCTATCGCTACCT
23FTW    AGCAGAGGTTGAGGAAGAATTTATTGCAGCAAACAAACTCAGTCATCTCTATCGCTACCT
         *************************** ********************************
```

Figure 196AF

```
14CSR    GTTTTATGTGGCAGTTGGTTTGATTGTGATTCTTTTATGGATTATTCGACGCTTGCGCAA
670      GTTTTATGTGGCAGTTGGTTTGATTGTGATTCTTTTATGGATTATTCGACGCTTGCGCAA
6BF      GTTTTATGTGGCAGTTGGTTTGATTGTGATTCTTTTATGGATTATTCGACGCTTGCGCAA
6BSP     GTTTTATGTGGCAGTTGGTTTGATTGTGATTCTTTTATGGATTATTCGACGCTTGCGCAA
19AH     GTTTTATGTGGCAGTTGGTTTGATTGTGATTCTTTTATGGATTATTCGACGCTTGCGCAA
23FPO    GTTTTATGTGGCAGTTGGTTTGATTGTGATTCTTTTATGGATTATTCGACGCTTGCGCAA
19FTW    GTTTTATGTGGCAGTTGGTTTGATTGTGATTCTTTTATGGATTATTCGACGCTTGCGCAA
9VSP     GTTTTATGTGGCAGTTGGTTTGATTGTGATTCTTTTATGGATTATTCGACGCTTGCGCAA
TIGR4    GTTTTATGTGGCAGTTGGTTTGATTGTGATTCTTTTATGGATTATTCGACGCTTGCGCAA
23FTW    GTTTTATGTGGCAGTTGGTTTGATTGTGATTCTTTTATGGATTATTCGACGCTTGCGCAA
         ************************************************************

14CSR    GAAGAAAAAAACAACCGGAAAAAGGCTTTGAAGGCGCTGAAAGCAGCAAGGAAGGAAGTGAA
670      GAAGAAAAAAACAACCGGAAAAAGGCTTTGAAGGCGCTGAAAGCAGCAAGGAAGGAAGTGAA
6BF      GAAGAAAAAAACAACCGGAAAAAGGCTTTGAAGGCGCTGAAAGCAGCAAGGAAGGAAGTGAA
6BSP     GAAGAAAAAAACAACCGGAAAAAGGCTTTGAAGGCGCTGAAAGCAGCAAGGAAGGAAGTGAA
19AH     GAAGAAAAAAACAACCGGAAAAAGGCTTTGAAGGCGCTGAAAGCAGCAAGGAAGGAAGTGAA
23FPO    GAAGAAACGGCAATCAGAAAGAGCTTTGAAAGCATTGAAGGAAGCTACTAAGGAAGTGAA
19FTW    GAAGAAACGGCAATCAGAAAGAGCTTTGAAAGCATTGAAGGAAGCTACTAAGGAAGTGAA
9VSP     GAAGAAACGGCAATCAGAAAGAGCTTTGAAAGCATTGAAGGAAGCTACTAAGGAAGTGAA
TIGR4    GAAGAAAAAAACAACCGGAAAAAGGCTTTGAAGGCGCTGAAAGCAGCAAGGAAGGAAGTGAA
23FTW    GAAGAAAAAAACAACCGGAAAAAGGCTTTGAAGGCGCTGAAAGCAGCAAGGAAGGAAGTGAA
         *******   *** * ****  ******** **   **** * *** *   ***********

14CSR    GGTGGAGGATGGACAACAGTAGACGTTCACGAAAAAAAGGCACAAAAAAGAAGAAACATC
670      GGTGGAGGATGGACAACAGTAGACGTTCACGAAAAAAAGGCACAAAAAAGAAGAAACATC
6BF      GGTGGAGGATGGACAACAGTAGACGTTCACGAAAAAAAGGCACAAAAAAGAAGAAACATC
6BSP     GGTGGAGGATGGACAACAGTAGACGTTCACGAAAAAAAGGCACAAAAAAGAAGAAACATC
19AH     GGTGGAGGATGGACAACAGTAGACGTTCACGAAAAAAAGGCACAAAAAAGAAGAAACATC
23FPO    GGTAGAGGATGAGTAAGAGTAGATATTCACGGAAAAAGAGCGTGAAAAAGAAGAAAAATC
19FTW    GGTAGAGGATGAGTAAGAGTAGATATTCACGGAAAAAGAGCGTGAAAAAGAAGAAAAATC
9VSP     GGTAGAGGATGAGTAAGAGTAGATATTCACGGAAAAAGAGCGTGAAAAAGAAGAAAAATC
TIGR4    GGTGGAGGATGGACAACAGTAGACGTTCACGAAAAAAAGGCACAAAAAAGAAGAAACATC
23FTW    GGTGGAGGATGGACAACAGTAGACGTTCACGAAAAAAAGGCACAAAAAAGAAGAAACATC
         *** *******   ** ******  ****** *****  **    ************ ***

14CSR    CGCTGATCCTTCTTCTGATTTTCTTAGTAGGATTCGCCGTTGCGATATATCCATTGGTGT
670      CGCTGATCCTTCTTCTGATTTTCTTAGTAGGATTCGCCGTTGCGATATATCCATTGGTGT
6BF      CGCTGATCCTTCTTCTGATTTTCTTAGTAGGATTCGCCGTTGCGATATATCCATTGGTGT
6BSP     CGCTGATCCTTCTTCTGATTTTCTTAGTAGGATTCGCCGTTGCGATATATCCATTGGTGT
19AH     CGCTGATCCTTCTTCTGATTTTCTTAGTAGGATTCGCCGTTGCGATATATCCATTGGTGT
23FPO    CGTTCATTCTTCTTCTGATTTTTTTGGTGGGGCTTGCCGTTGCGATGTATCCCTTGGTGT
19FTW    CGTTCATTCTTCTTCTGATTTTTTTGGTGGGGCTTGCCGTTGCGATGTATCCCTTGGTGT
9VSP     CGTTCATTCTTCTTCTGATTTTTTTGGTGGGGCTTGCCGTTGCGATGTATCCCTTGGTGT
TIGR4    CGCTGATCCTTCTTCTGATTTTCTTAGTAGGATTCGCCGTTGCGATATATCCATTGGTGT
23FTW    CGCTGATCCTTCTTCTGATTTTCTTAGTAGGATTCGCCGTTGCGATATATCCATTGGTGT
         ** * ** ************** ** ** **  * *********** ***** *******

14CSR    CTCGTTATTATTATCGTATTGAGTCAAACGAGGTTATTAAAGAGTTTGATGAGACGGTTT
670      CTCGTTATTATTATCGTATTGAGTCAAACGAGGTTATTAAAGAGTTTGATGAGACGGTTT
6BF      CTCGTTATTATTATCGTATTGAGTCAAACGAGGTTATTAAAGAGTTTGATGAGACGGTTT
6BSP     CTCGTTATTATTATCGTATTGAGTCAAACGAGGTTATTAAAGAGTTTGATGAGACGGTTT
19AH     CTCGTTATTATTATCGTATTGAGTCAAACGAGGTTATTAAAGAGTTTGATGAGACGGTTT
23FPO    CTCGTTATTATTATCGTATTGAGTCAAACGAGGTTATTAAAGAGTTTGATGAGACGGTTT
19FTW    CTCGTTATTATTATCGTATTGAGTCAAACGAGGTTATTAAAGAGTTTGATGAGACGGTTT
9VSP     CTCGTTATTATTATCGTATTGAGTCAAACGAGGTTATTAAAGAGTTTGATGAGACGGTTT
TIGR4    CTCGTTATTATTATCGTATTGAGTCAAACGAGGTTATTAAAGAGTTTGATGAGACGGTTT
23FTW    CTCGTTATTATTATCGTATTGAGTCAAACGAGGTTATTAAAGAGTTTGATGAGACGGTTT
         ************************************************************
```

Figure 196AG

```
14CSR      CCCAGATGGATAAGGCAGAACTTGAGGAGCGTTGGCGCTTGGCTCAAGCCTTCAATGCGA
670        CCCAGATGGATAAGGCAGAACTTGAGGAGCGTTGGCGCTTGGCTCAAGCCTTCAATGCGA
6BF        CCCAGATGGATAAGGCAGAACTTGAGGAGCGTTGGCGCTTGGCTCAAGCCTTCAATGCGA
6BSP       CCCAGATGGATAAGGCAGAACTTGAGGAGCGTTGGCGCTTGGCTCAAGCCTTCAATGCGA
19AH       CCCAGATGGATAAGGCAGAACTTGAGGAGCGTTGGCGCTTGGCTCAAGCCTTCAATGCGA
23FPO      CCCAGATGGATAAGGCGGAACTTGAGGAGCGTTGGCGCTTGGCTCAAGCCTTCAATGCGA
19FTW      CCCAGATGGATAAGGCGGAACTTGAGGAGCGTTGGCGCTTGGCTCAAGCCTTCAATGCGA
9VSP       CCCAGATGGATAAGGCGGAACTTGAGGAGCGTTGGCGCTTGGCTCAAGCCTTCAATGCGA
TIGR4      CCCAGATGGATAAGGCAGAACTTGAGGAGCGTTGGCGCTTGGCTCAAGCCTTCAATGCGA
23FTW      CCCAGATGGATAAGGCAGAACTTGAGGAGCGTTGGCGCTTGGCTCAAGCCTTCAATGCGA
           **************** *******************************************

14CSR      CCTTGAAACCATCTGAAATTCTTGATCCTTTTACAGAGCAAGAGAAAAAGAAAGGCGTCT
670        CCTTGAAACCATCTGAAATTCTTGATCCTTTTACAGAGCAAGAGAAAAAGAAAGGCGTCT
6BF        CCTTGAAACCATCTGAAATTCTTGATCCTTTTACAGAGCAAGAGAAAAAGAAAGGCGTCT
6BSP       CCTTGAAACCATCTGAAATTCTTGATCCTTTTACAGAGCAAGAGAAAAAGAAAGGCGTCT
19AH       CCTTGAAACCATCTGAAATTCTTGATCCTTTTACAGAGCAAGAGAAAAAGAAAGGCGTCT
23FPO      CCTTGAAACCATCTGAAATTCTTGATCCTTTTACAGAGCAAGAGAAAAAGAAAGGCGTCT
19FTW      CCTTGAAACCATCTGAAATCCTCGATCCTTTTACAGATCAGGAAAAGAAACAGGGAGTTT
9VSP       CCTTGAAACCATCTGAAATTCTTGATCCTTTTACAGAGCAAGAGAAAAAGAAAGGCGTCT
TIGR4      CCTTGAAACCATCTGAAATTCTTGATCCTTTTACAGAGCAAGAGAAAAAGAAAGGCGTCT
23FTW      CCTTGAAACCATCTGAAATTCTTGATCCTTTTACAGAGCAAGAGAAAAAGAAAGGCGTCT
           ******************* ** ************** ** ** ** **  * ** ** *

14CSR      CAGAATATGCCAATATGCTAAAGGTCCATGAGCGGATTGGCTATGTGGAAATTCCTGCGA
670        CAGAATATGCCAATATGCTAAAGGTCCATGAGCGGATTGGCTATGTGGAAATTCCTGCGA
6BF        CAGAATATGCCAATATGCTAAAGGTCCATGAGCGGATTGGCTATGTGGAAATTCCTGCGA
6BSP       CAGAATATGCCAATATGCTAAAGGTCCATGAGCGGATTGGCTATGTGGAAATTCCTGCGA
19AH       CAGAATATGCCAATATGCTAAAGGTCCATGAGCGGATTGGCTATGTGGAAATTCCTGCGA
23FPO      CAGAATATGCCAATATGCTAAAGGTCCATGAGCGGATTGGCTATGTGGAAATTCCTGCGA
19FTW      CAGAATATGCTAACATGCTAAAAGTTCATGAGCGTATCGGATATGTAGAAATTCCTGCGA
9VSP       CAGAATATGCCAATATGCTAAAGGTCCATGAGCGGATTGGCTATGTGGAAATTCCTGCGA
TIGR4      CAGAATATGCCAATATGCTAAAGGTCCATGAGCGGATTGGCTATGTGGAAATTCCTGCGA
23FTW      CAGAATATGCCAATATGCTAAAGGTCCATGAGCGGATTGGCTATGTGGAAATTCCTGCGA
           ********** ** ******** ** ******** ** ** ***** *************

14CSR      TTGATCAGGAAATTCCGATGTATGTCGGAACGAGTGAGGAAATTCTTCAGAAGGGCGCAG
670        TTGATCAGGAAATTCCGATGTATGTCGGAACGAGTGAGGAAATTCTTCAGAAGGGCGCAG
6BF        TTGATCAGGAAATTCCGATGTATGTCGGAACGAGTGAGGAAATTCTTCAGAAGGGCGCAG
6BSP       TTGATCAGGAAATTCCGATGTATGTCGGAACGAGTGAGGAAATTCTTCAGAAGGGCGCAG
19AH       TTGATCAGGAAATTCCGATGTATGTCGGAACGAGTGAGGAAATTCTTCAGAAGGGCGCAG
23FPO      TTGATCAGGAAATTCCGATGTATGTCGGAACGAGTGAGGAAATTCTTCAGAAGGGCGCAG
19FTW      TTGAACAGGAAATCCCCATGTATGTTGGCACAAGTGAAGACATTCTTCAGAAAGGGGCAG
9VSP       TTGATCAGGAAATTCCGATGTATGTCGGAACGAGTGAGGAAATTCTTCAGAAGGGCGCAG
TIGR4      TTGATCAGGAAATTCCGATGTATGTCGGAACGAGTGAGGACATTCTTCAGAAAGGGGCAG
23FTW      TTGATCAGGAAATTCCGATGTATGTCGGAACGAGTGAGGAAATTCTTCAGAAGGGCGCAG
           **** ******** ** ******** ** ** ***** ** *********** ** ****

14CSR      GATTGCTAGAGGGAGCTTCGTTACCGGTTGGTGGTGAAAATACCCACACAGTTGTCACTG
670        GATTGCTAGAGGGAGCTTCGTTACCGGTTGGTGGTGAAAATACCCACACAGTTGTCACTG
6BF        GATTGCTAGAGGGAGCTTCGTTACCGGTTGGTGGTGAAAATACCCACACAGTTGTCACTG
6BSP       GATTGCTAGAGGGAGCTTCGTTACCGGTTGGTGGTGAAAATACCCACACAGTTGTCACTG
19AH       GATTGCTAGAGGGAGCTTCGTTACCGGTTGGTGGTGAAAATACCCACACAGTTGTCACTG
23FPO      GATTGCTAGAGGGAGCTTCGTTACCGGTTGGTGGTGAAAATACCCACACAGTTGTCACTG
19FTW      GGCTGTTAGAAGGGGCTTCGCTGCCTGTTGGAGGTGAAAATACCCATACAGTGATCACTG
9VSP       GATTGCTAGAGGGAGCTTCGTTACCGGTTGGTGGTGAAAATACCCACACAGTTGTCACTG
TIGR4      GGCTGTTAGAAGGGGCTTCGCTGCCTGTTGGAGGTGAAAATACCCATACAGTGATCACTG
23FTW      GATTGCTAGAGGGAGCTTCGTTACCGGTTGGTGGTGAAAATACCCACACAGTTGTTACTG
           *  ** **** ** ****** * ** ***** ************** *****  * ****
```

Figure 196AH

```
14CSR          CTCATAGAGGATTACCGACGGCAGAACTGTTTAGTCAATTGGATAAGATGAAAAAAGGGG
670            CTCATAGAGGATTACCGACGGCAGAACTGTTTAGTCAATTGGATAAGATGAAAAAAGGGG
6BF            CTCATAGAGGATTACCGACGGCAGAACTGTTTAGTCAATTGGATAAGATGAAAAAAGGGG
6BSP           CTCATAGAGGATTACCGACGGCAGAACTGTTTAGTCAATTGGATAAGATGAAAAAAGGGG
19AH           CTCATAGAGGATTACCGACGGCAGAACTGTTTAGTCAATTGGATAAGATGAAAAAAGGGG
23FPO          CTCATAGAGGATTACCGACGGCAGAACTGTTTAGTCAATTGGATAAGATGAAAAAAGGGG
19FTW          CTCACAGAGGATTGCCAACGGCAGAATTGTTCAGTCAATTGGATAAGATGAAGAAAGGGG
9VSP           CTCATAGAGGATTACCGACGGCAGAACTGTTTAGTCAATTGGATAAGATGAAAAAAGGGG
TIGR4          CTCACAGAGGATTGCCAACGGCAGAATTGTTCAGTCAATTGGATAAGATGAAAAAAGGGG
23FTW          CTCATAGAGGATTACCGACGGCAGAACTGTTTAGTCAATTGGATAAGATGAAAAAAGGGG
               **** ******** ** ********* **** ******************** *******

14CSR          ATGTCTTTTATCTTCACGTTTTAGACCAGGTGTTGGCCTACCAAGTGGATCAGATTTTGA
670            ATGTCTTTTATCTTCACGTTTTAGACCAGGTGTTGGCCTACCAAGTGGATCAGATTTTGA
6BF            ATGTCTTTTATCTTCACGTTTTAGACCAGGTGTTGGCCTACCAAGTGGATCAGATTTTGA
6BSP           ATGTCTTTTATCTTCACGTTTTAGACCAGGTGTTGGCCTACCAAGTGGATCAGATTTTGA
19AH           ATGTCTTTTATCTTCACGTTTTAGACCAGGTGTTGGCCTACCAAGTGGATCAGATTTTGA
23FPO          ATATCTTTTATCTTCACGTTTTAGATCAGGTGTTGGCCTACCAAGTGGATCAGATAGTGA
19FTW          ATATCTTTTATCTTCACGTTTTAGACCAGGTTTTGGCCTATCAAGTGGATCAGATAGTGA
9VSP           ATATCTTTTATCTTCACGTTTTAGATCAGGTGTTGGCCTACCAAGTGGATCAGATAGTGA
TIGR4          ATATCTTTTATCTTCACGTTTTAGATCAGGTGTTGGCCTACCAAGTGGATCAGATAGTGA
23FTW          ATGTCTTTTATCTTCACGTTTTAGACCAGGTGTTGGCCTACCAAGTGGATCAGATTTTGA
               ** ********************** ***** ******** **************  ***

14CSR          CGGTTGAGCCAAATGACTTTGAGCCTGTCTTGATTCAACATGGGGAAGATTATGCGACCT
670            CGGTTGAGCCAAATGACTTTGAGCCTGTCTTGATTCAACATGGGGAAGATTATGCGACCT
6BF            CGGTTGAGCCAAATGACTTTGAGCCTGTCTTGATTCAACATGGGGAAGATTATGCGACCT
6BSP           CGGTTGAGCCAAATGACTTTGAGCCTGTCTTGATTCAACATGGGGAAGATTATGCGACCT
19AH           CGGTTGAGCCAAATGACTTTGAGCCTGTCTTGATTCAACATGGGGAAGATTATGCGACCT
23FPO          CGGTGGAGCCGAATGACTTTGAGCCTGTCTTGATTCAACATGGGGAAGATTATGCGACCT
19FTW          CGGTGGAGCCGAATGATTTTGAGCCTGTTCTGATTCAACATGGACAAGATTATGCGACTT
9VSP           CGGTGGAGCCGAATGACTTTGAGCCTGTCTTGATTCAACATGGGGAAGATTATGCGACCT
TIGR4          CGGTGGAGCCGAATGACTTTGAGCCTGTCTTGATTCAACATGGGGAAGATTATGCGACCT
23FTW          CGGTTGAGCCAAATGACTTTGAGCCTGTCTTGATTCAACATGGGAAAGATTATGCGACCT
               **** ***** ***** ***********  *************  ************* *

14CSR          TGTTGACCTGTACACCGTATATGATTAACAGTCATCGTCTGTTGGTACGTGGGAAGCGGA
670            TGTTGACCTGTACACCGTATATGATTAACAGTCATCGTCTGTTGGTACGTGGGAAGCGGA
6BF            TGTTGACCTGTACACCGTATATGATTAACAGTCATCGTCTGTTGGTACGTGGGAAGCGGA
6BSP           TGTTGACCTGTACACCGTATATGATTAACAGTCATCGTCTGTTGGTACGTGGGAAGCGGA
19AH           TGTTGACCTGTACACCGTATATGATTAACAGTCATCGTCTGTTGGTACGTGGGAAGCGGA
23FPO          TGTTGACTTGTACACCGTATATGATTAACAGTCATCGTCTGTTGGTACGTGGGAAGCGGA
19FTW          TACTGACTTGTACGCCATACATGATTAACAGCCACCGTTTGTTGGTACGTGGGAAACGGA
9VSP           TGTTGACTTGTACACCGTATATGATTAACAGTCATCGTCTGTTGGTACGTGGGAAGCGGA
TIGR4          TGTTGACTTGTACACCGTATATGATTAACAGTCATCGTCTGTTGGTACGTGGGAAGCGGA
23FTW          TGTTGACCTGTACACCGTATATGATTAACAGTCATCGTCTGTTGGTACGTGGGAAGCGGA
               *  **** ***** ** ** *********** ** *** **************** ****

14CSR          TTCCGTATACGGCACCAATTGCAGAGCGAAATCGAGCGGTGAGAGAGCGTGGGCAATTCT
670            TTCCGTATACGGCACCAATTGCAGAGCGAAATCGAGCGGTGAGAGAGCGTGGGCAATTCT
6BF            TTCCGTATACGGCACCAATTGCAGAGCGAAATCGAGCGGTGAGAGAGCGTGGGCAATTCT
6BSP           TTCCGTATACGGCACCAATTGCAGAGCGAAATCGAGCGGTGAGAGAGCGTGGGCAATTCT
19AH           TTCCGTATACGGCACCAATTGCAGAGCGAAATCGAGCGGTGAGAGAGCGTGGGCAATTCT
23FPO          TTCCGTATACGGCACCAATTGCAGAGCGGAATCGAGCGGTGAGAGAGCGTGGGCAATTCT
19FTW          TTCCATATACAGCGCCGATTGCTGAGCGGAATCGAGCGGTGAGAGAGCGTGGGCAATTCT
9VSP           TTCCGTATACGGCACCAATTGCAGAGCGGAATCGAGCGGTGAGAGAGCGTGGGCAATTCT
TIGR4          TTCCGTATACGGCACCAATTGCAGAGCGGAATCGAGCGGTGAGAGAGCGTGGGCAATTCT
23FTW          TTCCGTATACGGCACCAATTGCAGAGCGAAATCGAGCGGTGAGAGAGCGTGGGCAATTCT
               **** ***** ** ** ***** ***** *******************************
```

Figure 196AI

```
14CSR     GGTTGTGGTTATTGCTAGCGGCGTTGGTTATGATTCTGGTATTGAGTTACGGGGTGTATC
670       GGTTGTGGTTATTGCTAGCGGCGTTGGTTATGATTCTGGTATTGAGTTACGGGGTGTATC
6BF       GGTTGTGGTTATTGCTAGCGGCGTTGGTTATGATTCTGGTATTGAGTTACGGGGTGTATC
6BSP      GGTTGTGGTTATTGCTAGCGGCGTTGGTTATGATTCTGGTATTGAGTTACGGGGTGTATC
19AH      GGTTGTGGTTATTGCTAGCGGCGTTGGTTATGATTCTGGTATTGAGTTACGGGGTGTATC
23FPO     GGTTGTGGTTATTACTAGGAGCGATGGCGGTCATCCTTCTCTTGCTGTATCGCGTGTATC
19FTW     GGTTGTGGTTATTACTAGGAGCGATGGCGGTCATCCTTCTCTTGCTGTATCGCGTGTATC
9VSP      GGTTGTGGTTATTACTAGGAGCGATGGCGGTCATCCTTCTCTTGCTGTATCGCGTGTATC
TIGR4     GGTTGTGGTTATTACTAGGAGCGATGGCGGTCATCCTTCTCTTGCTGTATCGCGTGTATC
23FTW     GGTTGTGGTTATTGCTAGCGGCGTTGGTTATGATTCTGGTATTGAGTTACGGGGTGTATC
          ************* ****  *** ***   * ** **  * ***   **  * *******

14CSR     GTCATCGTCGCATTGTCAAAGGGCTAGAAAAACAATTGGAGGAGCATCATGTCAAAGGCT
670       GTCATCGTCGCATTGTCAAAGGGCTAGAAAAACAATTGGAGGAGCATCATGTCAAAGGCT
6BF       GTCATCGTCGCATTGTCAAAGGGCTAGAAAAACAATTGGAGGAGCATCATGTCAAAGGCT
6BSP      GTCATCGTCGCATTGTCAAAGGGCTAGAAAAACAATTGGAGGAGCATCATGTCAAAGGCT
19AH      GTCATCGTCGCATTGTCAAAGGGCTAGAAAAACAATTGGAGGAGCATCATGTCAAAGGCT
23FPO     GTAATCGACGGATTGTCAAAGGACTAGAAAAGCAATTGGAGGGGCGTCATGTCAAGGACT
19FTW     GTAATCGACGGATTGTCAAAGGACTAGAAAAGCAATTGGAGGGGCGTCATGTCAAGGACT
9VSP      GTAATCGACGGATTGTCAAAGGACTAGAAAAGCAATTGGAGGGGCGTCATGTCAAGGACT
TIGR4     GTAATCGACGGATTGTCAAAGGACTAGAAAAGCAATTGGAGGGGCGTCATGTCAAGGACT
23FTW     GTCATCGTCGCATTGTCAAAGGGCTAGAAAAACAATTGGAGGAGCATCATGTCAAAGGCT
          ** **** ** *********** ******** ********** ** ********* * **

14CSR     AAGCTACAGAAATTACTAGGGTATTTGCTGATGCTGGTAGCATTGGTGATTCCTGTTTAT
670       AAGCTACAGAAATTACTAGGGTATTTGCTGATGCTGGTAGCATTGGTGATTCCTGTTTAT
6BF       AAGCTACAGAAATTACTAGGGTATTTGCTGATGCTGGTAGCATTGGTGATTCCTGTTTAT
6BSP      AAGCTACAGAAATTACTAGGGTATTTGCTGATGCTGGTAGCATTGGTGATTCCTGTTTAT
19AH      AAGCTACAGAAATTACTAGGGTATTTGCTGATGCTGGTAGCATTGGTGATTCCTGTTTAT
23FPO     AAACTACGAGCCTTATTGGGATACTTGTTGATGTTGGTAGCCTGTTTGATTCCTATTTAT
19FTW     AAACTACGAGCCTTATTGGGATACTTGTTGATGTTGGTAGCCTGTTTGATTCCTATTTAT
9VSP      AAACTACGAGCCTTATTGGGATACTTGTTGATGTTGGTAGCCTGTTTGATTCCTATTTAT
TIGR4     AAACTACGAGCCTTATTGGGATACTTGTTGATGTTGGTAGCCTGTTTGATTCCTATTTAT
23FTW     AAGCTACAGAAATTACTAGGGTATTTGCTGATGCTGGTAGCATTGGTGATTCCTGTTTAT
          ** ****     *** * ** ** *** ***** ******* *   ******** *****

14CSR     TGTTTTGGGCAGATGGTGTTACAGTCTTTAGGACAAGTAAAAGGTCATGAGATATTTTCA
670       TGTTTTGGGCAGATGGTGTTACAGTCTTTAGGACAAGTAAAAGGTCATGAGATATTTTCA
6BF       TGTTTTGGGCAGATGGTGTTACAGTCTTTAGGACAAGTAAAAGGTCATGAGATATTTTCA
6BSP      TGTTTTGGGCAGATGGTGTTACAGTCTTTAGGACAAGTAAAAGGTCATGAGATATTTTCA
19AH      TGTTTTGGGCAGATGGTGTTACAGTCTTTAGGACAAGTAAAAGGTCATGAGATATTTTCA
23FPO     TGTTTTGGACAGATGGTGTTGCAGTCTCTTGGACAGGTGAAAGGTCATGCTACATTTGTG
19FTW     TGTTTTGGACAGATGGTGTTGCAGTCTCTTGGACAGGTGAAAGGTCATGCTACATTTGTG
9VSP      TGTTTTGGACAGATGGTGTTGCAGTCTCTTGGACAGGTGAAAGGTCATGCTACATTTGTG
TIGR4     TGTTTTGGACAGATGGTGTTGCAGTCTCTTGGACAGGTGAAAGGTCATGCTACATTTGTG
23FTW     TGTTTTGGGCAGATGGTGTTACAGTCTTTAGGACAAGTAAAAGGTCATGAGATATTTTCA
          ******** *********** ****** * ***** ** **********  * ****

14CSR     GAATCTGTGACGGCCGACAGTTACCAAGAGCAATTGCAACGGTCGCTTGATTACAATCAA
670       GAATCTGTGACGGCCGACAGTTACCAAGAGCAATTGCAACGGTCGCTTGATTACAATCAA
6BF       GAATCTGTGACGGCCGACAGTTACCAAGAGCAATTGCAACGGTCGCTTGATTACAATCAA
6BSP      GAATCTGTGACGGCCGACAGTTACCAAGAGCAATTGCAACGGTCGCTTGATTACAATCAA
19AH      GAATCTGTGACGGCCGACAGTTACCAAGAGCAATTGCAACGGTCGCTTGATTACAATCAA
23FPO     AAATCCATGACAACTGAAATGTACCAAGAACAACAGAACCATTCTCTCGCCTACAATCAA
19FTW     AAATCCATGACAACTGAAATGTACCAAGAACAACAGAACCATTCTCTCGCCTACAATCAA
9VSP      AAATCCATGACAACTGAAATGTACCAAGAACAACAGAACCATTCTCTCGCCTACAATCAA
TIGR4     AAATCCATGACAACTGAAATGTACCAAGAACAACAGAACCATTCTCTCGCCTACAATCAA
23FTW     GAATCTGTGACGGCCGACAGTTACCAAGAGCAATTGCAACGGTCGCTTGATTACAATCAA
           ****  ****  * ** *  ******** ***  * * *  ** ** *  *********
```

Figure 196AJ

```
14CSR    CGCTTGGATTCGCAAAATCGTATTGTAGATCCTTTTTTGGCGGAAGGGTATGAGGTAAAT
670      CGCTTGGATTCGCAAAATCGTATTGTAGATCCTTTTTTGGCGGAAGGGTATGAGGTAAAT
6BF      CGCTTGGATTCGCAAAATCGTATTGTAGATCCTTTTTTGGCGGAAGGGTATGAGGTAAAT
6BSP     CGCTTGGATTCGCAAAATCGTATTGTAGATCCTTTTTTGGCGGAAGGGTATGAGGTAAAT
19AH     CGCTTGGATTCGCAAAATCGTATTGTAGATCCTTTTTTGGCGGAAGGGTATGAGGTAAAT
23FPO    CGCTTGGCTTCGCAAAATCGCATTGTAGATCCTTTTTTGGCGGAGGGATATGAGGTCAAT
19FTW    CGCTTGGCTTCGCAAAATCGCATTGTAGATCCTTTTTTGGCGGAGGGATATGAGGTCAAT
9VSP     CGCTTGGCTTCGCAAAATCGCATTGTAGATCCTTTTTTGGCGGAGGGATATGAGGTCAAT
TIGR4    CGCTTGGCTTCGCAAAATCGCATTGTAGATCCTTTTTTGGCGGAGGGATATGAGGTCAAT
23FTW    CGCTTGGATTCGCAAAATCGTATTGTAGATCCTTTTTTGGCGGAAGGGTATGAGGTAAAT
         ******* ************ *********************** ** ******** ***

14CSR    TACCAAGTGTCTGACGATCCTGATGCAGTCTACGGCTATTTGTCGATTCCGAGTTTGGAA
670      TACCAAGTGTCTGACGATCCTGATGCAGTCTACGGCTATTTGTCGATTCCGAGTTTGGAA
6BF      TACCAAGTGTCTGACGATCCTGATGCAGTCTACGGCTATTTGTCGATTCCGAGTTTGGAA
6BSP     TACCAAGTGTCTGACGATCCTGATGCAGTCTACGGCTATTTGTCGATTCCGAGTTTGGAA
19AH     TACCAAGTGTCTGACGATCCTGATGCAGTCTACGGCTATTTGTCGATTCCGAGTTTGGAA
23FPO    TACCAAGTGTCTGACGACCCTGATGCAGTCTATGGTTACTTGTCTATTCCAAGTTTGGAA
19FTW    TACCAAGTGTCTGACGACCCTGATGCAGTCTATGGTTACTTGTCTATTCCAAGTTTGGAA
9VSP     TACCAAGTGTCTGACGACCCTGATGCAGTCTATGGTTACTTGTCTATTCCAAGTTTGGAA
TIGR4    TACCAAGTGTCTGACGACCCTGATGCAGTCTATGGTTACTTGTCTATTCCAAGTTTGGAA
23FTW    TACCAAGTGTCTGACGATCCTGATGCAGTCTACGGCTATTTGTCGATTCCGAGTTTGGAA
         ***************** ************** ** ** ***** ***** *********

14CSR    ATCATGGAGCCAGTTTATCTAGGAGCGGATTACCATCATTTAGCAATGGGGTTGGCCCAT
670      ATCATGGAGCCAGTTTATCTAGGAGCGGATTACCATCATTTAGCAATGGGGTTGGCCCAT
6BF      ATCATGGAGCCAGTTTATCTAGGAGCGGATTACCATCATTTAGCAATGGGGTTGGCCCAT
6BSP     ATCATGGAGCCAGTTTATCTAGGAGCGGATTACCATCATTTAGCAATGGGGTTGGCCCAT
19AH     ATCATGGAGCCAGTTTATCTAGGAGCGGATTACCATCATTTAGCAATGGGGTTGGCCCAT
23FPO    ATCATGGAGCCGGTTTATTTGGGAGCAGATTATCATCATTTAGGGATGGGCTTGGCTCAT
19FTW    ATCATGGAGCCGGTTTATTTGGGAGCAGATTATCATCATTTAGGGATGGGCTTGGCTCAT
9VSP     ATCATGGAGCCGGTTTATTTGGGAGCAGATTATCATCATTTAGGGATGGGCTTGGCTCAT
TIGR4    ATCATGGAGCCGGTTTATTTGGGAGCAGATTATCATCATTTAGGGATGGGCTTGGCTCAT
23FTW    ATCATGGAGCCAGTTTATCTAGGAGCGGATTACCATCATTTAGCAATGGGGTTGGCCCAT
         *********** ****** * ***** ***** ********** ***** ***** ***

14CSR    GTGGATGGGACGCCTCTTCCTGTTGAGGGAAAAGGGATTCGTTCAGTGATTGCTGGGCAC
670      GTGGATGGGACGCCTCTTCCTGTTGAGGGAAAAGGGATTCGTTCAGTGATTGCTGGGCAC
6BF      GTGGATGGGACGCCTCTTCCTGTTGAGGGAAAAGGGATTCGTTCAGTGATTGCTGGGCAC
6BSP     GTGGATGGGACGCCTCTTCCTGTTGAGGGAAAAGGGATTCGTTCAGTGATTGCTGGGCAC
19AH     GTGGATGGGACGCCTCTTCCTGTTGAGGGAAAAGGGATTCGTTCAGTGATTGCTGGGCAC
23FPO    GTGGATGGTACACCGCTGCCTCTGGATGGTACAGGGATTCGCTCAGTGATTGCTGGGCAC
19FTW    GTGGATGGTACACCGCTGCCTCTGGATGGTACAGGGATTCGCTCAGTGATTGCTGGGCAC
9VSP     GTGGATGGTACACCGCTGCCTCTGGATGGTACAGGGATTCGCTCAGTGATTGCTGGGCAC
TIGR4    GTGGATGGTACACCGCTGCCTCTGGATGGTACAGGGATTCGCTCAGTGATTGCTGGGCAC
23FTW    GTGGATGGGACGCCTCTTCCTGTTGAGGGAAAAGGGATTCGTTCAGTGATTGCTGGGCAC
         ******** ** ** ** *** * ** ** * ********* ******************

14CSR    CGTGCAGAACCAAGCCATGTCTTTTTCCGCCATTTGGATCAGCTAAAAGTTGGAGATGCT
670      CGTGCAGAACCAAGCCATGTCTTTTTCCGCCATTTGGATCAGCTAAAAGTTGGAGATGCT
6BF      CGTGCAGAACCAAGCCATGTCTTTTTCCGCCATTTGGATCAGCTAAAAGTTGGAGATGCT
6BSP     CGTGCAGAACCAAGCCATGTCTTTTTCCGCCATTTGGATCAGCTAAAAGTTGGAGATGCT
19AH     CGTGCAGAACCAAGCCATGTCTTTTTCCGCCATTTGGATCAGCTAAAAGTTGGAGATGCT
23FPO    CGTGCAGAGCCAAGCCATGTCTTTTTCCGCCATTTGGATCAGCTAAAAGTTGGAGATGCT
19FTW    CGTGCAGAGCCAAGCCATGTCTTTTTCCGCCATTTGGATCAGCTAAAAGTTGGAGATGCT
9VSP     CGTGCAGAGCCAAGCCATGTCTTTTTCCGCCATTTGGATCAGCTAAAAGTTGGAGATGCT
TIGR4    CGTGCAGAGCCAAGCCATGTCTTTTTCCGCCATTTGGATCAGCTAAAAGTTGGAGATGCT
23FTW    CGTGCAGAACCAAGCCATGTCTTTTTCCGCCATTTGGATCAGCTAAAAGTTGGAGATGCT
         ******** ***************************************************
```

Figure 196AK

```
14CSR    CTTTATTATGATAATGGCCAGGAAATTGTAGAATATCAGATGATGGACACAGAGATTATT
670      CTTTATTATGATAATGGCCAGGAAATTGTAGAATATCAGATGATGGACACAGAGATTATT
6BF      CTTTATTATGATAATGGCCAGGAAATTGTAGAATATCAGATGATGGACACAGAGATTATT
6BSP     CTTTATTATGATAATGGCCAGGAAATTGTAGAATATCAGATGATGGACACAGAGATTATT
19AH     CTTTATTATGATAATGGCCAGGAAATTGTAGAATATCAGATGATGGACACAGAGATTATT
23FPO    CTTTATTATGATAATGGCCAGGAAATTGTAGAATATCAGATGATGGACACAGAGATTATT
19FTW    CTTTATTATGATAATGGCCAGGAAATTGTAGAATATCAGATGATGGACACAGAGATTATT
9VSP     CTTTATTATGATAATGGCCAGGAAATTGTAGAATATCAGATGATGGACACAGAGATTATT
TIGR4    CTTTATTATGATAATGGCCAGGAAATTGTAGAATATCAGATGATGGACACAGAGATTATT
23FTW    CTTTATTATGATAATGGCCAGGAAATTGTAGAATATCAGATGATGGACACAGAGATTATT
         ************************************************************

14CSR    TTACCGTCGGAATGGGAAAAATTAGAATCGGTTAGCTCTAAAAATATCATGACCTTGATA
670      TTACCGTCGGAATGGGAAAAATTAGAATCGGTTAGCTCTAAAAATATCATGACCTTGATA
6BF      TTACCGTCGGAATGGGAAAAATTAGAATCGGTTAGCTCTAAAAATATCATGACCTTGATA
6BSP     TTACCGTCGGAATGGGAAAAATTAGAATCGGTTAGCTCTAAAAATATCATGACCTTGATA
19AH     TTACCGTCGGAATGGGAAAAATTAGAATCGGTTAGCTCTAAAAATATCATGACCTTGATA
23FPO    TTACCGTCGGAATGGGAAAAATTAGAATCGGTTAGCTCTAAAAATATCATGACCTTGATA
19FTW    TTACCGTCGGAATGGGAAAAATTAGAATCGGTTAGCTCTAAAAATATCATGACCTTGATA
9VSP     TTACCGTCGGAATGGGAAAAATTAGAATCGGTTAGCTCTAAAAATATCATGACCTTGATA
TIGR4    TTACCGTCGGAATGGGAAAAATTAGAATCGGTTAGCTCTAAAAATATCATGACCTTGATA
23FTW    TTACCGTCGGAATGGGAAAAATTAGAATCGGTTAGCTCTAAAAATATCATGACCTTGATA
         ************************************************************

14CSR    ACCTGCGATCCGATTCCTACCTTTAATAAACGCTTATTAGTGAATTTTGAACGAGTCGCT
670      ACCTGCGATCCGATTCCTACCTTTAATAAACGCTTATTAGTGAATTTTGAACGAGTCGCT
6BF      ACCTGCGATCCGATTCCTACCTTTAATAAACGCTTATTAGTGAATTTTGAACGAGTCGCT
6BSP     ACCTGCGATCCGATTCCTACCTTTAATAAACGCTTATTAGTGAATTTTGAACGAGTCGCT
19AH     ACCTGCGATCCGATTCCTACCTTTAATAAACGCTTATTAGTGAATTTTGAACGAGTCGCT
23FPO    ACCTGCGATCCGATTCCTACCTTTAATAAACGCTTATTAGTGAATTTTGAACGAGTCGCT
19FTW    ACCTGCGATCCGATTCCTACCTTTAATAAACGCTTATTAGTGAATTTTGAACGAGTCGCT
9VSP     ACCTGCGATCCGATTCCTACCTTTAATAAACGCTTATTAGTGAATTTTGAACGAGTCGCT
TIGR4    ACCTGCGATCCGATTCCTACCTTTAATAAACGCTTATTAGTGAATTTTGAACGAGTCGCT
23FTW    ACCTGCGATCCGATTCCTACCTTTAATAAACGCTTATTAGTGAATTTTGAACGAGTCGCT
         ************************************************************

14CSR    GTTTATCAAAAATCAGATCCACAAACAGCTGCAGTTGCGAGGGTTGCTTTTACGAAAGAA
670      GTTTATCAAAAATCAGATCCACAAACAGCTGCAGTTGCGAGGGTTGCTTTTACGAAAGAA
6BF      GTTTATCAAAAATCAGATCCACAAACAGCTGCAGTTGCGAGGGTTGCTTTTACGAAAGAA
6BSP     GTTTATCAAAAATCAGATCCACAAACAGCTGCAGTTGCGAGGGTTGCTTTTACGAAAGAA
19AH     GTTTATCAAAAATCAGATCCACAAACAGCTGCAGTTGCGAGGGTTGCTTTTACGAAAGAA
23FPO    GTTTATCAAAAATCAGATCCACAAACAGCTGCAGTTGCGAGGGTTGCTTTTACGAAAGAA
19FTW    GTTTATCAAAAATCAGATCCACAAACAGCTGCAGTTGCGAGGGTTGCTTTTACGAAAGAA
9VSP     GTTTATCAAAAATCAGATCCACAAACAGCTGCAGTTGCGAGGGTTGCTTTTACGAAAGAA
TIGR4    GTTTATCAAAAATCAGATCCACAAACAGCTGCAGTTGCGAGGGTTGCTTTTACGAAAGAA
23FTW    GTTTATCAAAAATCAGATCCACAAACAGCTGCAGTTGCGAGGGTTGCTTTTACGAAAGAA
         ************************************************************

14CSR    GGACAATCTGTATCGCGTGTTGCAACCTCTCAATGGTTGTACCGTGGGCTAGTGGTACTG
670      GGACAATCTGTATCGCGTGTTGCAACCTCTCAATGGTTGTACCGTGGGCTAGTGGTACTG
6BF      GGACAATCTGTATCGCGTGTTGCAACCTCTCAATGGTTGTACCGTGGGCTAGTGGTACTG
6BSP     GGACAATCTGTATCGCGTGTTGCAACCTCTCAATGGTTGTACCGTGGGCTAGTGGTACTG
19AH     GGACAATCTGTATCGCGTGTTGCAACCTCTCAATGGTTGTACCGTGGGCTAGTGGTACTG
23FPO    GGACAATCTGTATCGCGTGTTGCAACCTCTCAATGGTTGTACCGTGGGCTAGTGGTACTG
19FTW    GGACAATCTGTATCGCGTGTTGCAACCTCTCAATGGTTGTACCGTGGGCTAGTGGTACTG
9VSP     GGACAATCTGTATCGCGTGTTGCAACCTCTCAATGGTTGTACCGTGGGCTAGTGGTACTG
TIGR4    GGACAATCTGTATCGCGTGTTGCAACCTCTCAATGGTTGTACCGTGGGCTAGTGGTACTG
23FTW    GGACAATCTGTATCGCGTGTTGCAACCTCTCAATGGTTGTACCGTGGGCTAGTGGTACTG
         ************************************************************
```

Figure 196AL

```
14CSR    GCATTTCTGGGAATCCTGTTTGTTTTGTGGAAGCTAGCACGTTTACTACGAGGGAAATAA
670      GCATTTCTGGGAATCCTGTTTGTTTTGTGGAAGCTAGCACGTTTACTACGAGGGAAATAA
6BF      GCATTTCTGGGAATCCTGTTTGTTTTGTGGAAGCTAGCACGTTTACTACGAGGGAAATAA
6BSP     GCATTTCTGGGAATCCTGTTTGTTTTGTGGAAGCTAGCACGTTTACTACGAGGGAAATAA
19AH     GCATTTATGGGAATCCTGTTTGTTTTGTGGAAGCTAGCACGTTTACTACGAGGGAAATAA
23FPO    GCATTTCTGGGAATCCTGTTTGTTTTGTGGAAGCTAGCACGTTTACTACGAGGGAAATAA
19FTW    GCATTTCTGGGAATCCTGTTTGTTTTGTGGAAGCTAGCACGTTTACTACGAGGGAAATAA
9VSP     GCATTTCTGGGAATCCTGTTTGTTTTGTGGAAGCTAGCACGTTTACTACGAGGGAAATAA
TIGR4    GCATTTCTGGGAATCCTGTTTGTTTTGTGGAAGCTAGCACGTTTACTACGAGGGAAATAA
23FTW    GCATTTCTGGGAATCCTGTTTGTTTTGTGGAAGCTAGCACGTTTACTACGAGGGAAATAA
         ***** ******************************************************

14CSR    AAAGAAATGAAAGGAAAGCTAAGGCTGTTCCTTTTTCCGGCTCTTTGTCAACTGTAGGGG
670      AAAGAAATGAAAGGAAAGCTAAGGCTGTTCCTTTTTCCGGCTCTTTGTCAACTGTAGTGG
6BF      AAAGAAATGAAAGGAAAGCTAAGGCTGTTCCTTTTTCCGGCTCTTTGTCAACTGTAG---
6BSP     AAAGAAATGAAAGGAAAGCTAAGGCTGTTCCTTTTTCCGGCTCTTTGTCAACTGTAG---
19AH     AAAGAAATGAAAGGAAAGCTAAGGCTGTTCCTTTTTCCGGCTCTTTGTCAACTGTAG---
23FPO    AAAGAAATGAAAGGAAAGCTAAGGCTGTTCCTTTTTCCGGCTCTTTGTCAACTGT-----
19FTW    AAAGAAATGAAAGGAAAGCTAAGGCTGTTCCTTTTTCCGGCTCTTTGTCAACTGTAGT--
9VSP     AAAGAAATGAAAGGAAAGCTAAGGCTGTTCCTTTTTCCGGCTCTTTGTCAACTGTAG---
TIGR4    AAAGAAATGAAAGGAAAGCTAAGGCTGTTCCTTTTTCCGGCTCTTTGTCAACTGTAGTGG
23FTW    AAAGAAATGAAAGGAAAGCTAAGGCTGTTCCTTTTTCCGGCTCTTTGTCAACTGTA----
         ********************************************************
```

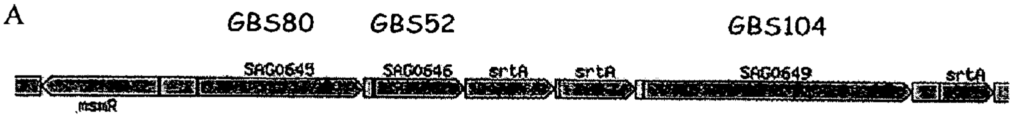

B

Intergenic region between AraC R and GBS 80

AraC..CAT

TTGATAGACCGCCTTCATTATCATTTCTAGAATTTTTCTTTAGGTTTGTA
AAGACTACAAAATAAAATGATGAAAACAACTATCTTGTGGATACACTAAA
AAGACACGCTAATTAGCAAACTCTCTCTTCATCATCTCTCACCATTATTA
TACTAC*TATTTATAT*GACAAATAAAGGTGATTT*TGTTAA*AATATAACTTT
GAAAATCCACATATATTTTTAATCTTCCGTCTGAAAAAATAAATAAAAAT
AGTAAAAATAAACACGAATTTAAAATAAGCAAATTTTTTAAGAAAATCTG
TGCTAAACTTTAATAGTTTTGTGCTTAATAATAATCAGCACTTACAAAGA
ACAAAGGGAAAAGCGAGGAGAGAACTTTTA ATG.. GBS80

C

| 187 | 4A | | 5A | | 5A |
|---|---|---|---|---|---|
| 233 | 6A | | 6A | | 7A |
| Strain | FACS a-80 | Strain | FACS a-80 | Strain | FACS a-80 |
| 1998 | 95 | 5364 | **454** | 2129 | 57 |
| 2110 | 0 | JMV071 | **556** | 2274 | 113 |
| 2603 | 62 | JM91003 | **587** | 5401 | 170 |
| 3050 | 43 | CJB111 | **365** | 5408 | 0 |
| 5376 | 165 | | | 5518 | 31 |
| M781 | 65 | | | CJB110 | 71 |
| COH1 | **305** (G->T 179) | | | J7357B | 91 |
| 18rs 21 | 0 (STOP, no LPXTG) | | | COH31 | 0 |
| | | | | | |
| | | | | | |

| AI-1 | | | | | | | | | | | |
|---|---|---|---|---|---|---|---|---|---|---|---|
| | | | aa | M1 | M3 | M5 | M18 | M49 | M6 | M12 | |
| M6 | | | | | | | | | | | |
| 50913503 | M6_Spy0157 | LPXTG | 628 | gas15 30%in593aa | M3-0098 46%in256aa M3-0104 28%in563aa | | M18-0132 24%in701aa | | | M12-4134 74%in703aa | Fibronectin-binding protein (protein F) |
| 50913505 | M6_Spy0159 | LPXSG | 1037 | | M3-0104 25%in339aa | | | | | M12-4141 37%in98aa | Collagen adhesion protein |
| 50913506 | M6_Spy0160 | LPXTG | 557 | | | | | | | | Fimbrial structural subunit |

Figure 198

| AI-2 | | | | | | | | | | | |
|---|---|---|---|---|---|---|---|---|---|---|---|
| | | | aa | M1 | M3 | M5 | M18 | M49 | M6 | M12 | |
| M1 | | | | | | | | | | | |
| gas15 | gas15 | VVXTG | 762 | | M3-0098 50%in738aa | M5-orf78 60%in462aa | M18-0126 54%in469aa | | | M12-4135 54%in747aa | Cpa |
| 13621428 | SPy0128 gas16 | EVXTG | 340 | | M3-0100 40%in354aa | M5-orf80 41%in358aa | M18-0128 38%in357aa | | | M12-4137 40%in354aa | hypothetic al protein (fimbrial) |
| 13621430 | SPy0130 gas18 | LPXTG | 215 | | M3-0102 32%200aa | M5-orf82 31%in213aa | M18-0130 32%in213aa | | | M12-4139 31%in206aa | hypothetic al protein |

Figure 199

| AI-3 | | | | | | | | | | | |
|---|---|---|---|---|---|---|---|---|---|---|---|
| | | | aa | M1 | M3 | M5 | M18 | M49 | M6 | M12 | |
| M3 | | | | | | | | | | | |
| 21909634 | SpyM3_0098 | VPXTG | 744 | gas15 51%in739aa | | M5-orf78 58%in484aa | M18-0126 74%in482aa | | | M12-4135 55%in751aa | putative collagen binding protein (Cpb) |
| 21909636 | SpyM3_0100 | QVXTG | 344 | gas16 40%in354aa | | M5-orf80 64%in349aa | M18-0128 67%in345aa | | | M12-4137 61%in344aa | conserved hypothetical protein (fimbrial) |
| 21909638 | SpyM3_0102 | LPXAG | 195 | gas18 32%in200aa | | M5-orf82 98%in183aa | M18-0130 97%in183aa | | | M12-4139 99%in183aa | hypothetical protein |
| 21909640 | SpyM3_0104 | LPXTG | 696 | | | M5-orf84 88%in656aa | M18-0132 88%in656aa | | | M12-4141 59%in612aa | protein F2 like fibronectin-binding |

Figure 200A

| M18 | | | | | | | | | | | |
|---|---|---|---|---|---|---|---|---|---|---|---|
| 19745301 | spyM18_0126 | VPXTG | 524 | gas15 54%in469aa | M3-0098 74%in482 | M5-orf78 61%in528aa | | | | M12-4135 59%in489aa | putative collagen binding protein (Cpb) |
| 19745303 | spyM18_0128 | QVXTG | 344 | gas16 38%in357aa | M3-0100 67%in345aa | M5-orf80 60%in349aa | | | | M12-4137 62%in344aa | conserved hypothetical protein (fimbrial) |
| 19745305 | spyM18_0130 | LPXAG | 195 | gas18 32%in213aa | M3-0102 97%in189aa | M5-orf82 99%in195aa | | | | M12-4139 97%in189aa | hypothetical protein |
| 19745307 | spyM18_0132 | LPXTG | 696 | | M3-0104 88%in656aa | M5-orf84 100%in696aa | | | | M12-4141 50%in701aa | protein F2 like fibronectin -binding |

Figure 200B

| M5 | | | | | | | | | | | |
|---|---|---|---|---|---|---|---|---|---|---|---|
| orf78 | | VPXTG | 523 | gas15 60%in462aa | M3-0098 58%in481aa | | M18-0126 61%in528aa | | | M12-4135 80%in484aa | putative collagen binding protein (Cpb) |
| orf80 | | QVXTG | 352 | gas16 39%in356aa | M3-0100 64%in349aa | | M18-0128 60%in349aa | | | M12-4137 65%in348aa | conserved hypothetic al protein (fimbrial) |
| orf82 | | LPXAG | 224 | gas18 31%in213aa | M3-0102 98%in183aa | | M18-0130 99%in195aa | | | M12-4139 98%in189aa | hypothetic al protein |
| orf84 | | LPXTG | 696 | | M3-104 88%in656aa | | M18-0132 100%in696aa | | | M12-4141 50%in701aa | protein F2 like fibronectin -binding |

Figure 200C

| M49 | | | | | | | | | | | |
|---|---|---|---|---|---|---|---|---|---|---|---|
| 56808848 | | VPXTG | 744 | gas15<br>55%in738aa | M3-0098<br>72%in743aa | M5-orf78<br>78%in483 | M18-0126<br>61% in484 | | | M12-4135<br>73%in752aa | putative collagen binding protein (Cpb) |
| 56808846 | | QVXTG | 344 | gas16<br>36%in355aa | M3-0100<br>66%in345aa | M5-orf80<br>61%in349aa | M18-0128<br>90%in344aa | | | M12-4137<br>62%in344aa | conserved hypothetical protein (fimbrial) |
| 56808844 | | LPXAG | 189 | gas18<br>31%in206aa | M3-102<br>98%in189aa | M5-orf82<br>98%in189aa | M18-0130<br>98%in189aa | | | M12-4139<br>98%in189aa | hypothetical protein |
| 56808842 | | LPXTG | 1160 | | M3-104<br>59%in612aa | M5-orf84<br>50%in701aa | M18-0132<br>50%in701aa | | M6-0157<br>32%in296aa | M12-4141<br>91%in1164aa | protein F2 like fibronectin -binding |

Figure 200D

| AI-4 | | | | | | | | | | | |
|---|---|---|---|---|---|---|---|---|---|---|---|
| | | | aa | M1 | M3 | M5 | M18 | M49 | M6 | M12 | |
| M12 | | | | | | | | | | | |
| 19224134 | | LPXTG | 698 | gas15<br>44%in297aa | M3-0098<br>49%in254aa | | | | M6-0157<br>74%in703aa | | protein F |
| 19224135 | | VPXTG | 756 | gas15<br>54%in747aa | M3-0098<br>55%in751aa | orf78<br>80%in484aa | M18-0126<br>59%in483aa | | M6-0157<br>51%in275aa | | Cpa |
| 19224137 | | QVXTG | 342 | gas16<br>40%in354aa | M3-0100<br>61%in344aa | orf80<br>65%in384aa | M18-0128<br>62%in344aa | | | | EftLSLA (fimbrial) |
| 19224139 | | LPXAG | 189 | gas18<br>31%in206aa | M3-0102<br>99%in183aa | orf82<br>98%in189aa | M18-130<br>97%in189aa | | | | Orf2 |
| 19224141 | | LPXTG | 1161 | | M3-0104<br>59%in612aa | orf84<br>50%in701aa | M18-0132<br>50%in701aa | | | | protein F2 |

Figure 201

Deletion of GBS80 protein does not affect the ability of GBS to adhere and invade ME180 cervical epithelial cells

Deletion of GBS104 protein, but not GBS80, reduces the capacity of GBS to invade J774 macrophage-like cell line

GBS80 knockout mutant strain partially loses the ability to translocate through an epithelial monolayer

Deletion of GBS104 protein in the GBS strain COH1 reduces the ability of GBS to adhere to ME180 cervical epithelial cells

COH1 overexpressing GBS80 protein has an impaired capacity to translocate through an epithelial monolayer COH1 infection of ME180 cells F-actin Blue
α- serotype III capsule Red
α-GBS80 Green COH1 overexpressing GBS80
infection of ME180 cells
F-actin Blue
α-GBS80 Green
α-serotype III capsule Red GBS 67 binds to fibronectin

Figure 226 A

| | | GBS 59 | | |
|---|---|---|---|---|
| GBS strains | Type | PCR | FACS (a-cjb111) | FACS (a-2603) |
| DK1 | | + | 565 | |
| DK8 | | + | 559 | |
| Davis | | + | 577 | |
| 515 | Ia | + | 583 | 0 |
| 090 | | + | 0 | 0 |
| 2986 | | + | 443 | |
| 5551 | | + | 524 | |
| H36B | | + | 0 | 410 |
| 7357b- | Ib | + | 596 | |
| 5518 | | + | 190 | |
| D136C | | + | 504 | |
| COH31 | III | + | 505 | |
| 1998 | | + | 59 | 510 |
| 18RS21 | | + | 0 | 353 |
| DK21 | | + | 249 | 0 |
| 3050 | II | + | 0 | 570 |
| 5401 | | + | 0 | 400 |
| 2141 | | + | 0 | 371 |
| CJB111 | | + | 625 | 0 |
| 2603 | V | + | 0 | 73 |
| 5364 | | + | 593 | |
| 2110 | | + | 590 | 0 |
| 2274 | | + | 0 | 400 |
| 1999 | IV | + | 594 | |
| 2210 | | + | 636 | |
| 5408 | VIII | + | 537 | |
| CJB110 | NT | + | 0 | 0 |
| 1169 | | + | 227 | 0 |

|  |  | GBS 59 | | |
|---|---|---|---|---|
| GBS strains | Type | PCR | FACS (a-cjb111) | FACS (a-2603) |
| A909 | Ia | - | 22 | |
| 2177 | Ib | - | 75 | |
| COH1 | | - | 0 | 0 |
| M732 | | - | 0 | |
| M781 | III | - | 17 | |
| 5376 | | - | 60 | |
| 5435 | | - | 55 | |
| SMU071 | VIII | - | 0 | |
| JM9130013 | | - | 0 | 0 |

Figure 227 A

| GBS strains | Type | FACS (D Mean) | | | | |
|---|---|---|---|---|---|---|
| | | GBS 80 | GBS 104 | GBS 67 | GBS 322 | GBS 59 |
| DK1 | Ia | 0 | 0 | 478 | 153 | 565 |
| DK8 | | 0 | 0 | 475 | 213 | 559 |
| Davis | | 0 | 0 | 430 | 86 | 577 |
| 515 | | 0 | 0 | 409 | 227 | 583 |
| 090 | | 0 | 0 | 0 | 0 | 0 |
| A909 | | 46 | 29 | 0 | 0 | 0 |
| 2986 | | 0 | 0 | 397 | 0 | 443 |
| 5551 | | 0 | 0 | 485 | 36 | 524 |
| 2177 | Ib | 477 | 355 | 66 | 323 | 0 |
| H36B | | 0 | 0 | 444 | 105 | 410 |
| 7357b- | | 91 | 0 | 316 | 102 | 596 |
| 5518 | | 31 | 0 | 162 | 0 | 190 |
| COH1 | III | 305 | 226 | 0 | 130 | 0 |
| D136C | | 40 | 40 | 406 | 460 | 504 |
| COH31 | | 0 | 0 | 273 | 479 | 505 |
| M732 | | 141 | 101 | 0 | 292 | 0 |
| M781 | | 111 | 136 | 0 | 224 | 0 |
| 1998 | | 140 | 77 | 350 | 288 | 510 |
| 5376 | | 165 | 156 | 0 | 76 | 0 |
| 5435 | | 93 | 100 | 0 | 88 | 0 |
| 18RS21 | II | 0 | 0 | 103 | 471 | 353 |
| DK21 | | 0 | 0 | 331 | 342 | 249 |
| 3050 | | 71 | 46 | 460 | 188 | 570 |
| 5401 | | 75 | 28 | 618 | 135 | 400 |
| 2141 | | 0 | 0 | 370 | 76 | 371 |
| CJB111 | V | 365 | 236 | 481 | 58 | 625 |
| 2603 | | 62 | 0 | 105 | 293 | 73 |
| 5364 | | 454 | 281 | 394 | 463 | 593 |

| | | | | | | |
|---|---|---|---|---|---|---|
| 2110 | | 0 | 0 | 589 | 0 | 590 |
| 2274 | IV | 123 | 62 | 484 | 161 | 400 |
| 1999 | | 0 | 389 | 453 | 55 | 594 |
| 2210 | | 0 | 0 | 574 | 0 | 636 |
| SMU071 | VIII | 556 | 393 | 74 | 170 | 0 |
| JM9130013 | | 587 | 436 | 72 | 133 | 0 |
| 5408 | | 0 | 0 | 433 | 0 | 537 |
| CJB110 | NT | 0 | 0 | 245 | 587 | 0 |
| 1169 | | 0 | 0 | 443 | 213 | 227 |
| D Mean > 200 | | 6/37 (16%) | 7/37 (19%) | 24/37 (65%) | 14/37 (38%) | 24/37 (65%) |

| | | FACS (ΔMean) | | | | | | | | | | | | | | | | Δmean |
|---|---|---|---|---|---|---|---|---|---|---|---|---|---|---|---|---|---|---|
| GBS Strain | Type | GBS 80 142 F | | GBS 104 Mab | | GBS 322 36 | | GBS 67 S1 | | GBS 67 H36B | | GBS 59 2603 | | GBS 59 CJB111 | | GBS 59 515 | | neg. control |
| **cdc-1** | II | 114 | 95 | 0 | 0 | 122 | 122 | 360 | 341 | 422 | 403 | 92 | 73 | 254 | 235 | 306 | 287 | 19 |
| **cdc-2** | IB | 173 | 69 | 92 | 0 | 95 | 75 | 552 | 448 | 590 | 486 | 135 | 31 | 635 | 531 | 197 | 93 | 104 |
| **cdc-3** | II | 566 | 508 | 360 | 302 | 85 | 60 | 364 | 306 | 433 | 375 | 111 | 53 | 448 | 390 | 310 | 252 | 58 |
| **cdc-4** | V | 524 | 432 | 337 | 245 | 284 | 204 | 577 | 485 | 625 | 533 | 105 | 13 | 674 | 582 | 303 | 211 | 92 |
| **cdc-5** | II | 140 | 0 | 0 | 0 | 462 | 300 | 487 | 297 | 563 | 373 | 175 | 0 | 373 | 183 | 440 | 250 | 190 |
| **cdc-6** | V | 544 | 484 | 361 | 301 | 95 | 95 | 586 | 526 | 601 | 541 | 55 | 0 | 686 | 626 | 302 | 242 | 60 |
| **cdc-7** | III | 155 | 116 | 44 | 5 | 134 | 118 | 95 | 56 | 138 | 99 | 74 | 35 | 92 | 53 | 91 | 52 | 39 |
| **cdc-8** | III | 347 | 304 | 192 | 149 | 74 | 62 | 98 | 55 | 170 | 127 | 72 | 29 | 88 | 45 | 108 | 65 | 43 |
| **cdc-9** | II | 89 | 65 | 0 | 0 | 226 | 191 | 390 | 366 | 504 | 480 | 181 | 157 | 317 | 293 | 410 | 386 | 24 |
| **cdc-10** | IA | 46 | 24 | 0 | 0 | 152 | 152 | 494 | 472 | 531 | 509 | 43 | 21 | 16 | 0 | 48 | 26 | 22 |
| **cdc-11** | IA | 17 | 0 | 0 | 0 | 295 | 135 | 569 | 550 | 569 | 550 | 47 | 28 | 467 | 448 | 648 | 629 | 19 |
| **cdc-12** | V | 439 | 430 | 290 | 281 | 60 | 30 | 174 | 165 | 227 | 218 | 52 | 43 | 139 | 130 | 207 | 198 | 9 |
| **cdc-13** | IA | 33 | 0 | 0 | 0 | 216 | 146 | 469 | 436 | 469 | 436 | 100 | 67 | 361 | 328 | 571 | 538 | 33 |
| **cdc-14** | III | 78 | 68 | 10 | 0 | 213 | 191 | 50 | 40 | 85 | 75 | 38 | 28 | 69 | 59 | 67 | 57 | 10 |
| **cdc-15** | III | 119 | 53 | 24 | 0 | 108 | 98 | 48 | 0 | 127 | 61 | 89 | 23 | 105 | 39 | 100 | 34 | 66 |
| **cdc-16** | V | 363 | 335 | 177 | 149 | 310 | 270 | 70 | 42 | 127 | 99 | 48 | 20 | 130 | 102 | 128 | 100 | 28 |
| **cdc-17** | III | 160 | 0 | 163 | 0 | 408 | 248 | 377 | 217 | 410 | 250 | 441 | 281 | 359 | 199 | 167 | 7 | 160 |
| **cdc-18** | III | 49 | 28 | 0 | 0 | 239 | 218 | 34 | 13 | 36 | 15 | 16 | 0 | 49 | 28 | 56 | 35 | 21 |
| **cdc-19** | III | 182 | 101 | 0 | 0 | 361 | 280 | 310 | 229 | 312 | 231 | 384 | 303 | 220 | 139 | 0 | 0 | 81 |
| **cdc-20** | V | 348 | 304 | 203 | 159 | 380 | 336 | 166 | 122 | 211 | 167 | 114 | 70 | 232 | 188 | 128 | 84 | 44 |
| **cdc-21** | II | 222 | 132 | 83 | 0 | 150 | 60 | 331 | 241 | 336 | 246 | 0 | 0 | 420 | 330 | 59 | 0 | 90 |
| **cdc-22** | IA | 0 | 0 | 13 | 13 | 43 | 43 | 238 | 238 | 238 | 238 | 43 | 43 | 38 | 38 | 429 | 429 | 0 |
| cdc-22 (9-6-05) | | 23 | 0 | 34 | 0 | 110 | 20 | 310 | 220 | 320 | 230 | 113 | 23 | 117 | 27 | 344 | 254 | 90 |
| **cdc-23** | V | 484 | 484 | 374 | 374 | 278 | 278 | 124 | 124 | 206 | 206 | 11 | 11 | 91 | 91 | 236 | 236 | 0 |
| **cdc-24** | V | 137 | 52 | 0 | 0 | 333 | 248 | 90 | 5 | 110 | 25 | 110 | 25 | 120 | 35 | 70 | 0 | 85 |
| **cdc-25** | IA | 0 | 0 | 0 | 0 | 351 | 190 | 530 | 370 | 565 | 405 | 495 | 335 | 442 | 282 | 625 | 465 | 160 |
| **cdc-26** | II | 117 | 2 | 0 | 0 | 185 | 70 | 210 | 95 | 285 | 170 | 30 | 0 | 175 | 60 | 210 | 95 | 115 |
| **cdc-27** | III | 323 | 95 | 34 | 0 | 498 | 270 | 346 | 118 | 406 | 178 | 424 | 196 | 314 | 86 | 64 | 0 | 228 |
| **cdc-28** | V | 150 | 92 | 20 | 0 | 132 | 74 | 462 | 404 | 505 | 447 | 0 | 0 | 526 | 468 | 78 | 20 | 58 |
| **cdc-29** | IV | 90 | 73 | 65 | 48 | 195 | 178 | 90 | 73 | 150 | 133 | 150 | 133 | 138 | 121 | 110 | 93 | 17 |
| **cdc-30** | V | 390 | 187 | 336 | 133 | 348 | 145 | 229 | 26 | 244 | 41 | 113 | 0 | 268 | 65 | 223 | 20 | 203 |
| **cdc-31** | IA | 22 | 0 | 68 | 0 | 306 | 182 | 368 | 244 | 386 | 262 | 126 | 2 | 248 | 124 | 426 | 302 | 124 |
| **cdc-32** | IA | 45 | 0 | 12 | 0 | 260 | 175 | 190 | 105 | 205 | 120 | 30 | 0 | 100 | 15 | 185 | 100 | 85 |
| **cdc-33** | II | 50 | 0 | 0 | 0 | 306 | 156 | 134 | 0 | 237 | 87 | 4 | 0 | 180 | 30 | 190 | 40 | 150 |
| **cdc-34** | III | 152 | 60 | 47 | 0 | 342 | 250 | 44 | 0 | 74 | 0 | 27 | 0 | 102 | 8 | 48 | 0 | 92 |
| **cdc-35** | V | 227 | 227 | 40 | 40 | 246 | 246 | 395 | 395 | 415 | 415 | 0 | 0 | 550 | 550 | 142 | 142 | 0 |
| **cdc-36** | IB | 25 | 15 | 8 | 0 | 30 | 20 | 154 | 144 | 174 | 164 | 33 | 23 | 222 | 212 | 20 | 10 | 10 |
| **cdc-37** | III | 168 | 53 | 61 | 0 | 361 | 246 | 82 | 0 | 133 | 18 | 83 | 0 | 132 | 17 | 75 | 0 | 115 |
| **cdc-38** | II | 140 | 14 | 30 | 0 | 338 | 212 | 124 | 0 | 198 | 72 | 158 | 32 | 138 | 12 | 104 | 0 | 126 |
| **cdc-39** | II | 126 | 0 | 0 | 0 | 316 | 148 | 466 | 298 | 514 | 346 | 438 | 270 | 184 | 16 | 34 | 0 | 168 |
| **cdc-40** | V | 420 | 366 | 214 | 160 | 22 | 0 | 103 | 49 | 162 | 108 | 90 | 36 | 209 | 155 | 192 | 138 | 54 |
| **cdc-41** | II | 146 | 31 | 15 | 0 | 380 | 265 | 330 | 215 | 425 | 310 | 140 | 25 | 280 | 165 | 315 | 200 | 115 |

Figure 229

Expected strain coverage

MIX GBS proteins

| | vaccine options | w/o 59 | w/o 322 | w/o 104+322 | w/o 59+322 | | |
|---|---|---|---|---|---|---|---|
| n. antigens FACS+++ | 80+104+67+59+322 | 80+104+67+322 | 80+104+67+59 | 80+67+59 | 80+104+67 | 80+67 | 80+59 |
| 1 | 89% | 89% | 80% | 80% | 79% | 79% | 74% |
| 2 | 74% | 51% | 71% | 64% | 24% | 16% | 16% |
| 3 | 23% | 14% | 17% | 16% | 13% | | |

- GBS 322 but not GBS 59 is important to increase strain coverage
- GBS 59 probably could be useful to increase the vaccine strength

Assumption:

- Protein antigens that are highly accessible to antibodies confer 100% protection with suitable adjuvants

Figure 234 A

Introducing Heterologous Antigens into AI-1 pilus to Obtain Protection Across GBS Strains

1- Substitution of GBS 104 with GBS67 from Island II

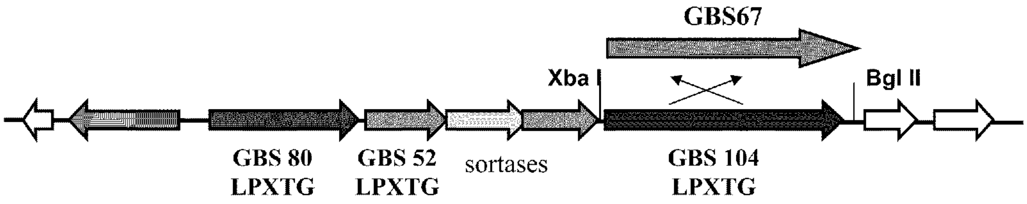

Oligo GBS67pAMXbafor AGTCAGTCTCTAGACGGCACAATAGGAGTTGTAAA
Oligo GBS67pAMBglrev CACCTGTCATAGATCTTAAGAATACTAAAGCGCATAA

2- Substitution of GBS52 or 104 with:

a) GBS 59 alleles 515 or CJB
b) GBS 59 allele CJB111 + sortases island II
c) GBS 59 allele 515 + GBS 59 CJB111 + sortases island II

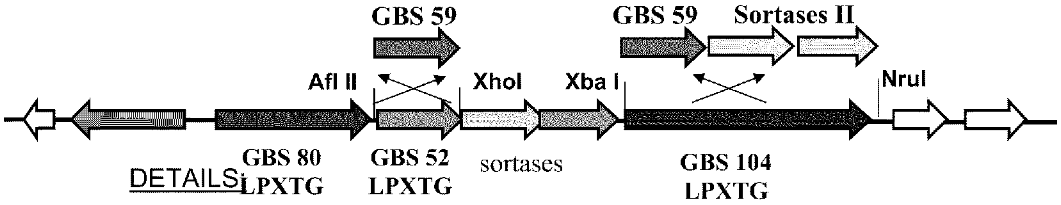

a) Oligos to be used:
Oligo 59pAMAflfor1 AGTCAGTCCTTAAGCCGCATATTATTAATCATGTTG (allele 515)
Oligo 59pAMAflfor1 AGTCAGTCCTCGAGTTAAACTTCCTCTGATTGACG (allele 515)
Oligo 59pAMAflfor2 AGTCAGTCCTTAAGAAGGAGTGGTGCTGCGGTAA (allele CJB111)
Oligo 59pAMXhorev2 AGTCAGTCCTCGAGTTAAGCTTCCTCTGATTGACG (allele CJB111)

b) Oligos to be used:
Oligo GBS59XbaF CTAGTGATATATCTAGAGAAAAAG
Oligo Sort59NruR CTAGCTAGTCGCGACTTTTTCATTTTTGATTTCCCTTTC

Figure 234 B

3- Substitution of GBS104 with a fusion of GBS322-GBS67 to include GBS 322 into AI-1 a) Construct 1: GBS67 complete sequenze included
**b) Construct 2: Only part of GBS 67 was included *(deleted bold region)***

DETAILS:

a) Construct 1:
Legend:
Pink: GBS322
Black GBS67
*Black Bold:* fragment of GBS67 eliminated in costruct 2
Green PK motifs
Yellow E motifs
Red LPXTG > gbs67-515 + 322
MRKYQKFSKILTLSLFCLSQIPLNTNVLGESTVPENGAKGKLVVKKTDDQNKPLSKATFV
LKTTAHPESKIEKVTAELTGEATFDNLIPGDYTLSEETAPEGYKKTNQTWQVKVESNGKT
TIQNSGDKNSTIGQNQEELDKQYPPTGIYEDTKESYKLEHVKGSVPNGKSEAKAVNPYSS
EGEHIREIPEGTLSKRISEVGDLAHNKYKIELTVSGKTIVKPVDKQKPLETDTTWTARTVSEV
KADLVKQDNKSSYTVKYGDTLSVISEAMSIDMNVLAKINNIADINLIYPETTLTVTYDQKSHTA
TSMKIETPATNAAGQTTATVDLKTNQVSVADQKVSLNTISEGMTPEAATTIVSPMKTYSSAP
ALKSKEVLAQEQAVSQAAANEQVSPAPVKSITSEVPAAKEEVKPTQTSVSQSTTVSPASVA
AETPAPVAKVAPVRTVAAPRVASVKVVTPKVETGASPEHVSAPAVPVTTTSPATDSKLQAT
EVKSVPVAQKAPTATPVAQPASTTNAVAAHPENAGLQPHVAAYKEKVASTYGVNEFSTYRAG
DPGDHGKGLAVDFIVGTNQALGNKVAQYSTQNMAANNISYVIWQQKFYSN
TNSIYGPANTWNAMPDRGGVTANHYDHVHVSFNK*DVVFVLDNSNS*
*MNNDGPNFQRHNKAKKAAEALGTAVKDILGANSDNRVALVTYGSDIFDGRSVDVVKGFKE*
*DDKYYGLQTKFTIQTENYSHKQLTNNAEEIIKRIPTEAPKAKWGSTTNGLTPEQQKEYYL*
*SKVGETFTMKAFMEADDILSQVNRNSQKIIVHVTDGVPTRSYAINNFKLGASYESQFEQM*
*KKNGYLNKSNFLLTDKPDDIKGN*GESYFLFPLDSYQTQIISGNLQKLHYLDLNLNYPKGT
IYRNGPVKEHGTPTKLYINSLKQKNYDIFNFGIDISGFRQVYNEEYKKNQDGTFQKLKEE
AFKLSDGEITELMRSFSSKPEYYTPIVTSADTSNNEILSKIQQQFETILTKENSIVNGTI
EDPMGDKINLQLGNGQILQPSDYTLQGNDGSVMKDGIATGGPNNDGGILKGVKLEYIGNK
LYVRGLNLGEGQKVTLTYDVKLDDSFISNKFYDTNGRTTLNPKSEDPNTLRDFPIPKIRD
VREYPTITIKNEKKLGEIEFIKVDKDNNKLLLKGATFELQEFNEDYKLYLPIKNNNSKVV
TGENGKISYKDLKDGKYQLIEAVSPEDYQKITNKPILTFEVVKGSIKNIIAVNKQISEYH
EEGDKHLITNTHIPPKGIPKTGGKGILSFILIGGAMMSIAGGIYIWKRYKKSSDMSIKK
D

Figure 234 C b) Construct 2:

>gbs67-515 deleted+ 322
MRKYQKFSKILTLSLFCLSQIPLNTNVLGESTVPENGAKGKLVVKKTDDQNKPLSKATFV
LKTTAHPESKIEKVTAELTGEATFDNLIPGDYTLSEETAPEGYKKTNQTWQVKVESNGKT
TIQNSGDKNSTIGQNQEELDKQYPPTGIYEDTKESYKLEHVKGSVPNGKSEAKAVNPYS
SEGEHIREIPEGTLSKRISEVGDLAHNKYKIELTVSGKTIVKPVDKQKPLETDTTW
TARTVSEVKADLVKQDNKSSYTVKYGDTLSVISEAMSIDMNVLAKINNIADINLIYPETTLTV
TYDQKSHTATSMKIETPATNAAGQTTATVDLKTNQVSVADQKVSLNTISEGMTPEAATTI
VSPMKTYSSAPALKSKEVLAQEQAVSQAAANEQVSPAPVKSITSEVPAAKEEVKPTQTS
VSQSTTVSPASVAAETPAPVAKVAPVRTVAAPRVASVKVVTPKVETGASPEHVSAPAVP
VTTTSPATDSKLQATEVKSVPVAQKAPTATPVAQPASTTNAVAAHPENAGLQPHVAAYK
EKVASTYGVNEFSTYRAGDPGDHGKGLAVDFIVGTNQALGNKVAQYSTQNMAANNISYV
IWQQKFYSNTNSIYGPANTWNAMPDRGGVTANHYDHVHVSFNKGESYFLFPLDSYQTQ
IISGNLQKLHYLDLNLNYPKGTIYRNGPVKEHGTPTKLYINSLKQKNYDIFNFGIDISGFRQ
VYNEEYKKNQDGTFQKLKEEAFKLSDGEITELMRSFSSKPEYYTPIVTSADTSNNEILSKI
QQQFETILTKENSIVNGTIEDPMGDKINLQLGNGQILQPSDYTLQGNDGSVMKDGIATGG
PNNDGGILKGVKLEYIGNKLYVRGLNLGEGQKVTLTYDVKLDDSFISNKFYDTNGRTTLN
PKSEDPNTLRDFPIPKIRDVREYPTITIKNEKKLGEIEFIKVDKDNNKLLLKGATFELQEFNE
DYKLYLPIKNNNSKVVTGENGKISYKDLKDGKYQLIEAVSPEDYQKITNKPILTFEVVKGS
IKNIIAVNKQISEYHEEGDKHLITNTHIPPKGIIPKTGGKGILSFILIGGAMMSIAGGIYIWKRY
KKSSDMSIKKD

Oligos to be used:

Oligo GBS67pAMXbafor (vedi operone)
AGTCAGTCTCTAGACGGCACAATAGGAGTTGTAAA
XbaI

Oligo GBS67soe1rev
CCACGTCGTATCTGTTTCTAACGGCTTTTGTTTGTCCACT

Oligo GBS322soe2for
GACAAACAAAAGCCGTTAGAAACAGATACGACGTGGACAG

Oligo GBS322soe2rev1 (per costrutto non deleto in 67)
GAGTACGAAGACAACATCTTTGTTAAATGATACGTGAACG

Oligo GBS322soe2rev2 (per costrutto deleto in 67)
TAAAAAGTAACTCTCCCCTTTGTTAAATGATACGTGAACG

Oligo fine67soe3for1 (per costrutto non deleto in 67)
CACGTATCATTTAACAAAGATGTTGTCTTCGTACTCGAT

Oligo fine67soe3for2 (per costrutto non deleto in 67)
CACGTATCATTTAACAAAGGGGAGAGTTACTTTTTATTTCC

Oligo GBS67pAMBglrev (vedi operone)
CACCTGTCATAGATCTTAAGAATACTAAAGCGCATAA
BglII

Figure 234 D

PCR Soe1: GBS67pAMXbafor + GBS67soe1rev 727 bp
PCR Soe2 non del: GBS322soe2for + GBS322soe2rev1 1260 bp
PCR Soe2 del: GBS322soe2for + GBS322soe2rev2 1260 bp
PCR Soe3 non del: fine67soe3for1 + GBS67pAMBglrev 2061 bp
PCR Soe3 del: fine67soe3for2 + GBS67pAMBglrev 1419 bp
PCR Soe4 non del. PCR25: GBS67pAMXbafor + GBS67pAMBglrev 4000 bp
Substrato PCRSoe1, 2, 3 non del
PCR Soe4 del, PCR26: GBS67pAMXbafor + GBS67pAMBglrev 3312 bp
Substrato PCRSoe1, 2, 3 del

4- Substitution of GBS 52 with a fusion of GBS322-GBS52 to include GBS 322 into AI-1

(same legend as for GBS67 derivatives)
a) Construct 1: GBS52 complete sequenze included
**b) Construct 2: Only part of GBS 52 was included *(deleted bold region)***

DETAILS:

a) Construct 1:
>GBS322-52 senza delezione di 52 (B) PCR 24
MKMNKKVLLTSTMAASLLSVASVQAQETDTTWTARTVSEVKADLVKQDNK
SSYTVKYGDTLSVISEAMSIDMNVLAKINNIADINLIYPETTLTVTYDQK
SHTATSMKIETPATNAAGQTTATVDLKTNQVSVADQKVSLNTISEGMTPE
AATTIVSPMKTYSSAPALKSKEVLAQEQAVSQAAANEQVSPA
PVKSITSEVPAAKEEVKPTQTSVSQSTTVSPASVAAETPAPVAKVAPVRTVAAPRVAS
VKVVTPKVETGASPEHVSAPAVPVTTTSPATDSKLQATEVKSVPVAQKAP
TATPVAQPASTTNAVAAHPENAGLQPHVAAYKEKVASTYGVNEFSTYRAG
DPGDHGKGLAVDFIVGTNQALGNKVAQYSTQNMAANNISYVIWQQKFYSN
TNSIYGPANTWNAMPDRGGVTANHYDHVHVSFNK *HQLTIVHLEARDIDRPNPQL*
*EIAPKEGTPIEGVLYQLYQLKSTEDGDLLAHWNSLTITELKKQAQQVFEA*
*TTNQ*QGKATFNQLPDGIYYGLAVKAGEKNRNVSAFLVDLSEDKVIYPKII
WSTGELDLLKVGVDGDTKKPLAGVVFELYEKNGRTPIRVKNGVHSQDIDA
AKHLETDSSGHIRISGLIHGDYVLKEIETQSGYQIGQAETAVTIEKSKTV
TVTIENKKVPTPKVPSRGGLIPKTGEQQAMALVIIGGILIALALRLLSKH
RKHQNKD

Figure 234 E b) Construct 2:

>GBS322-52 (A) PCR 23
MKMNKKVLLTSTMAASLLSVASVQAQETDTTWTARTVSEVKADLVKQDNK
SSYTVKYGDTLSVISEAMSIDMNVLAKINNIADINLIYPETTLTVTYDQK
SHTATSMKIETPATNAAGQTTATVDLKTNQVSVADQKVSLNTISEGMTPE
AATTIVSPMKTYSSAPALKSKEVLAQEQAVSQAAANEQVSPA
PVKSITSEVPAAKEEVKPTQTSVSQSTTVSPASVAAETPAPVAKVAPVRTVAAPRVAS
VKVVTPKVETGASPEHVSAPAVPVTTTSPATDSKLQATEVKSVPVAQKAP
TATPVAQPASTTNAVAAHPENAGLQPHVAAYKEKVASTYGVNEFSTYRAG
DPGDHGKGLAVDFIVGTNQALGNKVAQYSTQNMAANNISYVIWQQKFYSN
TNSIYGPANTWNAMPDRGGVTANHYDHVHVSFNK
QGKATFNQLPDGIYYGLAVKAGEKNRNVSAFLVDLSEDKVIYPKII
WSTGELDLLKVGVDGDTKKPLAGVVFELYEKNGRTPIRVKNGVHSQDIDA
AKHLETDSSGHIRISGLIHGDYVLKEIETQSGYQIGQAETAVTIEKSKTV
TVTIENKKVPTPKVPSRGGLIPKTGEQQAMALVIIGGILIALALRLLSKH
RKHQNKD

<u>Oligos to be used:</u>

Oligo 322Aflfor1
AGTCAGTCCTTAAGGATATTATAGTCTCGGACTA
Afl II

Oligo 52 soe1 forA
CACGTATCATTTAACAAACAAGGAAAGGCTACATTTAACC

Oligo 52 soe1 forB
TTCACGTATCATTTAACAAACATCAGTTGACGATTGTTCATC

Oligo52 soe1revA
AAATGTAGCCTTTCCTTGTTTGTTAAATGATACGTGAACG

Oligo52 soe1revB
AACAATCGTCAACTGATGTTTGTTAAATGATACGTGAACG

Oligo 52Xhorev
AAGACCTCCTCGAGATGGCACTT
Xho I

PCR Soe1A: Oligo 322Aflfor1+ Oligo 52 soe1 revA 1370 bp
PCR Soe2A: Oligo52 soe1forA + Oligo 52Xhorev 520 bp
PCR Soe3A: Oligo 322Aflfor1 + Oligo 52Xhorev 1846 bp (con PCR Soe1A + PCR Soe2A) (PCR23)

PCR Soe1B: Oligo 322Aflfor1+ Oligo 52 soe1 revB 1370 bp
PCR Soe2B: Oligo52 soe2forB + Oligo 52Xhorev 742 bp
PCR Soe3B: Oligo 322Aflfor1 + Oligo 52Xhorev 2068 bp (con PCR Soe1B + PCR Soe2B) (PCR 24)

Strain variability – GBS67: 2 alleles

Differences between strains 2603 and H36B
(AA not matching/AA total and % of homology)

114 / 828 (87.1%)

```
  1 MRKYQKFSKILTLSLPCLSGQIPLNTNVLSESTVPENGAKGKLVVKKTDDQ 50
    ||||||||||||||||||||||
  1 .........................NVLGESTVPENGAKGKLVVKKTDDQ 25

 51 NKPLSKATFVLKTIXHPESKIEKVTAELTGGAFTDNLIPGGYTLSEEIAP 100
    |||||||||| | |  ||||||| ||||||||| |||||||||||||||
 26 NKPLSKATFVLKPTSHSESRVEKVTEVTGEATFDNLIPGGYTLSEEIAP 75

101 EGYKKTNQTWQVKVESNGSKTTIQNSGXKRNSTIIGQNQEELDKQYPPTGIYE 150
    |||| ||||||||||| || |||||||| ||  | ||| ||||| |  |||
 76 EGYKKTTQTWQVKVESNGSKTTIQNSDKKSIIEQRQEELDKQYPLTGAVE 125

151 DTKESYKLEHVKGSVPNGKSEAKAVNPYSSEGEHIREIPEGTLSKRISEV 200
    |||||| |||||||||||||| ||| ||||||||||| ||||||||||||
126 DTKESYNLEHVKNSIPNGKLEAKAVNPYSSEGENIREIQEGTLSKRISEV 175

201 GDLAHRTYKIELTVSGCKTIVKPVQKXQKPLDVVFVLDNSNSNRNDGPNFQR 250
    ||  |||| || ||||| ||||   |   |  |||  |||     |  
176 NDLDHRYKIELIYVSGKSIIKTIMKDSFLDVVFVLDNSHSKRONNGKN... 222

251 HRKAKEAASALGTAVNDILGANSDNRVALVTTGSDIPDGRSVVKGFPKE 300
    || |||| || ||||||  |||| ||| |||||||| || ||||| |||
223 .RKAXKGEAVSTIIKDVLGANVENRAALVTTGSDIPDGRTVVKGFKE 271

301 DDKYYGLQTKGFTIQENVSEHQLINNAESIINGRIPTEAPKANSKSTTNGL 350
    ||  | | | | ||  ||| ||| ||||  ||  ||| || |||| || 
272 .DFYYGLSETBFTVQDDIYRQFTNIAADIIKGIPELALPKANRKGTSLGL 320

351 TPEXQCEYYLSKVGETFTNKAFMEADIILSQVMRRHSQNIVRKVDGVPTR 400
    |||| |||||||||||| ||||  ||| ||  | |||| |  | ||||||
321 TPEKREYDLSKVGETFTMKAFVEADTLLSSIQRKSRKKILVHLTDGVPTR 370

401 SYAINFKLGASYESQFEQPKRSNCYLNKSNFLLIHKPEDIKGNGESYFLF 450
    ||||| ||||| | | |  |  |  |  |   | |   |  || || ||
371 SYAINSPYKGSTYAXQFEHIRKKGYLDKNMYFIDDSPEKIKGNGESYFLF 420

451 PLDSYCTQLISGNLQKLYLDLNLNYPKGSTIYRNGPMEHGTPTKLYINS 500
    ||||||| |||||||||||||||||||||| |||| |||||||||||||
421 PLDSYCTQLISGNLQKLYLDLNLNYPNGTIIYRNGPVREHGTPTKLYINS 470

501 LKQRNYDIPFGIDISGFRQVYNEEYKNKQDGTFQXLKELAFKLSDGEIT 550
    ||||||||||||||||||||||||||||||||| ||| |||| |||||
471 LKQRNYDINFGIDISGFRQVYNEDYKKNQDGTFQXLKEEAFELSDGEIT 520

551 ELMRSFSSKPEYYTPIVTSADTSNNEILSKIQQFSFTLTKENSIVNGTI 600
    |||| ||||||||||||||||| ||||||||| ||| ||||||||||||
522 ELMNSFSSKPEYYTPIVTSADVSNNEILSKIQQFEKILTKENSIVMGTI 570

601 EDPMGDKINJQLGNGGTLQPSDYTLQGNDGSVNKDGIATGGPNNDGGILK 650
    ||||||||||||| |||||||||||||||||||||||||||||||||
571 EDPMGDKINLMLGNGQTLQPSDYTLQGNDGSIMKDSTATGGRNNDGGILK 620

651 GVKLEYIGNKLYVRGLNLGEGQKVTLTYDVKLDDSFISNKFYDTNGRTTL 700
    ||||||| |||||||||||||||||||||||||||||||||||||||
621 GVKLEYIKMKLYVRGLNLGEGQKVTLTYDVKLDDSFISNKFYDTNGRTTL 670

701 NPKSEDPNTLRDPFPIPKIRCVREYPFITIKNERKLGEIEFIKYDNDNKL 750
    ||| |||| |||||||||| |||||||  ||||||||||||||| ||||
671 MPKSEEPDTLRDPIPIPKREYVREYPTITIIKNEKKLGGEIEFTRVEKQNNKL 720

751 LLKGATFELQEFNEDKLYLPIKNNNSRVVTGENGRISYKDLKDGKYQLJ 800
    |||||||||||||||||||||||||||||||||||||||||||||||
721 LLKGATFELQEFNEDKLYLPIKNNNSKVVTGENGKISYKDLKDGKYQLJ 770

801 EAVSPECYQKITNKPLLFEVYKGSIKMIIAUNSQISEYHESSGERHLITN 850
    ||||| |||||||||| |||||||| |||| ||||||||| ||| |||
771 EAVSPKDYQKITNKPLTFEVYKGSIQNIIAVNKQISEYHESGGHKLITN 820

851 THIPPKGIPNTGGKGILSFILLGGANNGSIAGGIYEWSRKYKSSEMSIKK 900
    ||||||||
821 THIPKGI......................................... 828
```

Figure 237

Strain variability - GBS67 Allele I (2603)

| Strain | Differences in comparison with 2603 (% of homology) |
|---|---|
| **2603** | - |
| 18RS21 | 1/833 (99.9%) |
| CJB111 | 14/833 (98.3%) |
| 515 | 2/833(99.8%) |

Figure 238

Strain variability - GBS67 Allele II (H36b)

| Strain | Differences in comparison with H36b (% of homology) | FACS ($\alpha$-67 from 2603) |
|---|---|---|
| **H36B** | - | 444 |
| 1169 | 10/823 (98.8%) | 443 |
| 090 | 9/316<br>Stop codon (8G to 7G) | 0 |
| CJB110 | 11/824 (98.7%) | 245 |

Figure 239

IMMUNOGENIC COMPOSITIONS FOR GRAM POSITIVE BACTERIA SUCH AS *STREPTOCOCCUS AGALACTIAE*

This application is a continuation of Ser. No. 11/192,046 filed on Jul. 29, 2005, now abandoned which claims the benefit of 60/697,643 filed Jul. 11, 2005; Ser. No. 60/695,453 filed Jul. 1, 2005; Ser. No. 60/693,001 filed Jun. 21, 2005; Ser. No. 60/673,754 filed Apr. 22, 2005; Ser. No. 60/660,321 filed Mar. 11, 2005; Ser. No. 60/640,069 filed Dec. 30, 2004; Ser. No. 60/633,418 filed Dec. 7, 2004; Ser. No. 60/616,833 filed Oct. 8, 2004; Ser. No. 60/609,833 filed Sep. 13, 2004; and Ser. No. 60/592,805 filed Jul. 29, 2004. Each of these applications is incorporated herein by reference in its entirety.

This application incorporates by reference a 1.8 MB text file created on Oct. 18, 2010 and named "51779_sequencelisting.txt," which is the sequence listing for this application.

FIELD OF THE INVENTION

The invention relates to the identification of adhesin islands within the genome *Streptococcus agalactiae* ("GBS") and the use of adhesin island amino acid sequences encoded by these adhesin islands in compositions for the treatment or prevention of GBS infection. Similar sequences have been identified in other Gram positive bacteria. The invention further includes immunogenic compositions comprising adhesin island amino acid sequences of Gram positive bacteria for the treatment or prevention of infection of Gram positive bacteria. Preferred immunogenic compositions of the invention include an adhesin island surface protein which may be formulated or purified in an oligomeric or pilus form.

BACKGROUND OF THE INVENTION

GBS has emerged in the last 20 years as the major cause of neonatal sepsis and meningitis that affects 0.5-3 per 1000 live births, and an important cause of morbidity among older age groups affecting 5-8 per 100,000 of the population. Current disease management strategies rely on intrapartum antibiotics and neonatal monitoring which have reduced neonatal case mortality from >50% in the 1970's to less than 10% in the 1990s. Nevertheless, there is still considerable morbidity and mortality and the management is expensive. 15-35% of pregnant women are asymptomatic carriers and at high risk of transmitting the disease to their babies. Risk of neonatal infection is associated with low serotype specific maternal antibodies and high titers are believed to be protective. In addition, invasive GBS disease is increasingly recognized in elderly adults with underlying disease such as diabetes and cancer.

The "B" in "GBS" refers to the Lancefield classification, which is based on the antigenicity of a carbohydrate which is soluble in dilute acid and called the C carbohydrate. Lancefield identified 13 types of C carbohydrate, designated A to 0, that could be serologically differentiated. The organisms that most commonly infect humans are found in groups A, B, D, and G. Within group B, strains can be divided into at least 9 serotypes (Ia, Ib, Ia/c, II, III, IV, V, VI, VII and VIII) based on the structure of their polysaccharide capsule. In the past, serotypes Ia, Ib, II, and III were equally prevalent in normal vaginal carriage and early onset sepsis in newborns. Type V GBS has emerged as an important cause of GBS infection in the USA, however, and strains of types VI and VIII have become prevalent among Japanese women.

The genome sequence of a serotype V strain 2603 V/R has been published (See Tettelin et al. (2002) Proc. Natl. Acad.

Sci. USA, 10.1073/pnas.182380799) and various polypeptides for use a vaccine antigens have been identified (WO 02/34771). The vaccines currently in clinical trials, however, are based primarily on polysaccharide antigens. These suffer from serotype-specificity and poor immunogenicity, and so there is a need for effective vaccines against *S. agalactiae* infection.

*S. agalactiae* is classified as a gram positive bacterium, a collection of about 21 genera of bacteria that colonize humans, have a generally spherical shape, a positive Gram stain reaction and lack endospores. Gram positive bacteria are frequent human pathogens and include *Staphylococcus* (such as *S. aureus*), *Streptococcus* (such as *S. agalactiae* (GBS), *S. pyogenes* (GAS), *S. pneumoniae, S. mutans*), *Enterococcus* (such as *E. faecalis* and *E. faecium*), *Clostridium* (such as *C. difficile*), *Listeria* (such as *L. monocytogenes*) and *Corynebacterium* (such as *C. diphtheria*).

It is an object of the invention to provide further and improved compositions for providing immunity against disease and/or infection of Gram positive bacteria. The compositions are based on the identification of adhesin islands within Streptococcal genomes and the use of amino acid sequences encoded by these islands in therapeutic or prophylactic compositions. The invention further includes compositions comprising immunogenic adhesin island proteins within other Gram positive bacteria in therapeutic or prophylactic compositions.

SUMMARY OF THE INVENTION

Applicants have identified a new adhesin island, "GBS Adhesin Island 1," "AI-1," or "GBS AI-1" within the genomes of several Group B *Streptococcus* serotypes and isolates. This adhesin island is thought to encode surface proteins which are important in the bacteria's virulence. In addition, Applicants have discovered that surface proteins within GBS Adhesin Islands form a previously unseen pilus structure on the surface of GBS bacteria Amino acid sequences encoded by such GBS Adhesin Islands may be used in immunogenic compositions for the treatment or prevention of GBS infection.

A preferred immunogenic composition of the invention comprises an AI-1 surface protein, such as GBS 80, which may be formulated or purified in an oligomeric (pilus) form. In a preferred embodiment, the oligomeric form is a hyperoligomer. Electron micrographs depicting some of the first visualizations of this pilus structure in a wild type GBS strain are shown in FIGS. 16, 17, 49, and 50. In addition, Applicants have transformed a GBS strain with a plasmid comprising the AI surface protein GBS 80 which resulted in increased production of that AI surface protein. The electron micrographs of this mutant GBS strain in FIGS. 13-15 reveal long, hyper-oligomeric structures comprising GBS 80 which appear to cover portions of the surface of the bacteria and stretch far out into the supernatant. These hyper-oligomeric pilus structures comprising a GBS AI surface protein may be purified or otherwise formulated for use in immunogenic compositions.

GBS AI-1 comprises a series of approximately five open reading frames encoding for a collection of amino acid sequences comprising surface proteins and sortases ("AI-1 proteins"). Specifically, AI-1 includes polynucleotide sequences encoding for two or more of GBS 80, GBS 104, GBS 52, SAG0647 and SAG0648. One or more of the AI-1 polynucleotide sequences may be replaced by a polynucleotide sequence coding for a fragment of the replaced ORF. Alternatively, one or more of the AI-1 open reading frames may be replaced by a sequence having sequence homology (sequence identity) to the replaced ORF.

AI-1 typically resides on an approximately 16.1 kb transposon-like element frequently inserted into the open reading frame for trmA. One or more of the AI-1 surface protein sequences typically include an LPXTG motif (such as LPXTG (SEQ ID NO:122)) or other sortase substrate motif. The AI surface proteins of the invention may affect the ability of the GBS bacteria to adhere to and invade epithelial cells. AI surface proteins may also affect the ability of GBS to translocate through an epithelial cell layer. Preferably, one or more AI surface proteins are capable of binding to or otherwise associating with an epithelial cell surface. AI surface proteins may also be able to bind to or associate with fibrinogen, fibronectin, or collagen.

The sortase proteins are thought to be involved in the secretion and anchoring of the LPXTG containing surface proteins. AI-1 may encode at least one surface protein. Alternatively, AI-1 may encode at least two surface proteins and at least one sortase. Preferably, AI-1 encodes for at least three surface proteins and at least two sortases. One or more of the surface proteins may include an LPXTG motif or other sortase substrate motif.

The GBS AI-1 protein of the composition may be selected from the group consisting of GBS 80, GBS 104, GBS 52, SAG0647 and SAG0648. GBS AI-1 surface proteins GBS 80 and GBS 104 are preferred for use in the immunogenic compositions of the invention.

In addition to the open reading frames encoding the AI-1 proteins, AI-1 may also include a divergently transcribed transcriptional regulator such as araC (i.e., the transcriptional regulator is located near or adjacent to the AI protein open reading frames, but it transcribed in the opposite direction). It is believed that araC may regulate the expression of the GBS AI operon. (See Korbel et al., Nature Biotechnology (2004) 22 (7): 911-917 for a discussion of divergently transcribed regulators in *E. coli*).

A second adhesin island, "Adhesin Island-2", "AI-2" or "GBS AI-2", has also been identified in numerous GBS serotypes. Amino acid sequences encoded by the open reading frames of AI-2 may also be used in immunogenic compositions for the treatment or prevention of GBS infection.

GBS AI-2 comprises a series of approximately five open reading frames encoding for a collection of amino acid sequences comprising surface proteins and sortases. Specifically, AI-2 includes open reading frames encoding for two or more of GBS 67, GBS 59, GBS 150, SAG1405, SAG1406, 01520, 01521, 01522, 01523, 01523, 01524 and 01525. The GBS AI-sequences may be divided into two subgroups. In one embodiment, AI-2 includes open reading frames encoding for two or more of GBS 67, GBS 59, GBS 150, SAG1405, and SAG1406. This collection of open reading frames may be generally referred to as GBS AI-2 subgroup 1. Alternatively, AI-2 may include open reading frames encoding for two or more of 01520, 01521, 01522, 01523, 01523, 01524 and 01525. This collection of open reading frames may be generally referred to as GBS AI-2 subgroup 2.

One or more of the AI-2 open reading frame polynucleotide sequences may be replaced by a polynucleotide sequence coding for a fragment of the replaced ORF. Alternatively, one or more of the AI-2 open reading frames may be replaced by a sequence having sequence homology (sequence identity) to the replaced ORF.

One or more of the AI-2 surface proteins typically include an LPXTG motif (such as LPXTG (SEQ ID NO:122)) or other sortase substrate motif. These sortase proteins are thought to be involved in the secretion and anchoring of the LPXTG containing surface proteins. AI-2 may encode for at least one surface protein. Alternatively, AI-2 may encode for at least two surface proteins and at least one sortase. Preferably, AI-2 encodes for at least three surface proteins and at least two sortases. One or more of the surface proteins may include an LPXTG motif.

The AI-2 protein of the composition may be selected from the group consisting of GBS 67, GBS 59, GBS 150, SAG1405, SAG1406, 01520, 01521, 01522, 01523, 01523, 01524 and 01525. AI-2 surface proteins GBS 67, GBS 59, and 01524 are preferred AI-2 proteins for use in the immunogenic compositions of the invention. GBS 67 or GBS 59 is particularly preferred.

GBS AI-2 may also include a divergently transcribed transcriptional regulator such as a RofA like protein (for example rogB). As in AI-1, rogB is thought to regulate the expression of the AI-2 operon.

The GBS AI proteins of the invention may be used in immunogenic compositions for prophylactic or therapeutic immunization against GBS infection. For example, the invention may include an immunogenic composition comprising one or more GBS AI-1 proteins and one or more GBS AI-2 proteins.

The immunogenic compositions may also be selected to provide protection against an increased range of GBS serotypes and strain isolates. For example, the immunogenic composition may comprise a first and second GBS AI protein, wherein a full length polynucleotide sequence encoding for the first GBS AI protein is not present in a genome comprising a full length polynucleotide sequence encoding for the second GBS AI protein. In addition, each antigen selected for use in the immunogenic compositions will preferably be present in the genomes of multiple GBS serotypes and strain isolates. Preferably, each antigen is present in the genomes of at least two (i.e., 3, 4, 5, 6, 7, 8, 9, 10, or more) GBS strain isolates. More preferably, each antigen is present in the genomes of at least two (i.e., at least 3, 4, 5 or more) GBS serotypes.

Within GBS AI-1, Applicants have found that Group B *Streptococcus* surface exposure of GBS 104 is dependent on the concurrent expression of GBS 80. It is thought that GBS 80 is involved in the transport or localization of GBS 104 to the surface of the bacteria. The two proteins may be oligomerized or otherwise chemically or physically associated. It is possible that this association involves a conformational change in GBS 104 that facilitates its transition to the surface of the GBS bacteria. In addition, one or more AI sortases may also be involved in this surface localization and chemical or physical association. Similar relationships are thought to exist within GBS AI-2. The compositions of the invention may therefore include at least two AI proteins, wherein the two AI proteins are physically or chemically associated. Preferably, the two AI proteins form an oligomer. Preferably, one or more of the AI proteins are in a hyper-oligomeric form. In one embodiment, the associated AI proteins may be purified or isolated from a GBS bacteria or recombinant host cell.

It is also an object of the invention to provide further and improved compositions for providing prophylactic or therapeutic protection against disease and/or infection of Gram positive bacteria. The compositions are based on the identification of adhesin islands within Streptococcal genomes and the use of amino acid sequences encoded by these islands in therapeutic or prophylactic compositions. The invention further includes compositions comprising immunogenic adhesin island proteins within other Gram positive bacteria in therapeutic or prophylactic compositions. Preferred Gram positive adhesin island proteins for use in the invention may be derived from *Staphylococcus* (such as *S. aureus*), *Streptococcus* (such as *S. agalactiae* (GBS), *S. pyogenes* (GAS), *S. pneumoniae, S. mutans*), *Enterococcus* (such as *E. faecalis* and *E. faecium*), *Clostridium* (such as *C. difficile*), *Listeria* (such as *L. monocytogenes*) and *Corynebacterium* (such as *C. diphtheria*). Preferably, the Gram positive adhesin island surface proteins are in oligomeric or hyperologimeric form.

For example, Applicants have identified adhesin islands within the genomes of several Group A *Streptococcus* serotypes and isolates. These adhesion islands are thought to encode surface proteins which are important in the bacteria's virulence, and Applicants have obtained the first electron micrographs revealing the presence of these adhesin island proteins in hyperoligomeric pilus structures on the surface of Group A *Streptococcus.*

Group A *Streptococcus* is a human specific pathogen which causes a wide variety of diseases ranging from pharyngitis and impetigo through life threatening invasive disease and necrotizing fasciitis. In addition, post-streptococcal autoimmune responses are still a major cause of cardiac pathology in children.

Group A Streptococcal infection of its human host can generally occur in three phases. The first phase involves attachment and/or invasion of the bacteria into host tissue and multiplication of the bacteria within the extracellular spaces. Generally this attachment phase begins in the throat or the skin. The deeper the tissue level infected, the more severe the damage that can be caused. In the second stage of infection, the bacteria secretes a soluble toxin that diffuses into the surrounding tissue or even systemically through the vasculature. This toxin binds to susceptible host cell receptors and triggers inappropriate immune responses by these host cells, resulting in pathology. Because the toxin can diffuse throughout the host, the necrosis directly caused by the GAS toxins may be physically located in sites distant from the bacterial infection. The final phase of GAS infection can occur long after the original bacteria have been cleared from the host system. At this stage, the host's previous immune response to the GAS bacteria due to cross reactivity between epitopes of a GAS surface protein, M, and host tissues, such as the heart. A general review of GAS infection can be found in Principles of Bacterial Pathogenesis, Groisman ed., Chapter 15 (2001).

In order to prevent the pathogenic effects associated with the later stages of GAS infection, an effective vaccine against GAS will preferably facilitate host elimination of the bacteria during the initial attachment and invasion stage.

Isolates of Group A *Streptococcus* are historically classified according to the M surface protein described above. The M protein is surface exposed trypsin-sensitive protein generally comprising two polypeptide chains complexed in an alpha helical formation. The carboxyl terminus is anchored in the cytoplasmic membrane and is highly conserved among all group A streptococci. The amino terminus, which extend through the cell wall to the cell surface, is responsible for the antigenic variability observed among the 80 or more serotypes of M proteins.

A second layer of classification is based on a variable, trypsin-resistant surface antigen, commonly referred to as the T-antigen. Decades of epidemiology based on M and T serological typing have been central to studies on the biological diversity and disease causing potential of Group A Streptococci. While the M-protein component and its inherent variability have been extensively characterized, even after five decades of study, there is still very little known about the structure and variability of T-antigens. Antisera to define T types is commercially available from several sources, including Sevapharma (sevapharma.cz/en).

The gene coding for one form of T-antigen, T-type 6, from an M6 strain of GAS (D741) has been cloned and characterized and maps to an approximately 11 kb highly variable pathogenicity island. Schneewind et al., J. Bacteriol. (1990) 172 (6):3310-3317. This island is known as the Fibronectin-binding, Collagen-binding T-antigen (FCT) region because it contains, in addition to the T6 coding gene (tee6), members of a family of genes coding for Extra Cellular Matrix (ECM) binding proteins. Bessen et al., Infection & Immunity (2002) 70 (3):1159-1167. Several of the protein products of this gene family have been shown to directly bind either fibronectin and/or collagen. See Hanski et al., Infection & Immunity (1992) 60 (12):5119-5125; Talay et al., Infection & Immunity (1992 (60 (9):3837-3844; Jaffe et al. (1996) 21 (2):373-384; Rocha et al., Adv Exp Med. Biol. (1997) 418:737-739; Kreikemeyer et al., J Biol Chem (2004) 279 (16):15850-15859; Podbielski et al., Mol. Microbiol. (1999) 31 (4):1051-64; and Kreikemeyer et al., Int. J. Med Microbiol (2004) 294 (2-3):177-88. In some cases direct evidence for a role of these proteins in adhesion and invasion has been obtained.

Applicants raised antiserum against a recombinant product of the tee6 gene and used it to explore the expression of T6 in M6 strain 2724. In immunoblot of mutanolysin extracts of this strain, the antiserum recognized, in addition to a band corresponding to the predicted molecular mass of the product, very high molecular weight ladders ranging in mobility from about 100 kDa to beyond the resolution of the 3-8% gradient gels used.

This pattern of high molecular weight products is similar to that observed in immunoblots of the protein components of the pili identified in *Streptococcus agalactiae* (described above) and previously in *Corynebacterium diphtheriae*. Electron microscopy of strain M6_2724 with antisera specific for the product of tee6 revealed abundant surface staining and long pilus like structures extending up to 700 nanometers from the bacterial surface, revealing that the T6 protein, one of the antigens recognized in the original Lancefield serotyping system, is located within a GAS Adhesin Island (GAS AI-1) and forms long covalently linked pilus structures.

Applicants have identified at least four different Group A *Streptococcus* Adhesin Islands. While these GAS AI sequences can be identified in numerous M types, Applicants have surprisingly discovered a correlation between the four main pilus subunits from the four different GAS AI types and specific T classifications. While other trypsin-resistant surface exposed proteins are likely also implicated in the T classification designations, the discovery of the role of the GAS adhesin islands (and the associated hyper-oligomeric pilus like structures) in T classification and GAS serotype variance has important implications for prevention and treatment of GAS infections. Applicants have identified protein components within each of the GAS adhesin islands which are associated with the pilus formation. These proteins are believed to be involved in the bacteria's initial adherence mechanisms. Immunological recognition of these proteins may allow the host immune response to slow or prevent the bacteria's transition into the more pathogenic later stages of infection.

In addition, Applicants have discovered that the GBS pili structures appear to be implicated in the formation of biofilms (populations of bacteria growing on a surface, often enclosed in an exopolysaccharide matrix). Biofilms are generally associated with bacterial resistance, as antibiotic treatments and host immune response are frequently unable to eradicate all of the bacteria components of the biofilm. Direction of a host immune response against surface proteins exposed during the first steps of bacterial attachment (i.e., before complete biofilm formation) is preferable.

The invention therefore provides for improved immunogenic compositions against GAS infection which may target GAS bacteria during their initial attachment efforts to the host epithelial cells and may provide protection against a wide range of GAS serotypes. The immunogenic compositions of the invention include GAS AI surface proteins which may be formulated in an oligomeric, or hyperoligomeric (pilus) form. The immunogenic compositions of the invention may include one or more GAS AI surface proteins. The invention also includes combinations of GAS AI surface proteins. Combinations of GAS AI surface proteins may be selected from the same adhesin island or they may be selected from different GAS adhesin islands.

Amino acid sequence encoded by such GAS Adhesin Islands may be used in immunogenic compositions for the treatment or prevention of GAS infection. Preferred immunogenic compositions of the invention comprise a GAS AI surface protein which has been formulated or purified in an oligomeric (pilus) form. In a preferred embodiment, the oligomeric form is a hyperoligomer.

GAS Adhesin Islands generally include a series of open reading frames within a GAS genome that encode for a collection of surface proteins and sortases. A GAS Adhesin Island may encode for an amino acid sequence comprising at least one surface protein. The Adhesin Island, therefore, may encode at least one surface protein. Alternatively, a GAS Adhesin Island may encode for at least two surface proteins and at least one sortase. Preferably, a GAS Adhesin Island encodes for at least three surface proteins and at least two sortases. One or more of the surface proteins may include an LPXTG motif (such as LPXTG (SEQ ID NO:122)) or other sortase substrate motif. One or more GAS AI surface proteins may participate in the formation of a pilus structure on the surface of the Gram positive bacteria.

GAS Adhesin Islands of the invention preferably include a divergently transcribed transcriptional regulator. The transcriptional regulator may regulate the expression of the GAS AI operon. Examples of transcriptional regulators found in GAS AI sequences include RofA and Nra.

The GAS AI surface proteins may bind or otherwise adhere to fibrinogen, fibronectin, or collagen. One or more of the GAS AI surface proteins may comprise a fimbrial structural subunit.

One or more of the GAS AI surface proteins may include an LPXTG motif or other sortase substrate motif. The LPXTG motif may be followed by a hydrophobic region and a charged C terminus, which are thought to retard the protein in the cell membrane to facilitate recognition by the membrane-localized sortase. See Barnett, et al., J. Bacteriology (2004) 186 (17): 5865-5875.

GAS AI sequences may be generally categorized as Type 1, Type 2, Type 3, or Type 4, depending on the number and type of sortase sequences within the island and the percentage identity of other proteins (with the exception of RofA and cpa) within the island. Schematics of the GAS adhesin islands are set forth in FIG. 51A and FIG. 162. "GAS Adhesin Island-1 or "GAS AI-1" comprises a series of approximately five open reading frames encoding for a collection of amino acid sequences comprising surface proteins and sortases ("GAS AI-1 proteins"). GAS AI-1 preferably comprises surface proteins, a srtB sortase and a rofA divergently transcribed transcriptional regulator. GAS AI-1 surface proteins may include a fibronectin binding protein, a collagen adhesion protein and a fimbrial structural subunit. The fimbrial structural subunit (also known as tee6) is thought to form the shaft portion of the pilus like structure, while the collagen adhesion protein (Cpa) is thought to act as an accessory protein facilitating the formation of the pilus structure, exposed on the surface of the bacterial capsule.

Specifically, GAS AI-1 includes polynucleotide sequences encoding for two or more of M6_Spy0157, M6_Spy0158, M6_Spy0159, M6_Spy0160, M6_Spy0161. The GAS AI-1 may also include polynucleotide sequences encoding for any one of CDC SS 410_fimbrial, ISS3650_fimbrial, DSM2071_fimbrial.

A preferred immunogenic composition of the invention comprises a GAS AI-1 surface protein which may be formulated or purified in an oligomeric (pilus) form. In a preferred embodiment, the oligomeric form is a hyperoligomer. The immunogenic composition of the invention may alternatively comprise an isolated GAS AI-1 surface protein in oligomeric (pilus) form. The oligomer or hyperoligomeric pilus structures comprising GAS AI-1 surface proteins may be purified or otherwise formulated for use in immunogenic compositions.

One or more of the GAS AI-1 polynucleotide sequences may be replaced by a polynucleotide sequence coding for a fragment of the replaced ORF. Alternatively, one or more of the GAS AI-1 open reading frames may be replaced by a sequence having sequence homology (sequence identity) to the replaced ORF.

One or more of the GAS AI-1 surface proteins typically include an LPXTG motif (such as LPXTG (SEQ ID NO:122)) or other sortase substrate motif. These sortase proteins are thought to be involved in the secretion and anchoring of the LPXTG containing surface proteins. GAS AI-1 may encode for at least one surface protein. Alternatively, GAS AI-1 may encode for at least two surface proteins and at least one sortase. Preferably, GAS AI-1 encodes for at least three surface proteins and at least two sortases. One or more of the surface proteins may include an LPXTG motif.

GAS AI-1 preferably includes a srtB sortase. GAS srtB sortases may preferably anchor surface proteins with an LPSTG motif (SEQ ID NO:166), particularly where the motif is followed by a serine.

The GAS AI-1 protein of the composition may be selected from the group consisting of M6_Spy0157, M6_Spy0158, M6_Spy0159, M6_Spy0160 M6_Spy0161, CDC SS 410_fimbrial, ISS3650_fimbrial, and DSM2071_fimbrial. GAS AI-1 surface proteins M6_Spy0157 (a fibronectin binding protein), M6_Spy0159 (a collagen adhesion protein, Cpa), M6_Spy0160 (a fimbrial structural subunit, tee6), CDC SS 410_fimbrial (a fimbrial structural subunit), ISS3650_fimbrial (a fimbrial structural subunit), and DSM2071_fimbrial (a fimbrial structural subunit) are preferred GAS AI-1 proteins for use in the immunogenic compositions of the invention. The fimbrial structural subunit tee6 and the collagen adhesion protein Cpa are preferred GAS AI-1 surface proteins. Preferably, each of these GAS AI-1 surface proteins includes an LPXTG sortase substrate motif, such as LPXTG (SEQ ID NO:122) or LPXSG (SEQ ID NO:134) (conservative replacement of threonine with serine).

In addition to the open reading frames encoding the GAS AI-1 proteins, GAS AI-1 may also include a divergently transcribed transcriptional regulator such as rofA (i.e., the transcriptional regulator is located near or adjacent to the GAS AI protein open reading frames, but it transcribed in the opposite direction).

The GAS AI-1 surface proteins may be used alone, in combination with other GAS AI-1 surface proteins or in combination with other GAS AI surface proteins. Preferably, the immunogenic compositions of the invention include the GAS AI-1 fimbrial structural subunit (tee6) and the GAS AI-1 collagen binding protein. Still more preferably, the immunogenic compositions of the invention include the GAS AI-1 fimbrial structural subunit (tee6).

A second GAS adhesion island, "GAS Adhesin Island-2" or "GAS AI-2," has also been identified in GAS serotypes Amino acid sequences encoded by the open reading frames of GAS AI-2 may also be used in immunogenic compositions for the treatment or prevention of GAS infection.

A preferred immunogenic composition of the invention comprises a GAS AI-2 surface protein which may be formulated or purified in an oligomeric (pilus) form. In a preferred embodiment, the oligomeric form is a hyperoligomer. A preferred immunogenic composition of the invention alternatively comprises an isolated GAS AI-2 surface protein in oligomeric (pilus) form. The oligomer or hyperoligomeric pilus structures comprising GAS AI-2 surface proteins may be purified or otherwise formulated for use in immunogenic compositions.

GAS AI-2 comprises a series of approximately eight open reading frames encoding for a collection of amino acid sequences comprising surface proteins and sortases ("GAS AI-2 proteins"). GAS AI-2 preferably comprises surface proteins, a srtB sortase, a srtC1 sortase and a rofA divergently transcribed transcriptional regulator.

Specifically, GAS AI-2 includes polynucleotide sequences encoding for two or more of GAS15, Spy0127, GAS16, GAS17, GAS18, Spy0131, Spy0133, and GAS20.

One or more of the GAS AI-2 polynucleotide sequences may be replaced by a polynucleotide sequence coding for a fragment of the replaced ORF. Alternatively, one or more of the GAS AI-2 open reading frames may be replaced by a sequence having sequence homology (sequence identity) to the replaced ORF.

One or more of the GAS AI-2 surface proteins typically include an LPXTG motif (such as LPXTG (SEQ ID NO:122)) or other sortase substrate motif. These sortase proteins are thought to be involved in the secretion and anchoring of the LPXTG containing surface proteins. GAS AI-2 may encode for at least one surface protein. Alternatively, GAS AI-2 may encode for at least two surface proteins and at least one sortase. Preferably, GAS AI-2 encodes for at least three surface proteins and at least two sortases. One or more of the surface proteins may include an LPXTG motif.

GAS AI-2 preferably includes a srtB sortase and a srtC1 sortase. As discussed above, GAS srtB sortases may preferably anchor surface proteins with an LPSTG motif (SEQ ID NO:166), particularly where the motif is followed by a serine. GAS srtC1 sortase may preferentially anchor surface proteins with a V(P/V)PTG (SEQ ID NO:167) motif. GAS srtC1 may be differentially regulated by rofA.

The GAS AI-2 protein of the composition may be selected from the group consisting of GAS15, Spy0127, GAS16, GAS17, GAS18, Spy0131, Spy0133, and GAS20. GAS AI-2 surface proteins GAS15 (Cpa), GAS16 (thought to be a fimbrial protein, M1__128), GAS18 (M1_Spy0130), and GAS20 are preferred for use in the immunogenic compositions of the invention. GAS16 is thought to form the shaft portion of the pilus like structure, while GAS 15 (the collagen adhesion protein Cpa) and GAS 18 are thought to act as accessory proteins facilitating the formation of the pilus structure, exposed on the surface of the bacterial capsule. Preferably, each of these GAS AI-2 surface proteins includes an LPXTG sortase substrate motif, such as LPXTG (SEQ ID NO:122), VVXTG (SEQ ID NO:135), or EVXTG (SEQ ID NO:136).

In addition to the open reading frames encoding the GAS AI-2 proteins, GAS AI-2 may also include a divergently transcribed transcriptional regulator such as rofA (i.e., the transcriptional regulator is located near or adjacent to the GAS AI protein open reading frames, but it transcribed in the opposite direction). The GAS AI-2 surface proteins may be used alone, in combination with other GAS AI-2 surface proteins or in combination with other GAS AI surface proteins. Preferably, the immunogenic compositions of the invention include the GAS AI-2 fimbrial protein (GAS 16), the GAS AI-2 collagen binding protein (GAS 15) and GAS 18 (M1_Spy0130). More preferably, the immunogenic compositions of the invention include the GAS AI-2 fimbrial protein (GAS 16).

A third GAS adhesion island, "GAS Adhesin Island-3" or "GAS AI-3," has also been identified in numerous GAS serotypes Amino acid sequences encoded by the open reading frames of GAS AI-3 may also be used in immunogenic compositions for the treatment or prevention of GAS infection.

A preferred immunogenic composition of the invention comprises a GAS AI-3 surface protein which may be formulated or purified in an oligomeric (pilus) form. In a preferred embodiment, the oligomeric form is a hyperoligomer. A preferred immunogenic composition of the invention alternatively comprises an isolated GAS AI-3 surface protein in oligomeric (pilus) form. The oligomer or hyperoligomeric pilus structures comprising GAS AI-3 surface proteins may be purified or otherwise formulated for use in immunogenic compositions. GAS AI-3 comprises a series of approximately seven open reading frames encoding for a collection of amino acid sequences comprising surface proteins and sortases ("GAS AI-3 proteins"). GAS AI-3 preferably comprises surface proteins, a srtC2 sortase, and a Negative transcriptional regulator (Nra) divergently transcribed transcriptional regulator. GAS AI-3 surface proteins may include a collagen binding protein, a fimbrial protein, and a F2 like fibronectin-binding protein. GAS AI-3 surface proteins may also include a hypothetical surface protein. The fimbrial protein is thought to form the shaft portion of the pilus like structure, while the collagen adhesion protein (Cpa) and the hypothetical surface protein are thought to act as accessory proteins facilitating the formation of the pilus structure, exposed on the surface of the bacterial capsule. Preferred AI-3 surface proteins include the fimbrial protein, the collagen binding protein and the hypothetical protein. Preferably, each of these GAS AI-3 surface proteins include an LPXTG sortase substrate motif, such as LPXTG (SEQ ID NO:122), VPXTG (SEQ ID NO:137), QVXTG (SEQ ID NO:138) or LPXAG (SEQ ID NO:139).

Specifically, GAS AI-3 includes polynucleotide sequences encoding for two or more of SpyM3__0098, SpyM3__0099, SpyM3__0100, SpyM3__0101, SpyM3__0102, SpyM3__0103, SpyM3__0104, Sps0100, Sps0101, Sps0102, Sps0103, Sps0104, Sps0105, Sps0106, orf78, orf79, orf80, orf81, orf82, orf83, orf84, spyM18__0126, spyM18__0127, spyM18__0128, spyM18__0129, spyM18__0130, spyM18__0131, spyM18__0132, SpyoM0100156, SpyoM0100155, SpyoM0100154, SpyoM01000153, SpyoM01000152, SpyoM01000151, SpyoM01000150, SpyoM01000149, ISS3040_fimbrial, ISS3776_fimbrial, and ISS4959_fimbrial. In one embodiment, GAS AI-3 may include open reading frames encoding for two or more of SpyM3__0098, SpyM3__0099, SpyM3__0100, SpyM3__0101, SpyM3__0102, SpyM3__0103, and SpyM3__0104. Alternatively, GAS AI-3 may include open reading frames encoding for two or more of Sps0100, Sps0101, Sps0102, Sps0103, Sps0104, Sps0105, and Sps0106. Alternatively, GAS AI-3 may include open reading frames encoding for two or more of orf78, orf79, orf80, orf81, orf82, orf83, and orf84. Alternatively, GAS AI-3 may include open reading frames encoding for two or more of spyM18__0126, spyM18__0127, spyM18__0128, spyM18__0129, spyM18__0130, spyM18__0131, and spyM18__0132.

Alternatively, GAS AI-3 may include open reading frames encoding for two or more of SpyoM01000156, SpyoM01000155, SpyoM01000154, SpyoM01000153, SpyoM01000152, SpyoM01000151, SpyoM01000150, and SpyoM01000149. Alternatively, GAS AI-1 may also include polynucleotide sequences encoding for any one of ISS3040_fimbrial, ISS3776_fimbrial, and ISS4959_fimbrial.

One or more of the GAS AI-3 polynucleotide sequences may be replaced by a polynucleotide sequence coding for a fragment of the replaced ORF. Alternatively, one or more of the GAS AI-3 open reading frames may be replaced by a sequence having sequence homology (sequence identity) to the replaced ORF.

One or more of the GAS AI-3 surface proteins typically include an LPXTG motif (such as LPXTG (SEQ ID NO:122)) or other sortase substrate motif. These sortase proteins are thought to be involved in the secretion and anchoring of the LPXTG containing surface proteins. GAS AI-3 may encode for at least one surface protein. Alternatively, GAS AI-3 may encode for at least two surface proteins and at least one sortase. Preferably, GAS AI-3 encodes for at least three surface proteins and at least two sortases. One or more of the surface proteins may include an LPXTG motif.

GAS AI-3 preferably includes a srtC2 type sortase. GAS srtC2 type sortases may preferably anchor surface proteins with a QVPTG (SEQ ID NO:140) motif, particularly when the motif is followed by a hydrophobic region and a charged C terminus tail. GAS SrtC2 may be differentially regulated by Nra.

The GAS AI-3 protein of the composition may be selected from the group consisting of SpyM3__0098, SpyM3__0099, SpyM3__0100, SpyM3__0101, SpyM3__0102, SpyM3__0103, SpyM3__0104, Sps0100, Sps0101, Sps0102, Sps0103, Sps0104, Sps0105, Sps0106, orf78, orf79, orf80, orf81, orf82, orf83, orf84, spyM18__0126, spyM18__0127, spyM18__0128, spyM18__0129, spyM18__0130, spyM18__0131, spyM18__0132, SpyoM01000156, SpyoM01000155, SpyoM01000154, SpyoM01000153, SpyoM01000152, SpyoM01000151, SpyoM01000150, SpyoM01000149, ISS3040_fimbrial, ISS3776_fimbrial, and ISS4959_fimbrial. GAS AI-3 surface proteins SpyM3__0098, SpyM3__0100, SpyM3__0102, SpyM3__0104, SPs0100, SPs0102, SPs0104, SPs0106, orf78, orf80, orf82, orf84, spyM18__0126, spyM18__0128, spyM18__0130, spyM18__0132, SpyoM01000155, SpyoM01000153, SpyoM01000151, SpyoM01000149, ISS3040_fimbrial, ISS3776_fimbrial, and ISS4959_fimbrial are preferred GAS AI-3 proteins for use in the immunogenic compositions of the invention.

In addition to the open reading frames encoding the GAS AI-3 proteins, GAS AI-3 may also include a transcriptional regulator such as Nra.

GAS AI-3 may also include a LepA putative signal peptidase I protein.

The GAS AI-3 surface proteins may be used alone, in combination with other GAS AI-3 surface proteins or in combination with other GAS AI surface proteins. Preferably, the immunogenic compositions of the invention include the GAS AI-3 fimbrial protein, the GAS AI-3 collagen binding protein, the GAS AI-3 surface protein (such as SpyM3__0102, M3_Sps0104, M5_orf82, or spyM18__0130), and fibronectin binding protein PrtF2. More preferably, the immunogenic compositions of the invention include the GAS AI-3 fimbrial protein, the GAS AI-3 collagen binding protein, and the GAS AI-3 surface protein. Still more preferably, the immunogenic compositions of the invention include the GAS AI-3 fimbrial protein.

Representative examples of the GAS AI-3 fimbrial protein include SpyM3__0100, M3_Sps0102, M5_orf80, spyM18__128, SpyoM01000153, ISS3040_fimbrial, ISS3776_fimbrial, ISS4959_fimbrial.

Representative examples of the GAS AI-3 collagen binding protein include SpyM3__0098, M3_Sps0100, M5_orf 78, spyM18__0126, and SpyoM01000155.

Representative examples of the GAS AI-3 fibronectin binding protein PrtF2 include SpyM3__0104, M3_Sps0106, M5_orf84 and spyM18__0132, and SpyoM01000149.

A fourth GAS adhesion island, "GAS Adhesin Island-4" or "GAS AI-4," has also been identified in GAS serotypes Amino acid sequences encoded by the open reading frames of GAS AI-4 may also be used in immunogenic compositions for the treatment or prevention of GAS infection.

A preferred immunogenic composition of the invention comprises a GAS AI-4 surface protein which may be formulated or purified in an oligomeric (pilus) form. In a preferred embodiment, the oligomeric form is a hyperoligomer. A preferred immunogenic composition of the invention alternatively comprises an isolated GAS AI-4 surface protein in oligomeric (pilus) form. The oligomer or hyperoligomeric pilus structures comprising GAS AI-3 surface proteins may be purified or otherwise formulated for use in immunogenic compositions. The oligomeric or hyperoligomeric pilus structures comprising GAS AI-4 surface proteins may be purified or otherwise formulated for use in immunogenic compositions.

GAS AI-4 comprises a series of approximately eight open reading frames encoding for a collection of amino acid sequences comprising surface proteins and sortases ("GAS AI-4 proteins"). This GAS adhesin island 4 ("GAS AI-4") comprises surface proteins, a srtC2 sortase, and a RofA regulatory protein. GAS AI-4 surface proteins within may include a fimbrial protein, F1 and F2 like fibronectin-binding proteins, and a capsular polysaccharide adhesion protein (Cpa). GAS AI-4 surface proteins may also include a hypothetical surface protein in an open reading frame (orf).

The fimbrial protein (EftLSL) is thought to form the shaft portion of the pilus like structure, while the collagen adhesion protein (Cpa) and the hypothetical protein are thought to act as accessory proteins facilitating the formation of the pilus structure, exposed on the surface of the bacterial capsule. Preferably, each of these GAS AI-4 surface proteins include an LPXTG sortase substrate motif, such as LPXTG (SEQ ID NO:122), VPXTG (SEQ ID NO:137), QVXTG (SEQ ID NO:138) or LPXAG (SEQ ID NO:139).

Specifically, GAS AI-4 includes polynucleotide sequences encoding for two or more of 19224134, 19224135, 19224136, 19224137, 19224138, 19224139, 19224140, and 19224141. A GAS AI-4 polynucleotide may also include polynucleotide sequences encoding for any one of 20010296_fimbrial, 20020069_fimbrial, CDC SS 635_fimbrial, ISS4883_fimbrial, ISS4538_fimbrial. One or more of the GAS AI-4 polynucleotide sequences may be replaced by a polynucleotide sequence coding for a fragment of the replaced ORF. Alternatively, one or more of the GAS AI-4 open reading frames may be replaced by a sequence having sequence homology (sequence identity) to the replaced ORF.

One or more of the GAS AI-4 surface proteins typically include an LPXTG motif (such as LPXTG (SEQ ID NO:122)) or other sortase substrate motif. These sortase proteins are thought to be involved in the secretion and anchoring of the LPXTG containing surface proteins. GAS AI-4 may encode for at least one surface protein. Alternatively, GAS AI-4 may encode for at least two surface proteins and at least one sortase. Preferably, GAS AI-4 encodes for at least three surface proteins and at least two sortases. One or more of the surface proteins may include an LPXTG motif.

GAS AI-4 includes a SrtC2 type sortase. GAS SrtC2 type sortases may preferably anchor surface proteins with a QVPTG (SEQ ID NO:140) motif, particularly when the motif is followed by a hydrophobic region and a charged C terminus tail.

The GAS AI-4 protein of the composition may be selected from the group consisting of 19224134, 19224135, 19224136, 19224137, 19224138, 19224139, 19224140, 19224141, 20010296_fimbrial, 20020069_fimbrial, CDC SS 635_fimbrial, ISS4883_fimbrial, and ISS4538_fimbrial. GAS AI-4 surface proteins 19224134, 19224135, 19224137, 19224139, 19224141, 20010296_fimbrial, 20020069_fimbrial, CDC SS 635_fimbrial, ISS4883_fimbrial, ISS4538_fimbrial are preferred proteins for use in the immunogenic compositions of the invention.

In addition to the open reading frames encoding the GAS AI-4 proteins, GAS AI-4 may also include a divergently transcribed transcriptional regulator such as RofA (i.e., the transcriptional regulator is located near or adjacent to the AI protein open reading frames, but it transcribed in the opposite direction.

GAS AI-4 may also include a LepA putative signal peptidase I protein and a MsmRL protein. The GAS AI-4 surface proteins may be used alone, in combination with other GAS AI-4 surface proteins or in combination with other GAS AI surface proteins. Preferably, the immunogenic compositions of the invention include the GAS AI-4 fimbrial protein (EftLSL or 20010296_fimbrial, 20020069_fimbrial, CDC SS 635_fimbrial, ISS4883_fimbrial, or ISS4538_fimbrial), the GAS AI-4 collagen binding protein, the GAS AI-4 surface protein (such as M12 isolate A735 orf 2), and fibronectin binding protein PrtF1 and PrtF2. More preferably, the immunogenic compositions of the invention include the GAS AI-4 fimbrial protein, the GAS AI-4 collagen binding protein, and the GAS AI-4 surface protein. Still more preferably, the immunogenic compositions of the invention include the GAS AI-4 fimbrial protein.

The GAS AI proteins of the invention may be used in immunogenic compositions for prophylactic or therapeutic immunization against GAS infection. For example, the invention may include an immunogenic composition comprising one or more GAS AI-1 proteins and one or more of any of GAS AI-2, GAS AI-3, or GAS AI-4 proteins. For example, the invention includes an immunogenic composition comprising at least two GAS AI proteins where each protein is selected from a different GAS adhesin island. The two GAS AI proteins may be selected from one of the following GAS AI combinations: GAS AI-1 and GAS AI-2; GAS AI-1 and GAS AI-3; GAS AI-1 and GAS AI-4; GAS AI-2 and GAS AI-3; GAS AI-2 and GAS AI-4; and GAS AI 3 and GAS AI-4. Preferably the combination includes fimbrial proteins from one or more GAS adhesin islands.

The immunogenic compositions may also be selected to provide protection against an increased range of GAS serotypes and strain isolates. For example, the immunogenic composition may comprise a first and second GAS AI protein, wherein a full length polynucleotide sequence encoding for the first GAS AI protein is not present in a genome comprising a full length polynucleotide sequence encoding for the second GAS AI protein. In addition, each antigen selected for use in the immunogenic compositions will preferably be present in the genomes of multiple GAS serotypes and strain isolates. Preferably, each antigen is present in the genomes of at least two (i.e., 3, 4, 5, 6, 7, 8, 9, 10, or more) GAS strain isolates. More preferably, each antigen is present in the genomes of at least two (i.e., at least 3, 4, 5, or more) GAS serotypes.

Applicants have also identified adhesin islands within the genome of *Streptococcus pneumoniae*. These adhesion islands are thought to encode surface proteins which are important in the bacteria's virulence. Amino acid sequence encoded by such *S. pneumoniae* Adhesin Islands may be used in immunogenic compositions for the treatment or prevention of *S. pneumoniae* infection. Preferred immunogenic compositions of the invention comprise a *S. pneumoniae* AI surface protein which has been formulated or purified in an oligomeric (pilus) form. In a preferred embodiment, the oligomeric form is a hyperoligomer. A preferred immunogenic composition of the invention alternatively comprises an isolated *S. pneumoniae* surface protein in oligomeric (pilus) form. The oligomer or hyperoligomeric pilus structures comprising *S. pneumoniae* surface proteins may be purified or otherwise formulated for use in immunogenic compositions.

The *S. pneumoniae* Adhesin Islands generally include a series of open reading frames within a *S. pneumoniae* genome that encode for a collection of surface proteins and sortases. A *S. pneumoniae* Adhesin Island may encode for an amino acid sequence comprising at least one surface protein. Alternatively, the *S. pneumoniae* Adhesin Island may encode for at least two surface proteins and at least one sortase. Preferably, a *S. pneumoniae* Adhesin Island encodes for at least three surface proteins and at least two sortases. One or more of the surface proteins may include an LPTXG motif (such as LPXTG (SEQ ID NO:122)) or other sortase substrate motif. One or more *S. pneumoniae* AI surface proteins may participate in the formation of a pilus structure on the surface of the *S. pneumoniae* bacteria.

The *S. pneumoniae* Adhesin Islands of the invention preferably include a divergently transcribed transcriptional regulator. The transcriptional regulator may regulate the expression of the *S. pneumoniae* AI operon. An example of a transcriptional regulator found in *S. pneumoniae* AI sequences is rlrA.

A schematic of the organization of a *S. pneumoniae* AI locus is provided in FIG. 137. The locus comprises open reading frames encoding a transcriptional regulator (rlrA), cell wall surface proteins (rrgA, rrgB, rrgc) and sortases (srt B, srtC, srtD).

*S. pneumoniae* AI sequences may be generally divided into two groups of homology, *S. pneumoniae* AI-a and AI-b. *S. pneumoniae* strains that comprise AI-a include 14 CSR 10, 19A Hungary 6, 23 F Poland 15, 670, 6B Finland 12, and 6B Spain 2. *S. pneumoniae* AI strains that comprise AI-b include 19F Taiwan 14, 9V Spain 3, 23F Taiwan 15 and TIGR 4.

*S. pneumoniae* AI from TIGR4 comprises a series of approximately seven open reading frames encoding for a collection of amino acid sequences comprising surface proteins and sortases ("*S. pneumoniae* AI proteins"). Specifically, *S. pneumoniae* AI from TIGR4 includes polynucleotide sequences encoding for two or more of SP0462, SP0463, SP0464, SP0465, SP0466, SP0467, and SP0468.

One or more of the *S. pneumoniae* AI from TIGR4 polynucleotide sequences may be replaced by a polynucleotide sequence coding for a fragment of the replaced ORF. Alternatively, one or more of the *S. pneumoniae* AI from TIGR4 open reading frames may be replaced by a sequence having sequence homology to the replaced ORF.

*S. pneumoniae* strain 670 AI comprises a series of approximately seven open reading frames encoding for a collection of amino acid sequences comprising surface proteins and sortases ("*S. pneumoniae* AI proteins"). Specifically, *S. pneumoniae* strain 670 AI includes polynucleotide sequences encoding for two or more of orf1__670, orf3__670, orf4__670, orf5__670, orf6__670, orf7__670, and orf8__670.

One or more of the *S. pneumoniae* strain 670 AI polynucleotide sequences may be replaced by a polynucleotide sequence coding for a fragment of the replaced ORF. Alternatively, one or more of the *S. pneumoniae* strain 670 AI open reading frames may be replaced by a sequence having sequence homology to the replaced ORF.

*S. pneumoniae* AI from 14 CSR10 comprises a series of approximately seven open reading frames encoding for a collection of amino acid sequences comprising surface proteins and sortases ("*S. pneumoniae* AI proteins"). Specifically, *S. pneumoniae* AI from 14 CSR10 includes polynucleotide sequences encoding for two or more of ORF2__14CSR, ORF3__14CSR, ORF4__14CSR, ORF5__14CSR, ORF6__14CSR, ORF7__14CSR, and ORF8__14CSR.

One or more of the *S. pneumoniae* AI from 14 CSR10 polynucleotide sequences may be replaced by a polynucleotide sequence coding for a fragment of the replaced ORF. Alternatively, one or more of the *S. pneumoniae* AI from 14 CSR10 open reading frames may be replaced by a sequence having sequence homology to the replaced ORF.

*S. pneumoniae* AI from 19A Hungary 6 comprises a series of approximately seven open reading frames encoding for a collection of amino acid sequences comprising surface proteins and sortases ("*S. pneumoniae* AI proteins"). Specifically, *S. pneumoniae* AI from 19A Hungary 6 includes polynucleotide sequences encoding for two or more of ORF2__19AH, ORF3__1gAH, ORF4__19AH, ORF5__19AH, ORF6__19AH, ORF7__19AH, and ORF8__19AH.

One or more of the *S. pneumoniae* AI from 19A Hungary 6 polynucleotide sequences may be replaced by a polynucleotide sequence coding for a fragment of the replaced ORF. Alternatively, one or more of the *S. pneumoniae* AI from 19A Hungary 6 open reading frames may be replaced by a sequence having sequence homology to the replaced ORF.

*S. pneumoniae* AI from 19F Taiwan 14 comprises a series of approximately seven open reading frames encoding for a collection of amino acid sequences comprising surface proteins and sortases ("*S. pneumoniae* AI proteins"). Specifically, *S. pneumoniae* AI from 19F Taiwan 14 includes polynucleotide sequences encoding for two or more of ORF2__19FTW, ORF3__19FTW, ORF4__19FTW, ORF5__19FTW, ORF6__19FTW, ORF7__19FTW, and ORF8__19FTW.

One or more of the *S. pneumoniae* AI from 19F Taiwan 14 polynucleotide sequences may be replaced by a polynucleotide sequence coding for a fragment of the replaced ORF. Alternatively, one or more of the *S. pneumoniae* AI from 19F Taiwan 14 open reading frames may be replaced by a sequence having sequence homology to the replaced ORF.

*S. pneumoniae* AI from 23F Poland 16 comprises a series of approximately seven open reading frames encoding for a collection of amino acid sequences comprising surface proteins and sortases ("*S. pneumoniae* AI proteins"). Specifically, *S. pneumoniae* AI from 23F Poland 16 includes polynucleotide sequences encoding for two or more of ORF2__23FP, ORF3__23FP, ORF4__23FP, ORF5__23FP, ORF6__23FP, ORF7__23FP, and ORF8__23FP.

One or more of the *S. pneumoniae* AI from 23F Poland 16 polynucleotide sequences may be replaced by a polynucleotide sequence coding for a fragment of the replaced ORF. Alternatively, one or more of the *S. pneumoniae* AI from 23F Poland 16 open reading frames may be replaced by a sequence having sequence homology to the replaced ORF.

*S. pneumoniae* AI from 23F Taiwan 15 comprises a series of approximately seven open reading frames encoding for a collection of amino acid sequences comprising surface proteins and sortases ("*S. pneumoniae* AI proteins"). Specifically, *S. pneumoniae* AI from 23F Taiwan 15 includes polynucleotide sequences encoding for two or more of ORF2__23FTW, ORF3__23FTW, ORF4__23FTW, ORF5__23FTW, ORF6__23FTW, ORF7__23FTW, and ORF8__23FTW.

One or more of the *S. pneumoniae* AI from 23F Taiwan 15 polynucleotide sequences may be replaced by a polynucleotide sequence coding for a fragment of the replaced ORF. Alternatively, one or more of the *S. pneumoniae* AI from 23F Taiwan 15 open reading frames may be replaced by a sequence having sequence homology to the replaced ORF.

*S. pneumoniae* AI from 6B Finland 12 comprises a series of approximately seven open reading frames encoding for a collection of amino acid sequences comprising surface proteins and sortases ("*S. pneumoniae* AI proteins"). Specifically, *S. pneumoniae* AI from 6B Finland 12 includes polynucleotide sequences encoding for two or more of ORF2__6BF, ORF3__6BF, ORF4__6BF, ORF5__6BF, ORF6__6BF, ORF7__6BF, and ORF8__6BF.

One or more of the *S. pneumoniae* AI from 6B Finland 12 polynucleotide sequences may be replaced by a polynucleotide sequence coding for a fragment of the replaced ORF. Alternatively, one or more of the *S. pneumoniae* AI from 6B Finland 12 open reading frames may be replaced by a sequence having sequence homology to the replaced ORF.

*S. pneumoniae* AI from 6B Spain 2 comprises a series of approximately seven open reading frames encoding for a collection of amino acid sequences comprising surface proteins and sortases ("*S. pneumoniae* AI proteins"). Specifically, *S. pneumoniae* AI from 6B Spain 2 includes polynucleotide sequences encoding for two or more of ORF2__6BSP, ORF3__6BSP, ORF4__6BSP, ORF5__6BSP, ORF6__6BSP, ORF7__6BSP, and ORF8__6BSP.

One or more of the *S. pneumoniae* AI from 6B Spain 2 polynucleotide sequences may be replaced by a polynucleotide sequence coding for a fragment of the replaced ORF. Alternatively, one or more of the *S. pneumoniae* AI from 6B Spain 2 open reading frames may be replaced by a sequence having sequence homology to the replaced ORF.

*S. pneumoniae* AI from 9V Spain 3 comprises a series of approximately seven open reading frames encoding for a collection of amino acid sequences comprising surface proteins and sortases ("*S. pneumoniae* AI proteins"). Specifically, *S. pneumoniae* AI from 9V Spain 3 includes polynucleotide sequences encoding for two or more of ORF2__9VSP, ORF3__9VSP, ORF4__9VSP, ORF5__9VSP, ORF6__9VSP, ORF7__9VSP, and ORF8__9VSP.

One or more of the *S. pneumoniae* AI from 9V Spain 3 polynucleotide sequences may be replaced by a polynucleotide sequence coding for a fragment of the replaced ORF. Alternatively, one or more of the *S. pneumoniae* AI from 9V Spain 3 open reading frames may be replaced by a sequence having sequence homology to the replaced ORF.

One or more of the *S. pneumoniae* AI surface proteins typically include an LPXTG motif (such as LPXTG (SEQ ID NO:122)) or other sortase substrate motif. These sortase proteins are thought to be involved in the secretion and anchoring of the LPXTG containing surface proteins. *S. pneumoniae* AI may encode for at least one surface protein. The Adhesin Island, may encode at least one surface protein. Alternatively, *S. pneumoniae* AI may encode for at least two surface proteins and at least one sortase. Preferably, *S. pneumoniae* AI encodes for at least three surface proteins and at least two sortases. One or more of the surface proteins may include an LPXTG motif.

The *S. pneumoniae* AI protein of the composition may be selected from the group consisting of SP0462, SP0463, SP0464, SP0465, SP0466, SP0467, SP0468, orf1_670, orf5_670, orf4_670, orf5_670, orf6_670, orf7_670, orf8_670, ORF2_14CSR, ORF3_14CSR, ORF4_14CSR, ORF5_14CSR, ORF6_14CSR, ORF7_14CSR, ORF8_14CSR, ORF2_19AH, ORF3_19AH, ORF4_19AH, ORF5_19AH, ORF6_19AH, ORF7_19AH, ORF8_19AH, ORF2_19FTW, ORF3_19FTW, ORF4_19FTW, ORF5_19FTW, ORF6_19FTW, ORF7_19FTW, ORF8_19FTW, ORF2_23FP, ORF3_23FP, ORF4_23FP, ORF5_23FP, ORF6_23FP, ORF7_23FP, ORF8_23FP, ORF2_23FTW, ORF3_23FTW, ORF4_23FTW, ORF5_23FTW, ORF6_23FTW, ORF7_23FTW, ORF5_23FTW, ORF2_6BF, ORF3_6BF, ORF4_6BF, ORF5_6BF, ORF6_6BF, ORF7_6BF, ORF8_6BF, ORF2_6BSP, ORF3_6BSP, ORF4_6BSP, ORF5_6BSP, ORF6_6BSP, ORF7_6BSP, ORF8_6BSP, ORF2_9VSP, ORF3_9VSP, ORF4_9VSP, ORF5_9VSP, ORF6_9VSP, ORF7_9VSP and, ORF8_9VSP.

*S. pneumoniae* AI surface proteins are preferred proteins for use in the immunogenic compositions of the invention. In one embodiment, the compositions of the invention comprise combinations of two or more *S. pneumoniae* AI surface proteins. Preferably such combinations are selected from two or more of the group consisting of SP0462, SP0463, SP0464, orf3_670, orf4_670, orf5_670, ORF314CSR, ORF4_14CSR, ORF5_14CSR, ORF3_19AH, ORF4_19AH, ORF5_19AH, ORF3_19FTW, ORF4_19FTW, ORF5_1gFTW, ORF3_23FP, ORF4_23FP, ORF5_23FP, ORF3_23FTW, ORF4_23FTW, ORF5_23FTW, ORF3_6BF, ORF4_6BF, ORF5_6BF, ORF3_6BSP, ORF4_6BSP, ORF5_6BSP, ORF3_9VSP, ORF4_9VSP, and ORF5_9VSP.

In addition to the open reading frames encoding the *S. pneumoniae* AI proteins, *S. pneumoniae* AI may also include a transcriptional regulator.

The *S. pneumoniae* AI proteins of the invention may be used in immunogenic compositions for prophylactic or therapeutic immunization against *S. pneumoniae* infection. For example, the invention may include an immunogenic composition comprising one or more *S. pneumoniae* from TIGR4 AI proteins and one or more *S. pneumoniae* strain 670 proteins. The immunogenic composition may comprise one or more AI proteins from any one or more of *S. pneumoniae* strains TIGR4, 19A Hungary 6, 6B Finland 12, 6B Spain 2, 9V Spain 3, 14 CSR 10, 19F Taiwan 14, 23F Taiwan 15, 23F Poland 16, and 670.

The immunogenic compositions may also be selected to provide protection against an increased range of *S. pneumoniae* serotypes and strain isolates. For example, the immunogenic composition may comprise a first and second *S. pneumoniae* AI protein, wherein a full length polynucleotide sequence encoding for the first *S. pneumoniae* AI protein is not present in a genome comprising a full length polynucleotide sequence encoding for the second *S. pneumoniae* AI protein. In addition, each antigen selected for use in the immunogenic compositions will preferably be present in the genomes of multiple *S. pneumoniae* serotypes and strain isolates. Preferably, each antigen is present in the genomes of at least two (i.e., 3, 4, 5, 6, 7, 8, 9, 10, or more) *S. pneumoniae* strain isolates. More preferably, each antigen is present in the genomes of at least two (i.e., at least 3, 4, 5, or more) *S. pneumoniae* serotypes.

The immunogenic compositions may also be selected to provide protection against an increased range of serotypes and strain isolates of a Gram positive bacteria. For example, the immunogenic composition may comprise a first and second Gram positive bacteria AI protein, wherein a full length polynucleotide sequence encoding for the first Gram positive bacteria AI protein is not present in a genome comprising a full length polynucleotide sequence encoding for the second Gram positive bacteria AI protein. In addition, each antigen selected for use in the immunogenic compositions will preferably be present in the genomes of multiple serotypes and strain isolates of the Gram positive bacteria. Preferably, each antigen is present in the genomes of at least two (i.e., 3, 4, 5, 6, 7, 8, 9, 10, or more) Gram positive bacteria strain isolates. More preferably, each antigen is present in the genomes of at least two (i.e., at least 3, 4, 5, or more) Gram positive bacteria serotypes. One or both of the first and second AI proteins may preferably be in oligomeric or hyperoligomeric form.

Adhesin island surface proteins from two or more Gram positive bacterial genus or species may be combined to provide an immunogenic composition for prophylactic or therapeutic treatment of disease or infection of two more Gram positive bacterial genus or species. Optionally, the adhesin island surface proteins may be associated together in an oligomeric or hyperoligomeric structure.

In one embodiment, the invention comprises adhesin island surface proteins from two or more *Streptococcus* species. For example, the invention includes a composition comprising a GBS AI surface protein and a GAS adhesin island surface protein. As another example, the invention includes a composition comprising a GAS adhesin island surface protein and a *S. pneumoniae* adhesin island surface protein. One or both of the GAS AI surface protein and the *S. pneumoniae* AI surface protein may be in oligomeric or hyperoligomeric form. As a further example, the invention includes a composition comprising a GBS adhesin island surface protein and a *S. pneumoniae* adhesin island surface protein.

In one embodiment, the invention comprises an adhesin island surface protein from two or more Gram positive bacterial genus. For example, the invention includes a composition comprising a *Streptococcus* adhesin island protein and a *Corynebacterium* adhesin island protein. One or more of the Gram positive bacteria AI surface proteins may be in an oligomeric or hyperoligomeric form.

In addition, the AI polynucleotides and amino acid sequences of the invention may also be used in diagnostics to identify the presence or absence of GBS (or a Gram positive bacteria) in a biological sample. They may be used to generate antibodies which can be used to identify the presence of absence of an AI protein in a biological sample or in a prophylactic or therapeutic treatment for GBS (or a Gram positive bacterial) infection. Further, the AI polynucleotides and amino acid sequences of the invention may also be used to identify small molecule compounds which inhibit or decrease the virulence associated activity of the AI.

BRIEF DESCRIPTION OF THE FIGURES

FIG. 4 also illustrates the identification of AI-2 comprising open reading frames encoding for 01520 (a sortase), 01521, 01522 (a sortase), 01523 (spb1), 01524 and 01525 (or sequences having sequence homology thereto).

FIG. 7 presents schematic depictions of in-frame deletion mutations within AI-1.

FIGS. 8A-E present FACS data showing that GBS 80 is required for surface localization of GBS 104. FIG. 8A, Coh1; FIG. 8B, Δ80; FIG. 8C, Δ104; FIG. 8D, Δ80/pGBs80; and FIG. 8E, Δ80/pAM401.

FIGS. 9A-E present FACS data showing that sortases SAG0647 and SAG0648 play a semi-redundant role in surface exposure of GBS 80 and GBS 104. FIG. 9A, Coh1; FIG. 9B, Δ52; FIG. 9C, Δ647; FIG. 9D, Δ648; and FIG. 9E, Δ647-8.

FIG. 10 presents Western Blots of the in-frame deletion mutants probed with anti-GBS80 and anti-GBS 104 antisera.

FIG. 11: Electron micrograph of surface exposed pili structures in *Streptococcus agalactiae* containing GBS 80.

FIG. 12: PHD predicted secondary structure of GBS 067 (SEQ ID NO:23).

FIGS. 18A-AL: Alignment of polynucleotide sequences of AI-1 from serotype V, strain isolates 2603 (SEQ ID NO:297) and CJB111 (SEQ ID NO:300); serotype II, strain isolate 18RS21 (SEQ ID NO:298); serotype III, strain isolates COH1 (SEQ ID NO:299) and NEM316 (SEQ ID NO:301); and serotype 1a, strain isolate A909 (SEQ ID NO:302). Majority sequence, SEQ ID NO:296.

FIGS. 20A-V: Alignment of polynucleotide sequences of AI-2 from serotype V, strain isolate 2603 (SEQ ID NO:304) and serotype III, strain isolate NEM316 (SEQ ID NO:309). Majority sequence, SEQ ID NO:547.

FIGS. 21A-V: Alignment of polynucleotide sequences of AI-2 from serotype III, strain isolate COH1 (SEQ ID NO:310) and serotype Ia, strain isolate A909 (SEQ ID NO:311). Majority sequence, SEQ ID NO:548.

FIGS. 22A-B: Alignment of amino acid sequences of AI-1 surface protein GBS 80 from serotype V, strain isolates 2603 (SEQ ID NO:2) and CJB111 (SEQ ID NO:312); serotype 1a, strain isolate A909 (SEQ ID NO:312); serotype III, strain isolates COH1 (SEQ ID NO:2) and NEM316 (SEQ ID NO:2). Majority sequence, SEQ ID NO:2.

FIGS. 23A-C: Alignment of amino acid sequences of AI-1 surface protein GBS 104 from serotype V, strain isolates 2603 (SEQ ID NOS:11 and 313) and CJB111 (SEQ ID NOS:11 and 313); serotype III, strain isolates COH1 (SEQ ID NO:314) and NEM316 (SEQ ID NOS:11 and 313); and serotype II, strain isolate 18RS21 (SEQ ID NOS:11 and 313). Majority sequence, SEQ ID NOS:11 and 313.

FIGS. 24A-C: Alignment of amino acid sequences of AI-2 surface protein GBS 067 from serotype V, strain isolates 2603 (SEQ ID NO:316) and CJB111 (SEQ ID NO:319); serotype 1a, strain isolate 515 (SEQ ID NO:317); serotype II, strain isolate 18RS21 (SEQ ID NO:318); serotype Ib, strain isolate H36B (SEQ ID NO:320); and serotype III, strain isolate NEM316 (SEQ ID NO:321). Majority sequence, SEQ ID NO:315.

FIG. 25: Illustrates that GBS closely associates with tight junctions and cross the monolayer of ME180 cervical epithelial cells by a paracellular route.

FIG. 26: Illustrates GBS infection of ME180 cells.

FIGS. 52A-B: Amino acid alignment of the capsular polysaccharide adhesion proteins of GAS AI-4 serotype M12 (A735), GAS AI-3 serotype M5 (Manfredo), *S. pyogenes* strain MGAS315 serotype M3, *S. pyogenes* strain SSI-1 serotype M3, *S. pyogenes* strain MGAS8232 serotype M3, and GAS AI-2 serotype M1. GI-19224135, SEQ ID NO:328; ORF78, SEQ ID NO:329; GI-21909634, SEQ ID NO:330; GI-28810257, SEQ ID NO:331; GI-19745301, SEQ ID NO:332; and GAS15, SEQ ID NO:333.

FIG. 53: Amino acid alignment of F-like fibronectin-binding proteins of GAS AI-4 serotype M12 (A735) and *S. pyogenes* strain MGAS10394 serotype M6. GI-19224134, SEQ ID NO:334; GI-50913503, SEQ ID NO:335.

FIGS. 54A-C: Amino acid alignment of F2-like fibronectin-binding proteins of GAS AI-4 serotype M12 (A735), *S. pyogenes* strain MGAS8232 serotype M3, GAS AI-3 strain M5 (Manfredo), *S. pyogenes* strain SSI serotype M3, and *S. pyogenes* strain MGAS315 serotype M3. GI-19745307, SEQ ID NO:336; ORF84, SEQ ID NO:337; GI-28810263, SEQ ID NO:338; GI-21909640, SEQ ID NO:339; and GI-19224141, SEQ ID NO:340.

FIG. 55: Amino acid alignment of fimbrial proteins of GAS AI-4 serotype M12 (A735), GAS AI-3 serotype M5 (Manfredo), *S. pyogenes* strain MGAS315 serotype M3, *S. pyogenes* strain SSI serotype M3, *S. pyogenes* strain MGAS8232 serotype M3, and *S. pyogenes* M1 GAS serotype M1. GI-19224137, SEQ ID NO:341; ORF80, SEQ ID NO:342; GI-21909636, SEQ ID NO:343; GI-28810259, SEQ ID NO:344; GI-19745303, SEQ ID NO:345; and GI-13621428, SEQ ID NO:346.

FIG. 56: Amino acid alignment of hypothetical proteins of GAS AI-4 serotype M12 (A735), *S. pyogenes* strain MGAS315 serotype M3, *S. pyogenes* strain SSI-1 serotype M3, GAS AI-3 serotype M5 (Manfredo), and *S. pyogenes* strain MGAS8232 serotype M3. GI-21909638, SEQ ID NO:347; GI-29910261, SEQ ID NO:348; GI-19224139, SEQ ID NO:349; ORF82, SEQ ID NO:350; and GI-19745305, SEQ ID NO:351.

FIGS. 57A-M: Results of FASTA homology search for amino acid sequences that align with the collagen adhesion protein of GAS AI-1 serotype M6 (MGAS10394). GI-50913505, SEQ ID NO:352; GI-19224141, SEQ ID NO:353; GI-21909640, SEQ ID NO:354; GI-13621428, SEQ ID NO:355; GI-50913506, SEQ ID NO:356; GI-13621432, SEQ ID NO:357; GI-19745301, SEQ ID NO:358; GAS15, SEQ ID NO:359; GI-21909636, SEQ ID NO:360; GI-28810259, SEQ ID NO:361; GI-19224139, SEQ ID NO:362; ORF82, SEQ ID NO:363; and GI-21909638, SEQ ID NO:364.

FIGS. 58A-Q: Results of FASTA homology search for amino acid sequences that align with the fimbrial structural subunit of GAS AI-1 serotype M6 (MGAS10394). GI-50913506, SEQ ID NO:365; ORF84, SEQ ID NO:366; GI-19745307, SEQ ID NO:367; GI-21909640, SEQ ID NO:368; GI-28810263, SEQ ID NO:369; ORF80, SEQ ID NO:370; GI-19224137, SEQ ID NO:371; GI-19224141, SEQ ID NO:372; GI-21909636, SEQ ID NO:373; GI-28810259, SEQ ID NO:374; GAS15, SEQ ID NO:375; GI-13621428, SEQ ID NO:376; GI-19224135, SEQ ID NO:377; GI-50913505, SEQ ID NO:378; GI-13621430, SEQ ID NO:379; and GI-19745303, SEQ ID NO:380.

FIGS. 59A-I: Results of FASTA homology search for amino acid sequences that align with the hypothetical protein of GAS AI-2 serotype M1 (SF370). gi-13621430, SEQ ID NO:381; gi-19745305, SEQ ID NO:382; gi-28810261, SEQ ID NO:383; gi|19224139, SEQ ID NO:384; gi|21909638, SEQ ID NO:385; gi|19745303, SEQ ID NO:386; gi|13621428, SEQ ID NO:387; gi|19224137, SEQ ID NO:388; gi|50913503, SEQ ID NO:389; and gi|19224134, SEQ ID NOS:390, 391.

FIG. 60: Specifies pilin and E box motifs present in GAS type 3 (SEQ ID NOS:392, 393) and 4 (SEQ ID NO:394-405) adhesin islands.

FIG. 62A, whole COH1 cells and whole 2603 cells; FIG. 62B, negative control; FIG. 62C, GBS80; and FIG. 62D, GBS322.

FIG. 63: Illustrates the amino acid sequence identity of GBS 59 proteins in GBS strains.

FIG. 66: FACS analysis of GBS strains CJB111, 7357B, 515 using GBS 59 antiserum.

FIGS. 101A-AP: Full length nucleotide sequence of an *S. pneumoniae* strain 670 AI (SEQ ID NO:406). Homologue of sp0459, SEQ ID NO:407; orf1__670 homolog of sp0460, SEQ ID NO:408; orf2__670 homologue of sp0461, SEQ ID NO:409; homologue of sp0462, SEQ ID NO:410; homologue of sp0463, SEQ ID NO:411; homologue of sp0464, SEQ ID NO:412; homologue of sp0466, SEQ ID NO:413; homologue of sp0467, SEQ ID NO:414; and homologue of sp0468, SEQ ID NO:415.

Figure 120:
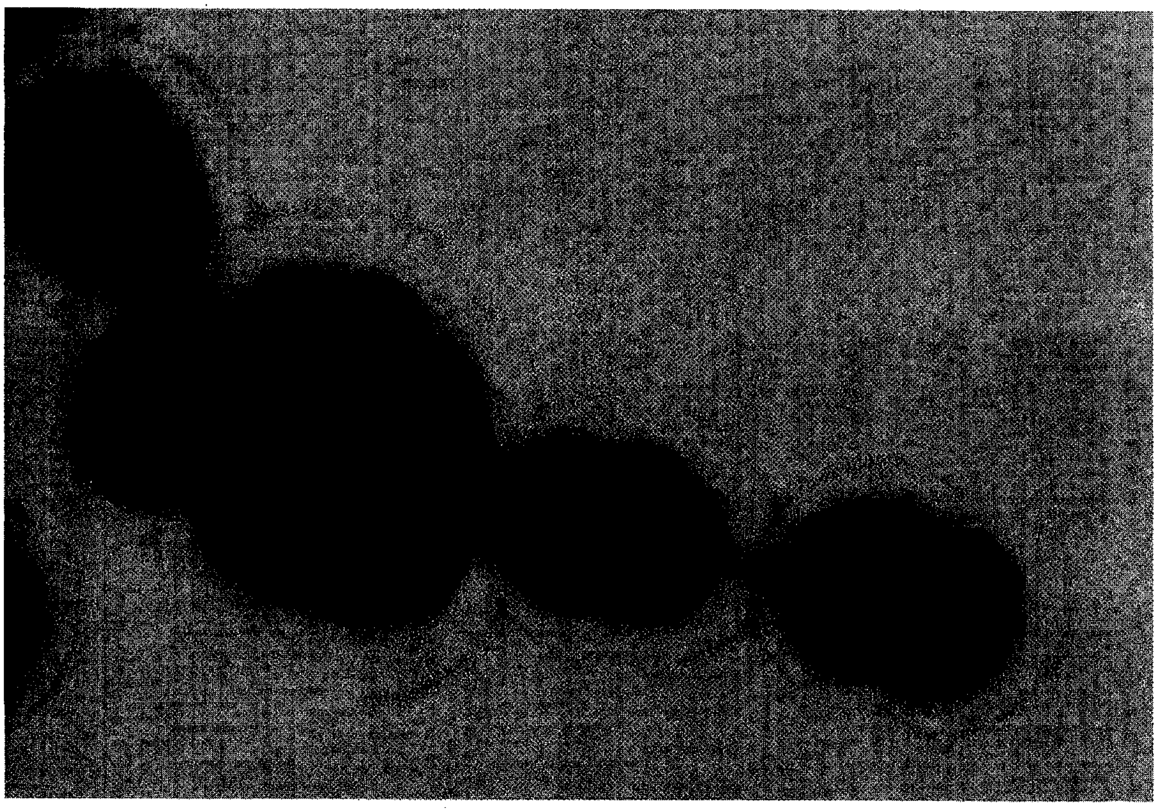

FIG. 120: Electron micrographs of surface exposed GAS 16 on GAS M1 strain SF370.

Figure 121:
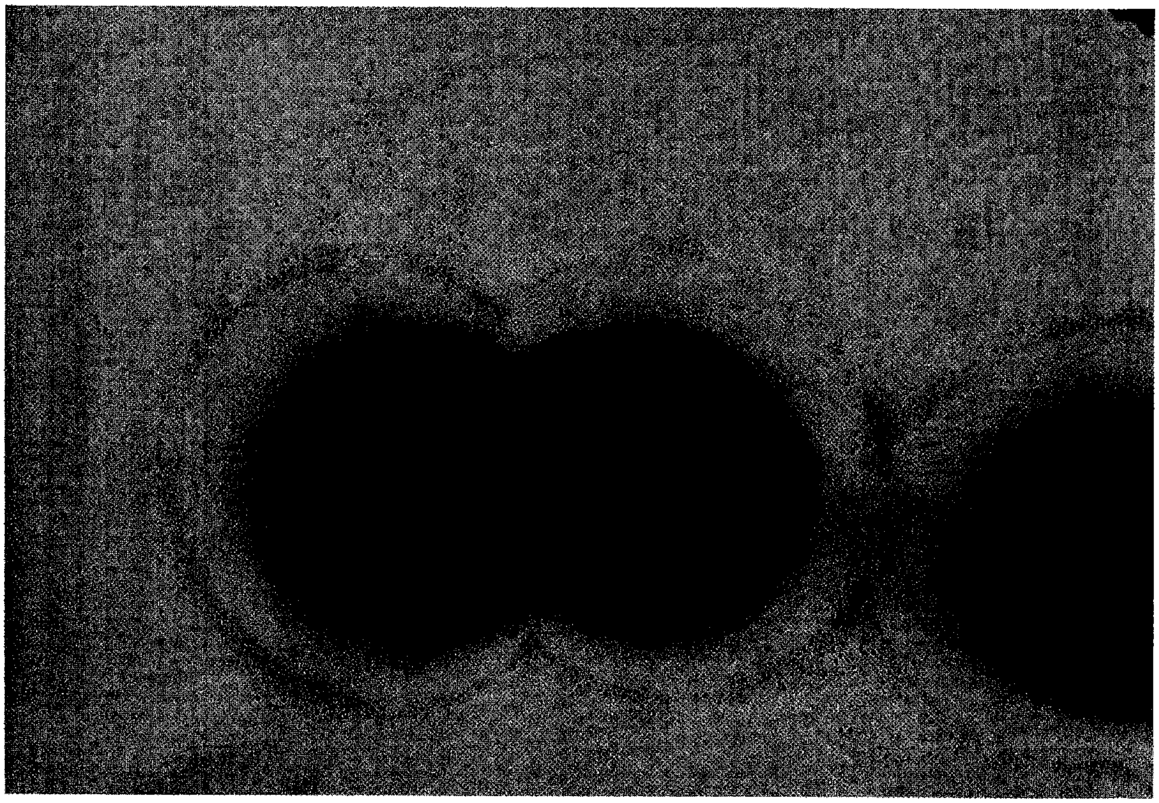

FIG. 121: Electron micrographs of surface exposed GAS 16 on GAS M1 strain SF370.

Figure 122:
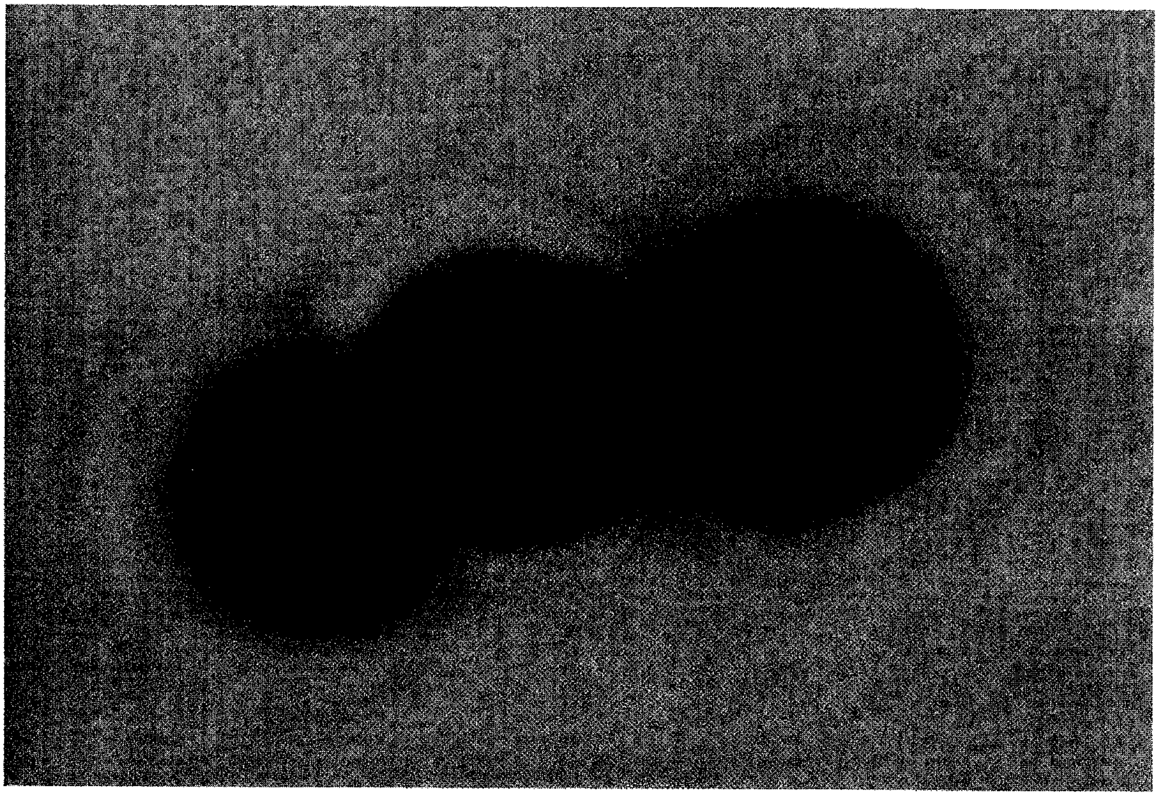

FIG. 122: Electron micrographs of surface exposed GAS 18 on GAS M1 strain SF370 detected using anti-GAS 18 antisera.

Figure 123:
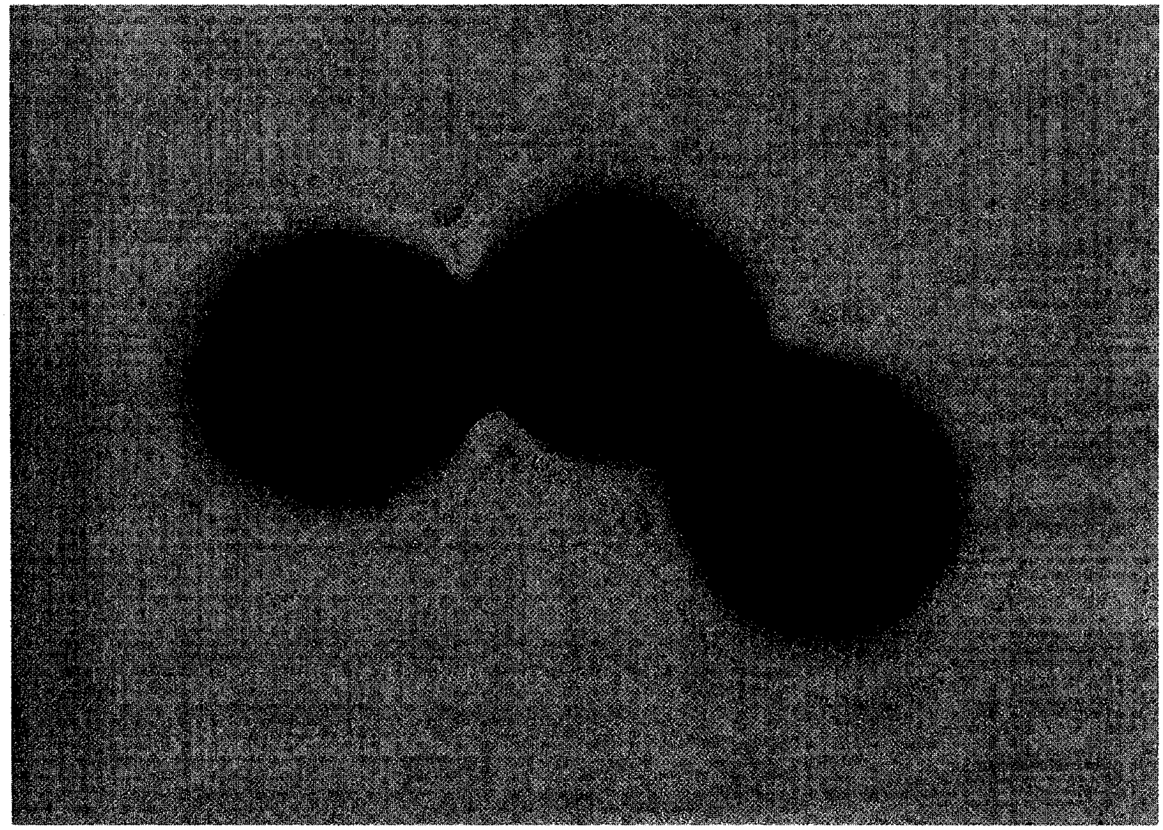

FIG. 123: Electron micrographs of surface exposed GAS 18 on GAS M1 strain SF370 detected using anti-GAS 18 antisera.

Figure 124:
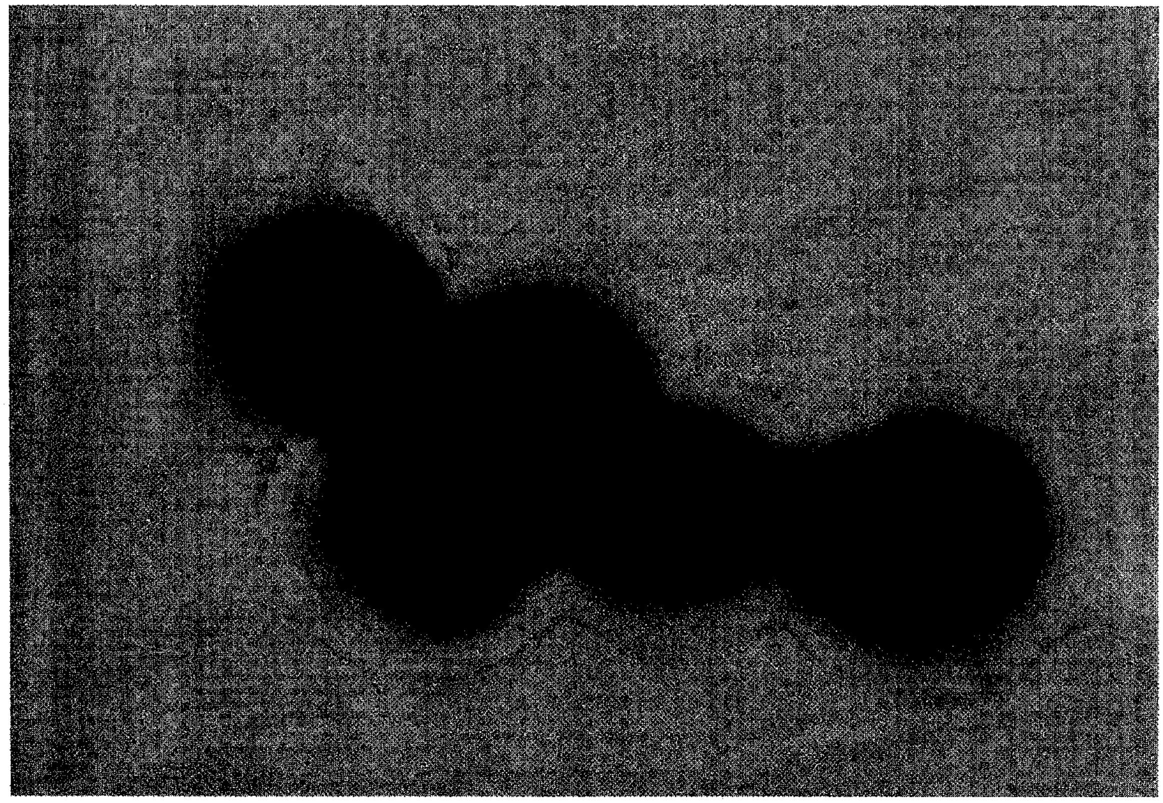

FIG. 124: Electron micrographs of surface exposed GAS 18 on GAS M1 strain SF370 detected using anti-GAS 18 antisera.

Figure 125:
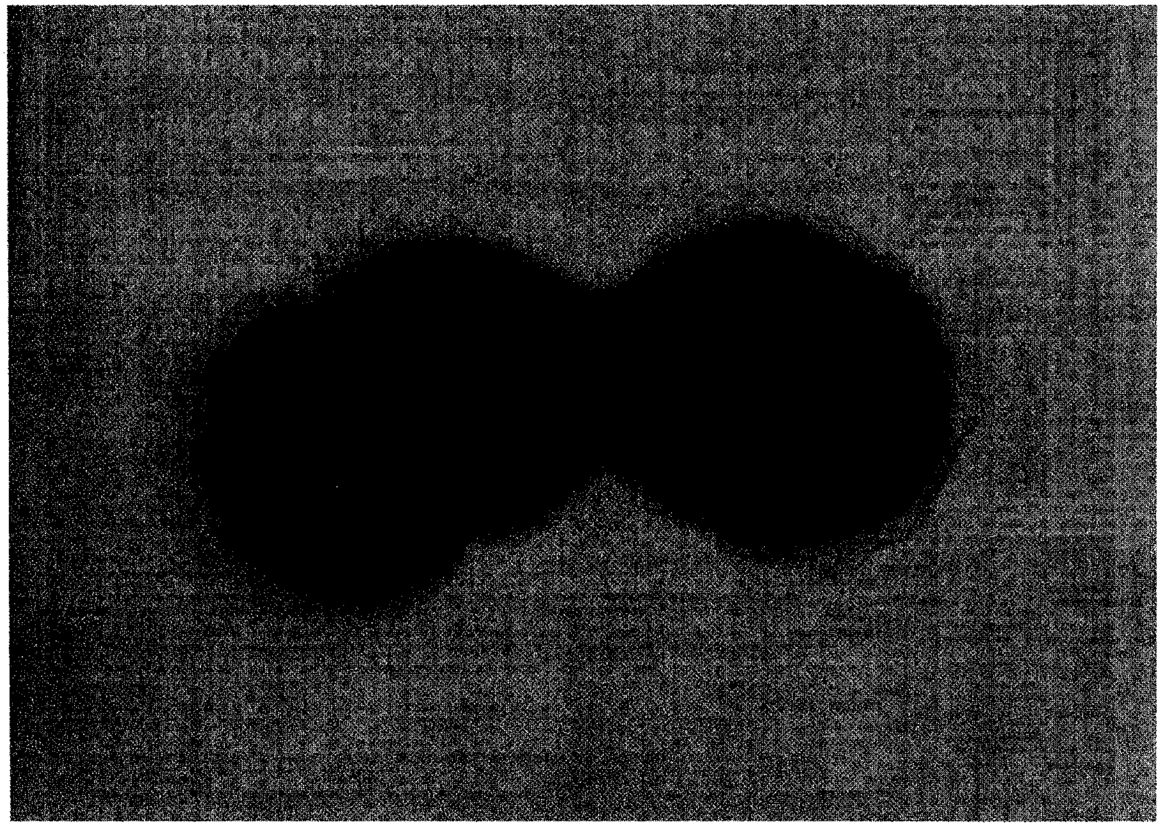

FIG. 125: Electron micrographs of surface exposed GAS 18 on GAS M1 strain SF370 detected using anti-GAS 18 antisera.

Figure 126:
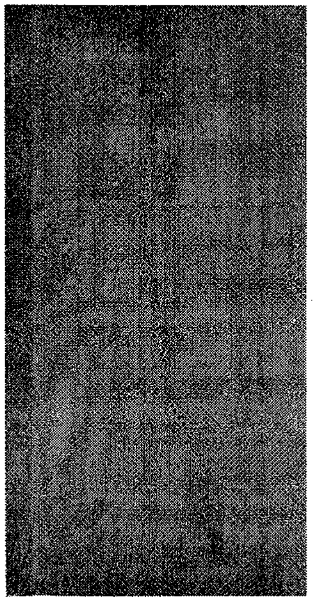

FIG. 126: IEM image of a hyperoligomer on GAS M1 strain SF370 detected using anti-GAS 18 antisera.

Figure 127:
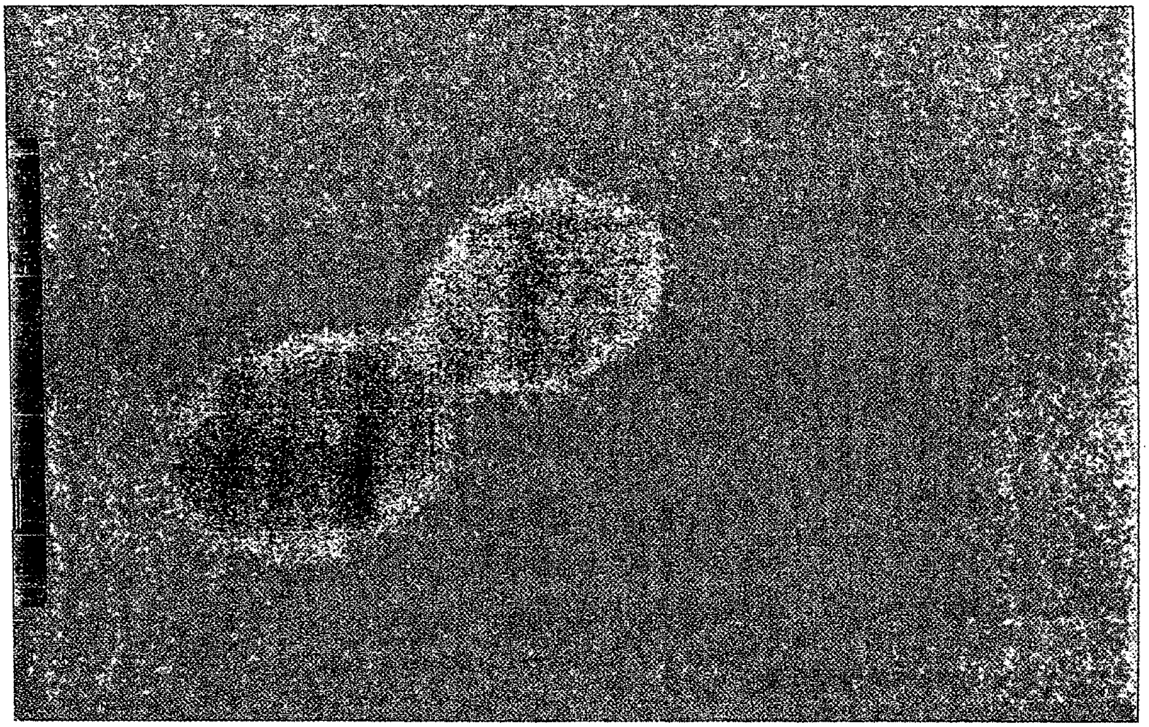

FIG. 127: IEM image of oligomeric and hyperoligomeric structures containing M6_Spy0160 extending from the surface of GAS serotype M6 3650.

Figure 128:
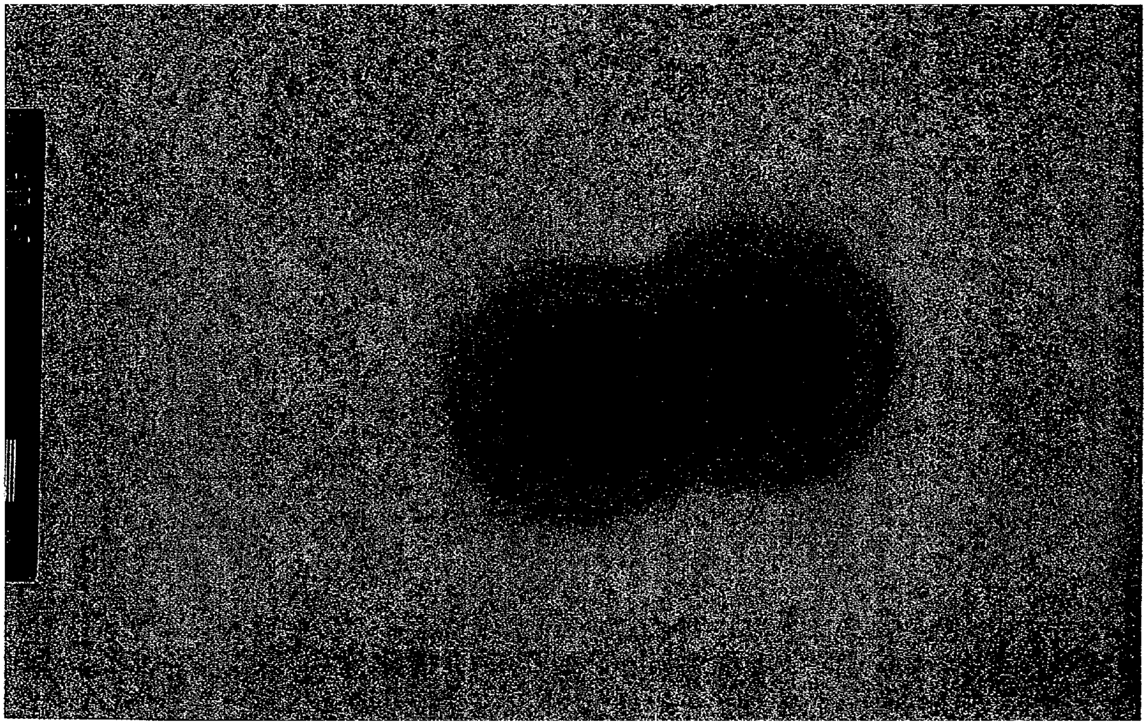

FIG. 128: IEM image of oligomeric and hyperoligomeric structures containing M6_Spy0160 extending from the surface of GAS serotype M6 3650.

Figure 129:

FIG. 129: IEM image of oligomeric and hyperoligomeric structures containing M6_Spy0160 extending from the surface of GAS serotype M6 3650.

Figure 130:
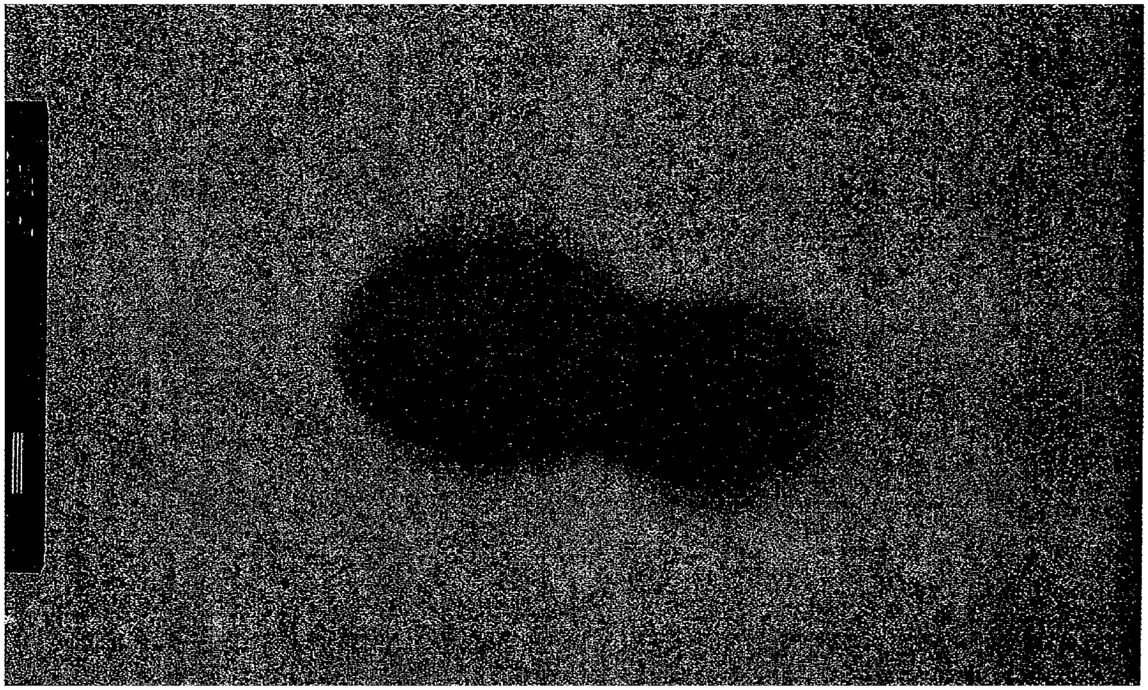

FIG. 130: IEM image of oligomeric and hyperoligomeric structures containing M6_Spy0160 extending from the surface of GAS serotype M6 3650.

Figure 131:

FIG. 131: IEM image of oligomeric and hyperoligomeric structures containing M6_Spy0160 extending from the surface of GAS serotype M6 3650.

Figure 132:
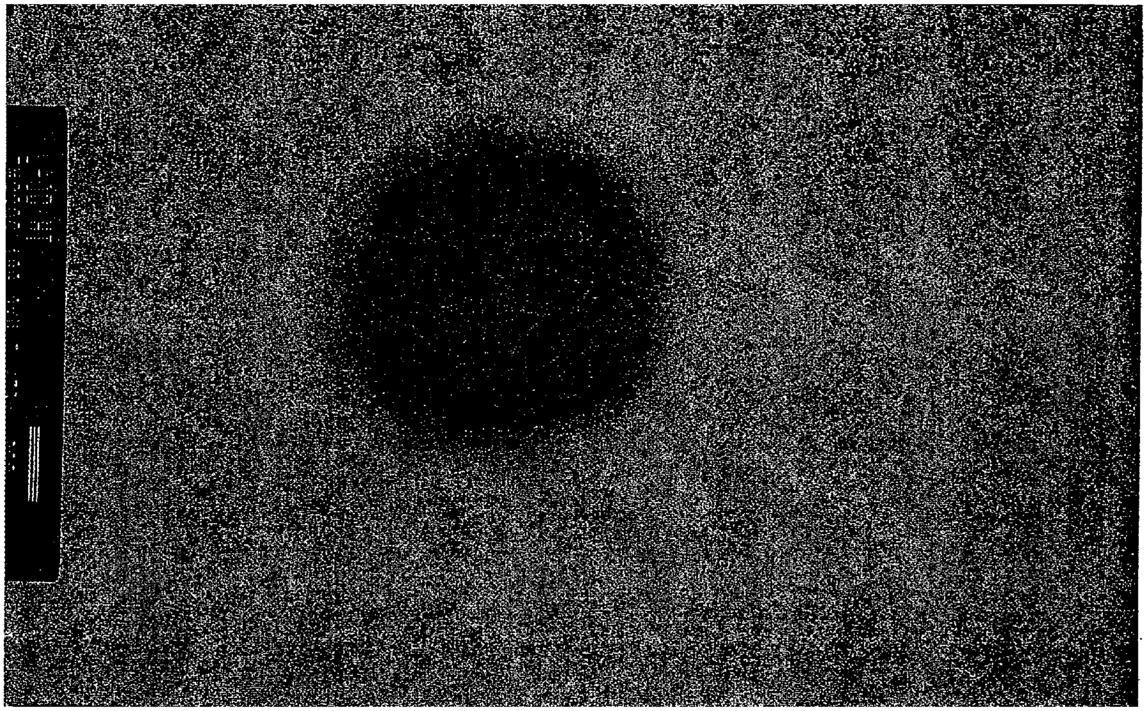

FIG. 132: IEM image of oligomeric and hyperoligomeric structures containing M6_Spy0160 extending from the surface of GAS serotype M6 3650.

Figure 133:
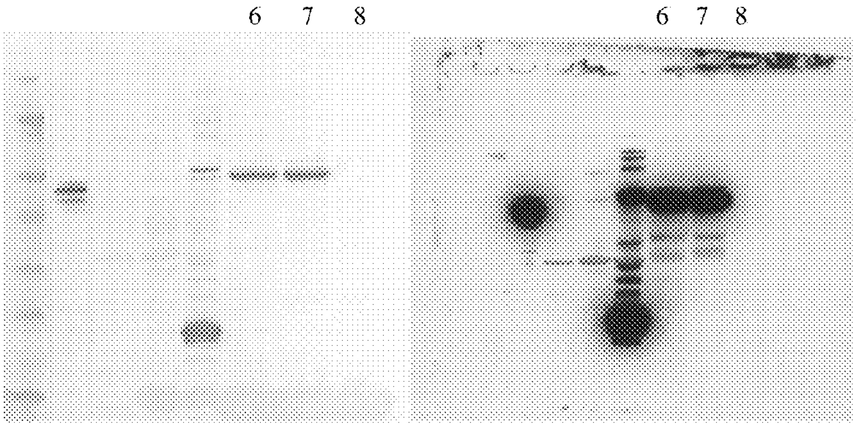

FIGS. 133A-B: Western blot analysis of *L. lactis* transformed to express GBS 80 with anti-GBS 80 antiserum.

Figure 134:
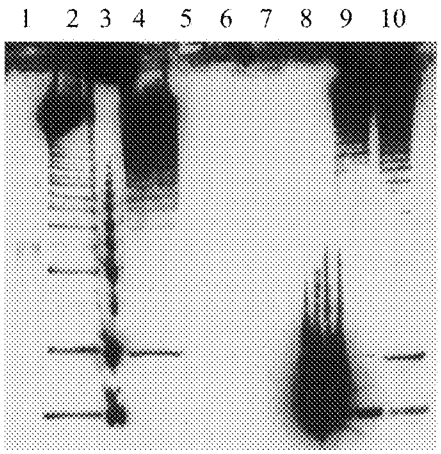

FIG. 134: Western blot analyses of *L. lactis* transformed to express GBS AI-1 with anti-GBS 80 antiserum.

Figure 135:
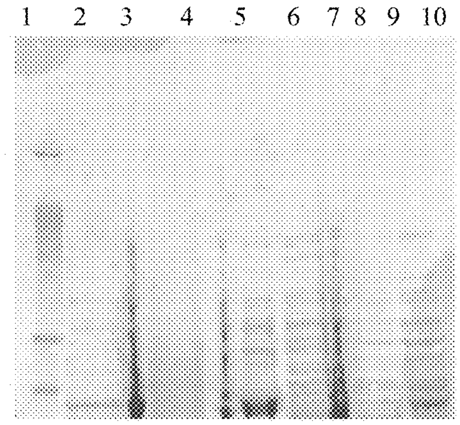

FIG. 135: Ponceau staining of same acrylamide gel as used in FIG. 134.

FIG. 136A: Western blot analysis of sonicated pellets and supernatants of cultured *L. lactis* transformed to express GBS AI-1 polypeptides using anti-GBS 80 antiserum.

FIG. 136B: Polyacrylamide gel electrophoresis of sonicated pellets and supernatants of cultured *L. lactis* transformed to express GBS AI polypeptides.

Figure 137:
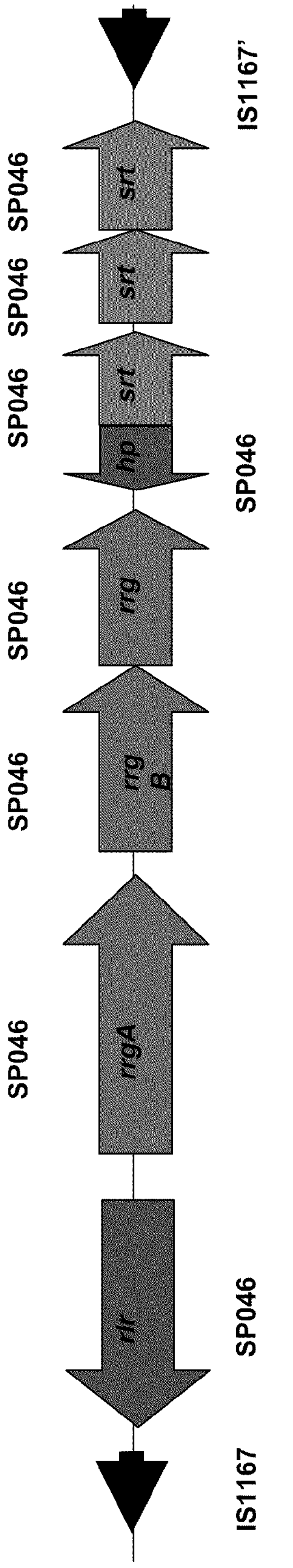

FIG. 137: Depiction of an example *S. pneumoniae* AI locus.

Figure 138:
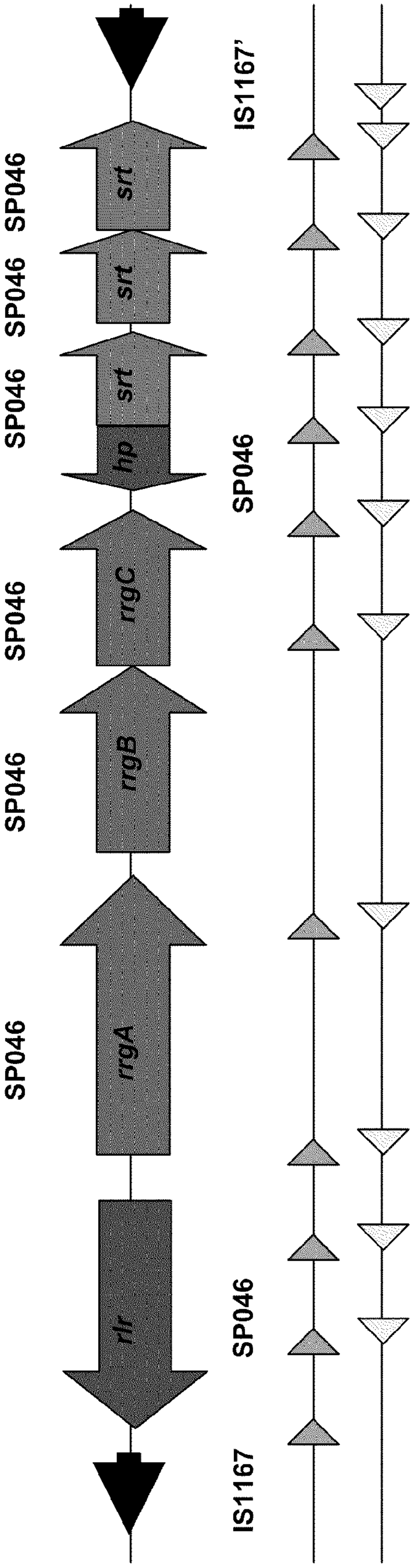

FIG. 138: Schematic of primer hybridization sites within the *S. pneumoniae* AI locus of FIG. 137.

Figure 139:
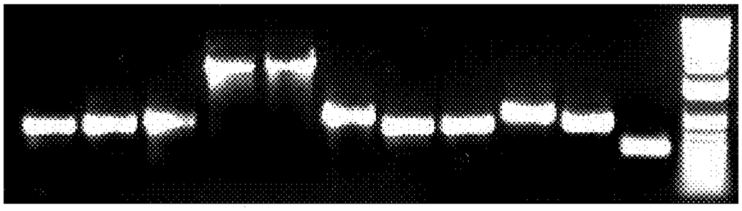

FIG. 139A: The set of amplicons produced from the *S. pneumoniae* strain TIGR4 AI locus.

FIG. 139B: Base pair lengths of amplicons produced from FIG. 139A primers in *S. pneumoniae* strain TIGR4.

Figure 140:
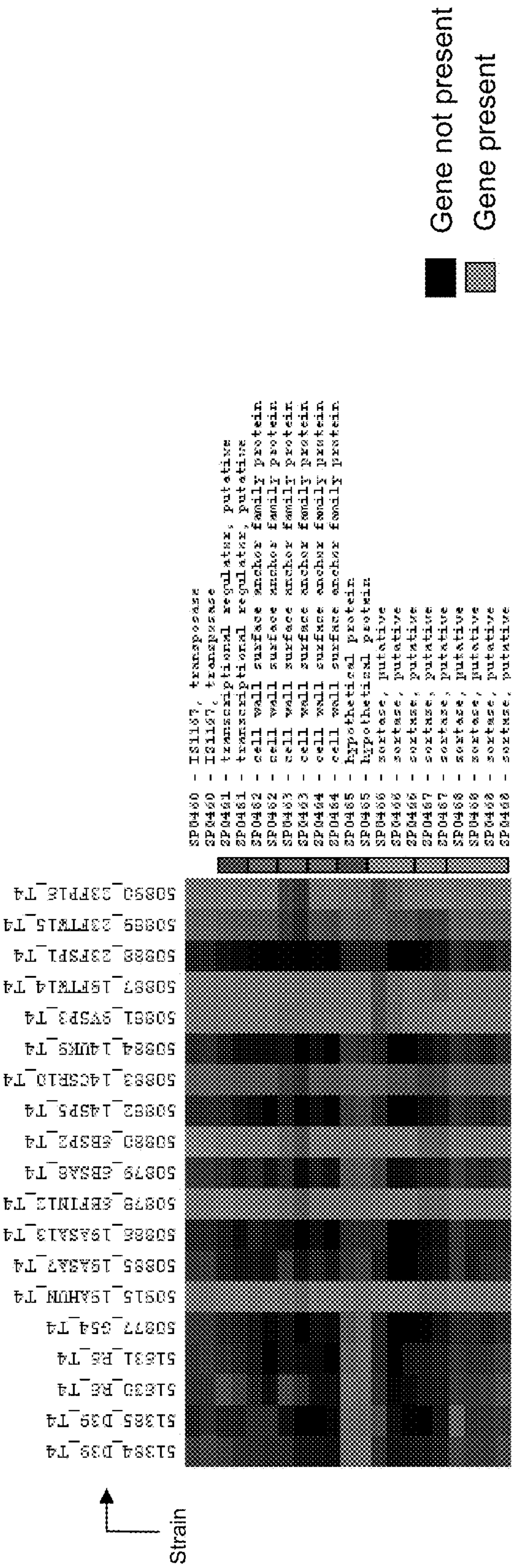

FIG. 140: CGH analysis of *S. pneumoniae* strains for the AI locus.

FIGS. 141A-B: Amino acid sequence alignment of polypeptides encoded by AI orf 2 in *S. pneumoniae* AI-positive strains. ORF2__14CSR, SEQ ID NO:416; ORF2__19AH, SEQ ID NO:417; ORF2__19FTW, SEQ ID NO:418; ORF2__23FP, SEQ ID NO:419; ORF2__23FTW, SEQ ID NO:420; ORF2__670, SEQ ID NO:421; ORF2__6BF, SEQ ID NO:422; ORF2__6BSP, SEQ ID NO:423; ORF2_TIGR, SEQ ID NO:424; ORF2__9VSP, SEQ ID NO:425.

FIGS. 142A-C: Amino acid sequence alignment of polypeptides encoded by AI orf 3 in *S. pneumoniae* AI-positive strains. ORF3__19AH, SEQ ID NO:426; ORF3__23FP, SEQ ID NO:427; ORF3__14CSR, SEQ ID NO:428; ORF3__670, SEQ ID NO:429; ORF3__6BF, SEQ ID NO:430; ORF3__6BSP, SEQ ID NO:431; ORF3__19FTW, SEQ ID NO:432; ORF3__9VSP, SEQ ID NO:433; ORF3__23FTW, SEQ ID NO:434; ORF3_TIGR, SEQ ID NO:435.

FIGS. 143A-C: Amino acid sequence alignment of polypeptides encoded by AI orf 4 in *S. pneumoniae* AI-positive strains. ORF4__6BF, SEQ ID NO:436; ORF4__6BSP, SEQ ID NO:437; ORF4__670, SEQ ID NO:438; ORF4__14CSR, SEQ ID NO:439; ORF4__19AH, SEQ ID NO:440; ORF4__23FP, SEQ ID NO:441; ORF4__23FTW, SEQ ID NO:442; ORF4__19FTW, SEQ ID NO:443; ORF4__9VSP, SEQ ID NO:444; ORF4_TIGR, SEQ ID NO:445.

FIGS. 144A-B: Amino acid sequence alignment of polypeptides encoded by AI orf 5 in *S. pneumoniae* AI-positive strains. ORF5__6BSP, SEQ ID NO:446; ORF5_TIGR, SEQ ID NO:447; ORF5__6BF, SEQ ID NO:448; ORF5__670, SEQ ID NO:449; ORF5__19AH, SEQ ID NO:450; ORF5__14CSR, SEQ ID NO:451; ORF5__19FTW, SEQ ID NO:452; ORF5__23FTW, SEQ ID NO:453; ORF5__9VSP, SEQ ID NO:454; ORF5__23FP, SEQ ID NO:455.

FIGS. 145A-B: Amino acid sequence alignment of polypeptides encoded by AI orf 6 in *S. pneumoniae* AI-positive strains. ORF6__23FTW, SEQ ID NO:456; ORF6_TIGR, SEQ ID NO:457; ORF6__6BSP, SEQ ID NO:458; ORF6__6BF, SEQ ID NO:459; ORF6__670, SEQ ID NO:460; ORF6__19AH, SEQ ID NO:461; ORF6__14CSR, SEQ ID NO:462; ORF6__23FP, SEQ ID NO:463; ORF6__9VSP, SEQ ID NO:464; ORF6__19FTW, SEQ ID NO:465.

FIG. 146: Amino acid sequence alignment of polypeptides encoded by AI orf 7 in *S. pneumoniae* AI-positive strains. ORF7__14CSR, SEQ ID NO:466; ORF7__19AH, SEQ ID NO:467; ORF7__6BF, SEQ ID NO:468; ORF7__6BSP, SEQ ID NO:469; ORF7__670, SEQ ID NO:470; ORF7__23FTW, SEQ ID NO:471; ORF7__23FP, SEQ ID NO:472; ORF7__9VSP, SEQ ID NO:473; ORF7__19FTW, SEQ ID NO:474; ORF7_TIGR, SEQ ID NO:475.

FIG. 147: Amino acid sequence alignment of polypeptides encoded by AI orf 8 in *S. pneumoniae* AI-positive strains. ORF8__14CSR, SEQ ID NO:476; ORF8__19AH, SEQ ID NO:477; ORF8__23FTW, SEQ ID NO:478; ORF8__670, SEQ ID NO:479; ORF8__6BF, SEQ ID NO:480; ORF8__6BSP, SEQ ID NO:481; ORF8__19FTW, SEQ ID NO:482; ORF8__23FP, SEQ ID NO:483; ORF8__9VSP, SEQ ID NO:484; ORF8_TIGR, SEQ ID NO:485.

Figure 148:
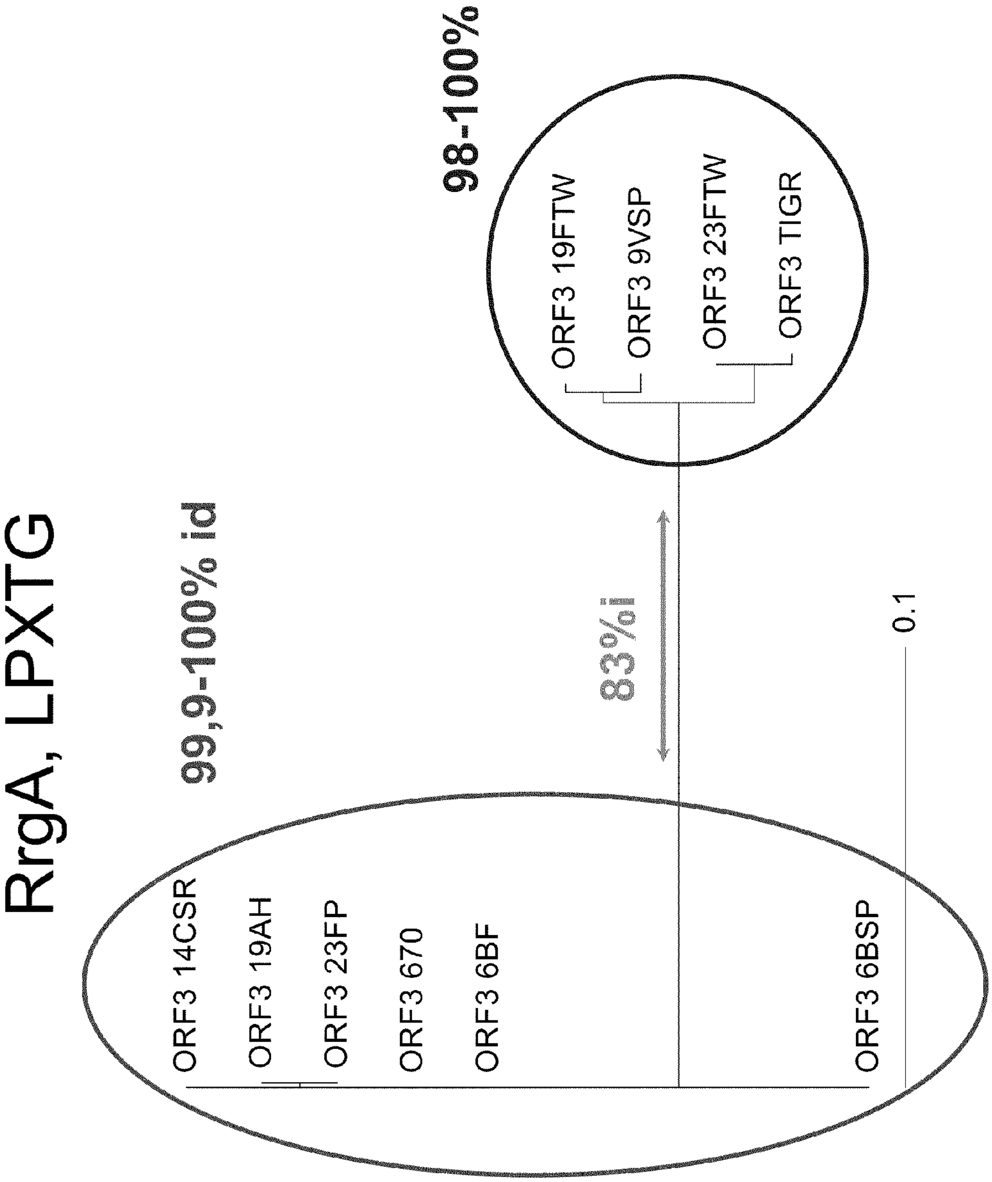

FIG. 148: Diagram comparing amino acid sequences of RrgA in *S. pneumoniae* strains.

Figure 149:
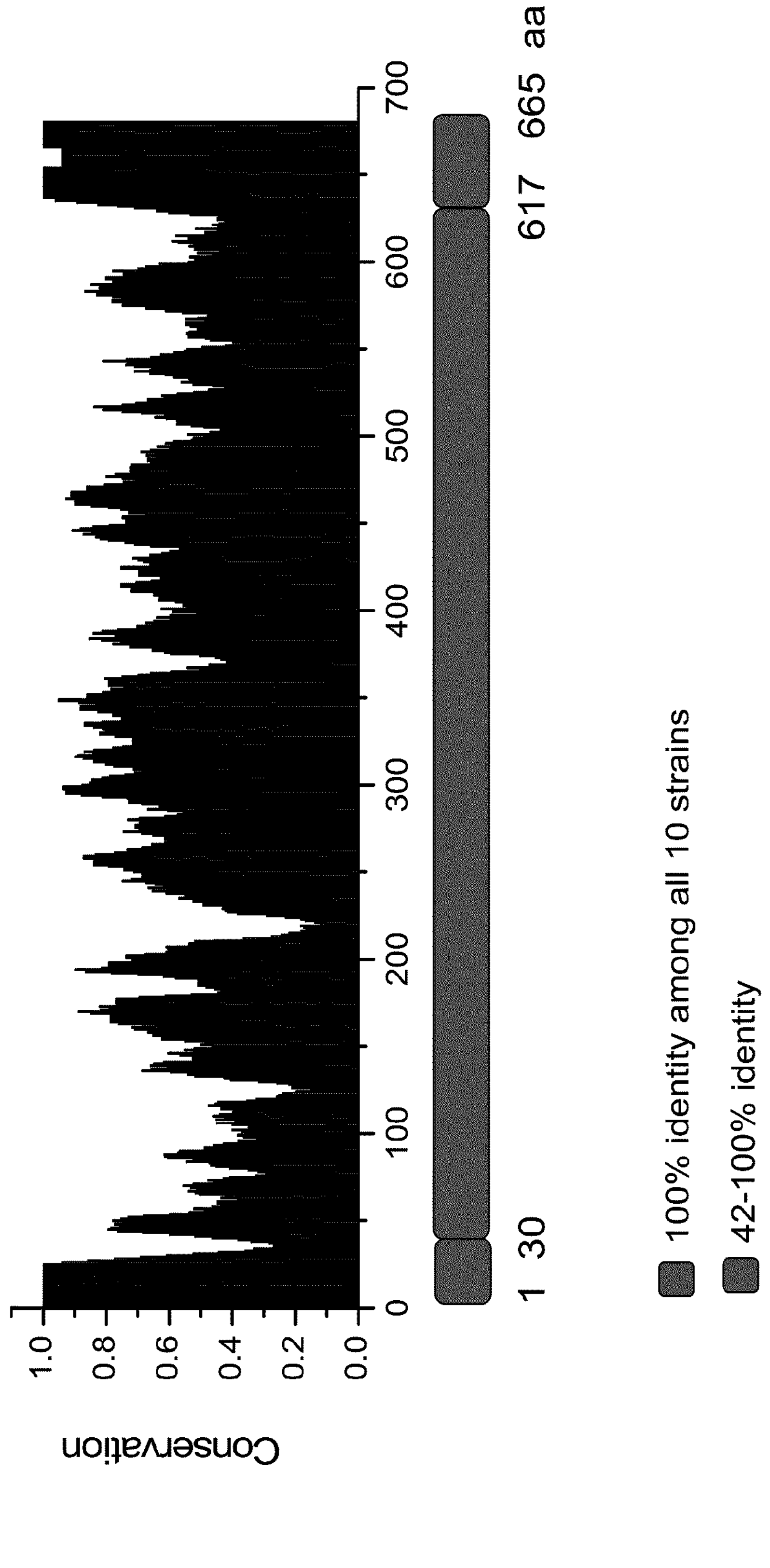

FIG. 149: Amino acid sequence comparison of RrgB *S. pneumoniae* strains.

FIG. 150A: Sp0462 amino acid sequence (SEQ ID NO:486).

FIG. 150B: Primers used to produce a clone encoding the Sp0462 polypeptide (SEQ ID NOS:487, 488).

Figure 151:
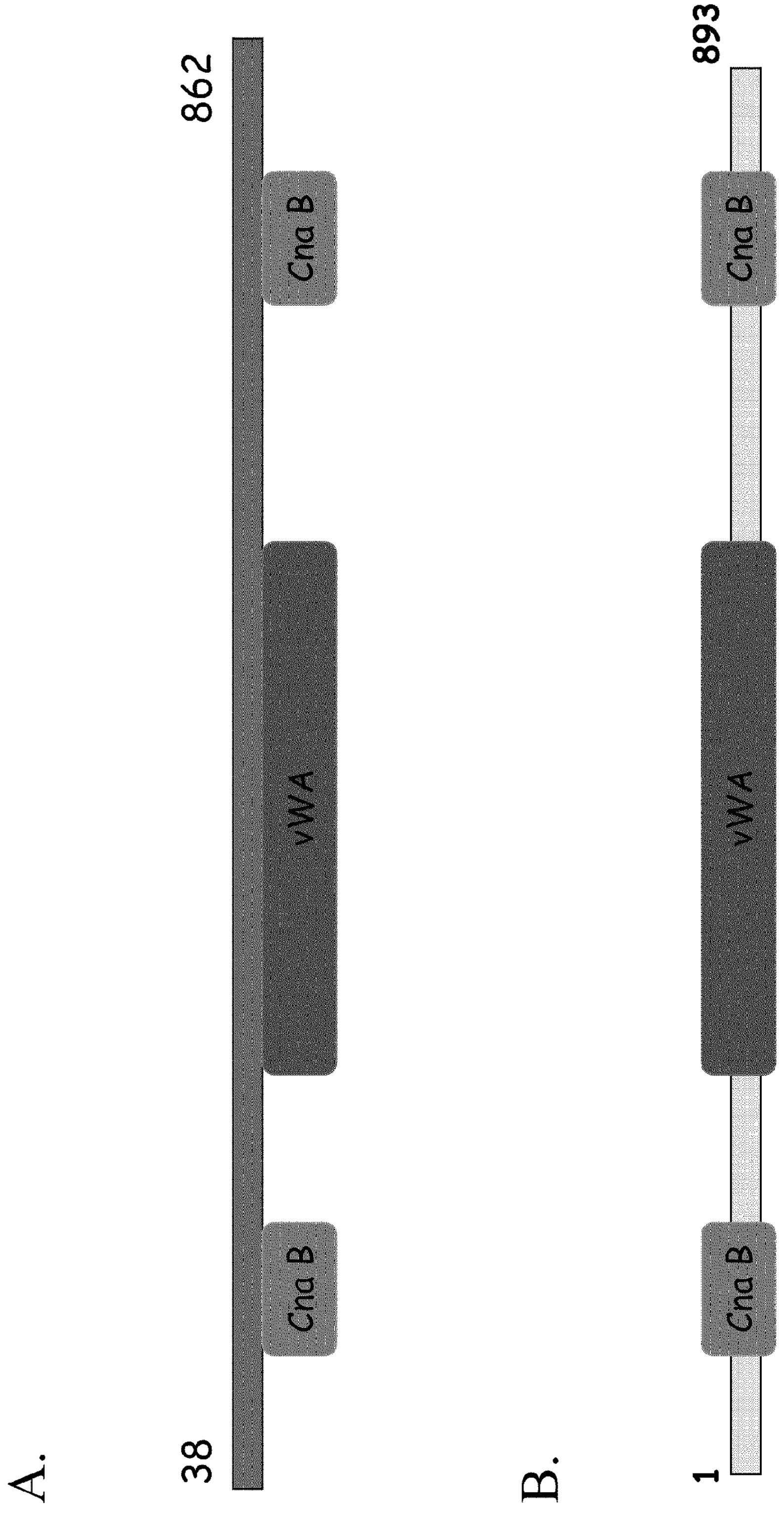

FIG. 151A: Schematic depiction of recombinant Sp0462 polypeptide.

FIG. 151B: Schematic depiction of full-length Sp0462 polypeptide.

FIG. 152A: Western blot probed with serum obtained from *S. pneumoniae*-infected patients for Sp0462.

FIG. 152B: Western blot probed with GBS 80 serum for Sp0462.

FIG. 153A: Sp0463 amino acid sequence (SEQ ID NO:489).

FIG. 153B: Primers used to produce a clone encoding the Sp0463 polypeptide (SEQ ID NO:490, 491).

Figure 154:
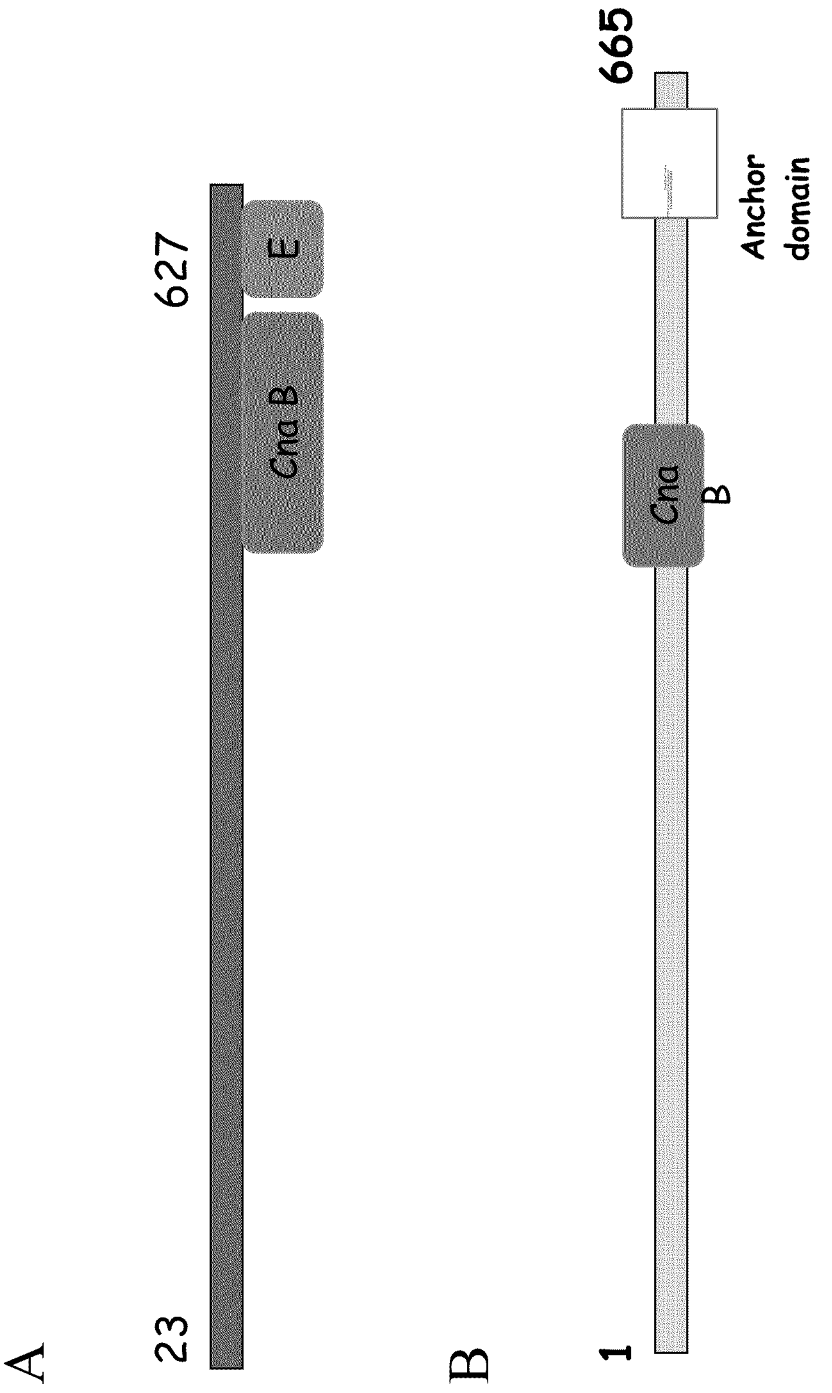

FIG. 154A: Schematic depiction of recombinant Sp0463 polypeptide.

FIG. 154B: Schematic depiction of full-length Sp0463 polypeptide.

Figure 155:
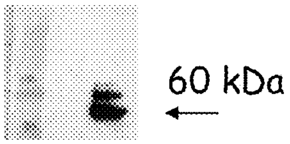

FIG. 155: Western blot detection of recombinant Sp0463 polypeptide.

Figure 156:
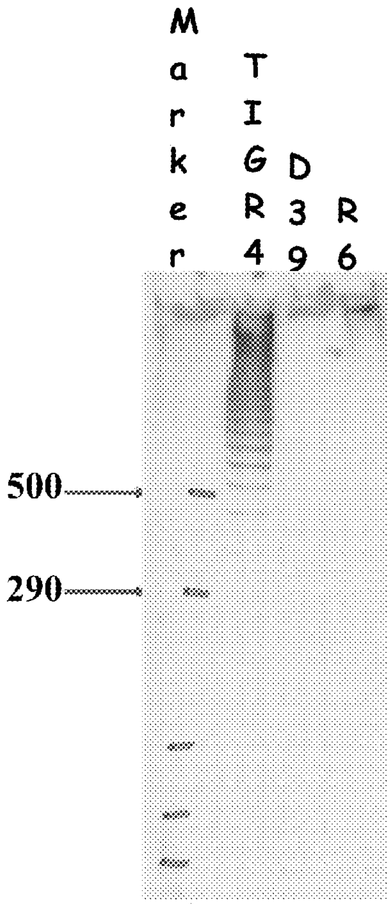

FIG. 156: Western blot detection of high molecular weight Sp0463 polymers.

FIG. 157A: Sp0464 amino acid sequence (SEQ ID NO:492).

FIG. 157B: Primers used to produce a clone encoding the Sp0464 polypeptide (SEQ ID NOS:493, 494).

Figure 158:
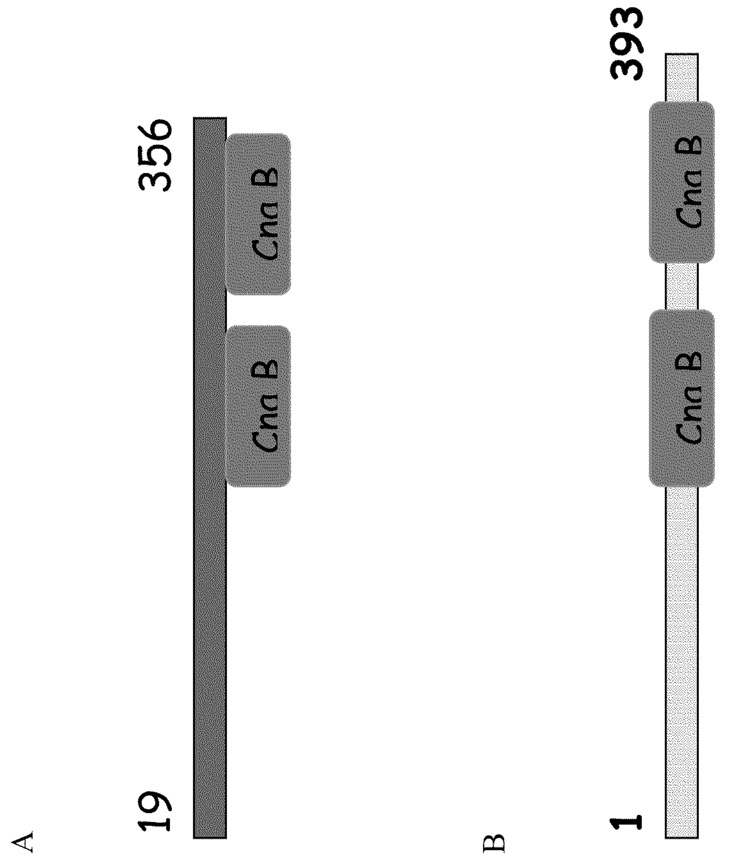

FIG. 158A: Schematic depiction of recombinant Sp0464 polypeptide.

FIG. 158B: Schematic depiction of full-length Sp0464 polypeptide.

Figure 159:
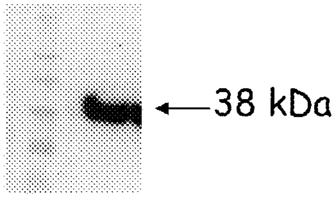

FIG. 159: Western blot detection of recombinant Sp0464 polypeptide.

Figure 160:
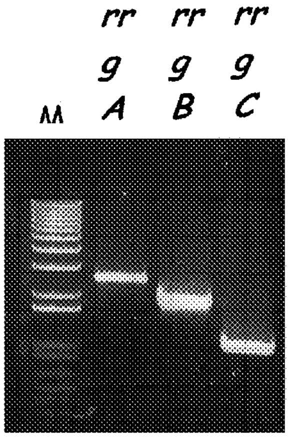

FIG. 160: Amplification products prepared for production of Sp0462, Sp0463, and Sp0464 clones.

Figure 161:
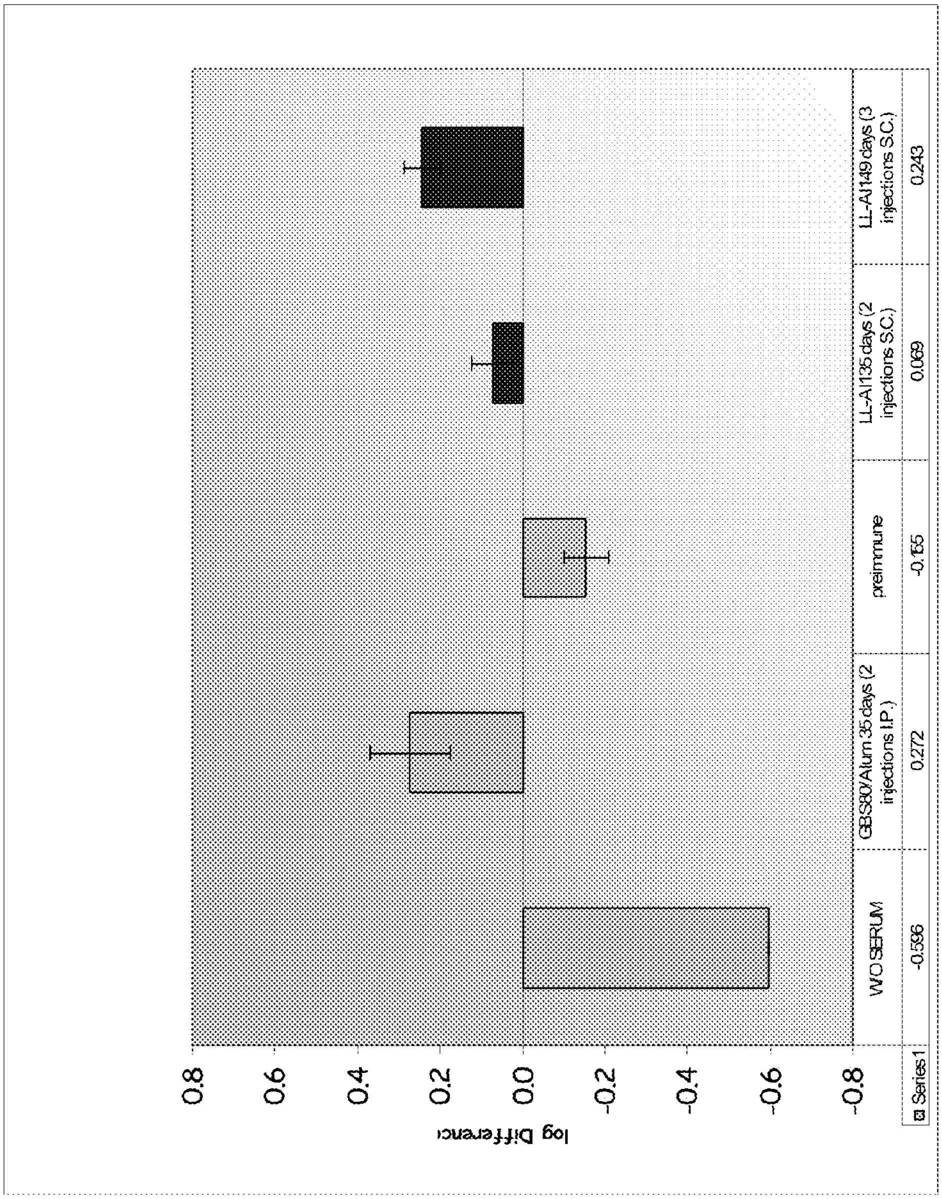

FIG. 161: Opsonic killing by anti-sera raised against *L. lactis* expressing GBS AI FIG. 162: Schematic depicting GAS adhesin islands GAS AI-1, GAS AI-2, GAS AI-3 and GAS AI-4.

Figure 163:
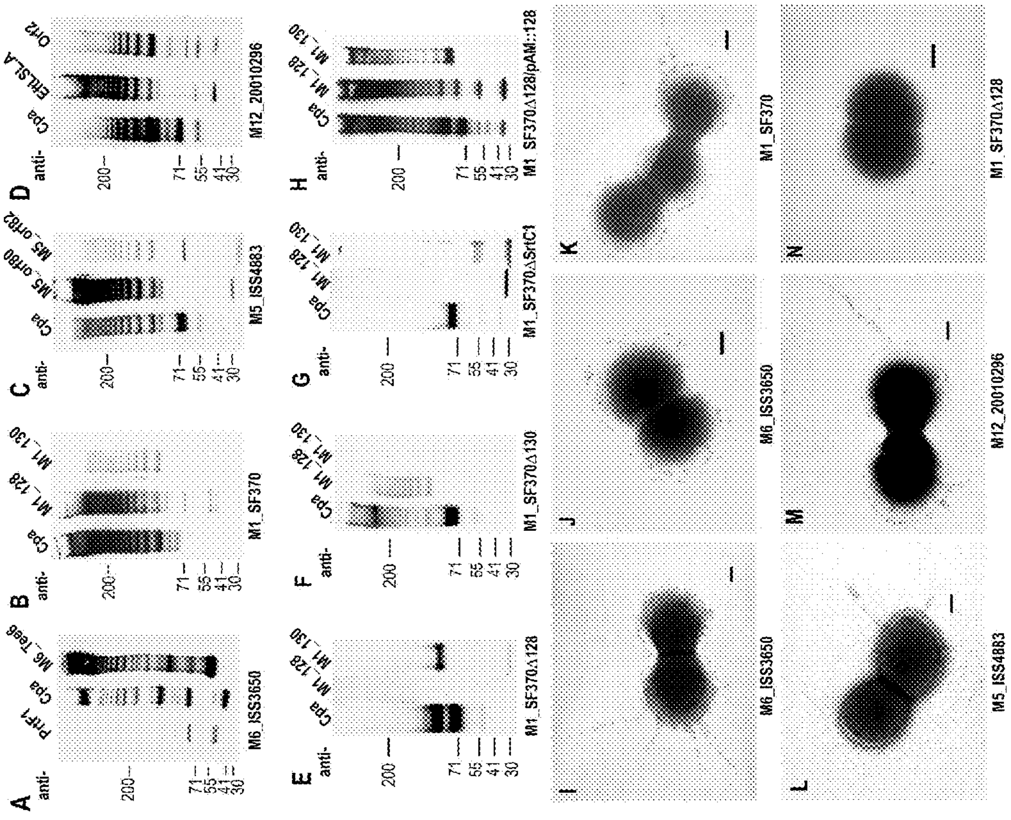

FIGS. 163 A-D: Immunoblots of cell-wall fractions of GAS strains with antisera specific for LPXTG proteins of M6_ISS3650 (A), M1_SF370 (B), M5_ISS4883 (C) and M12__20010296 (D).

FIGS. 163 E-H: Immunoblots of cell-wall fractions of deletion mutants M1_SF370.DELTA.128 (E) M1_SF370.DELTA.130 (F) M1_SF370.DELTA.SrtC1 (G) and the M1__128 deletion strain complemented with plasmid pAM::128 which contains the M1__128 gene (H) with antisera specific for the pilin components of M1_SF370.

FIGS. 163 I-N: Immunogold labeling and transmission electron microscopy of: T6 (I) and Cpa (J) in M6__1553650; M1__128 in M1_SF370 (K) and deletion strain M1_SF370.DELTA.128 (N); M5_orf80 in M5_ISS4883 (L); M12_EftLSL.A in M12__20010296 (M). The strains used are indicated below the panels. Bars=200 nm.

Figure 164:
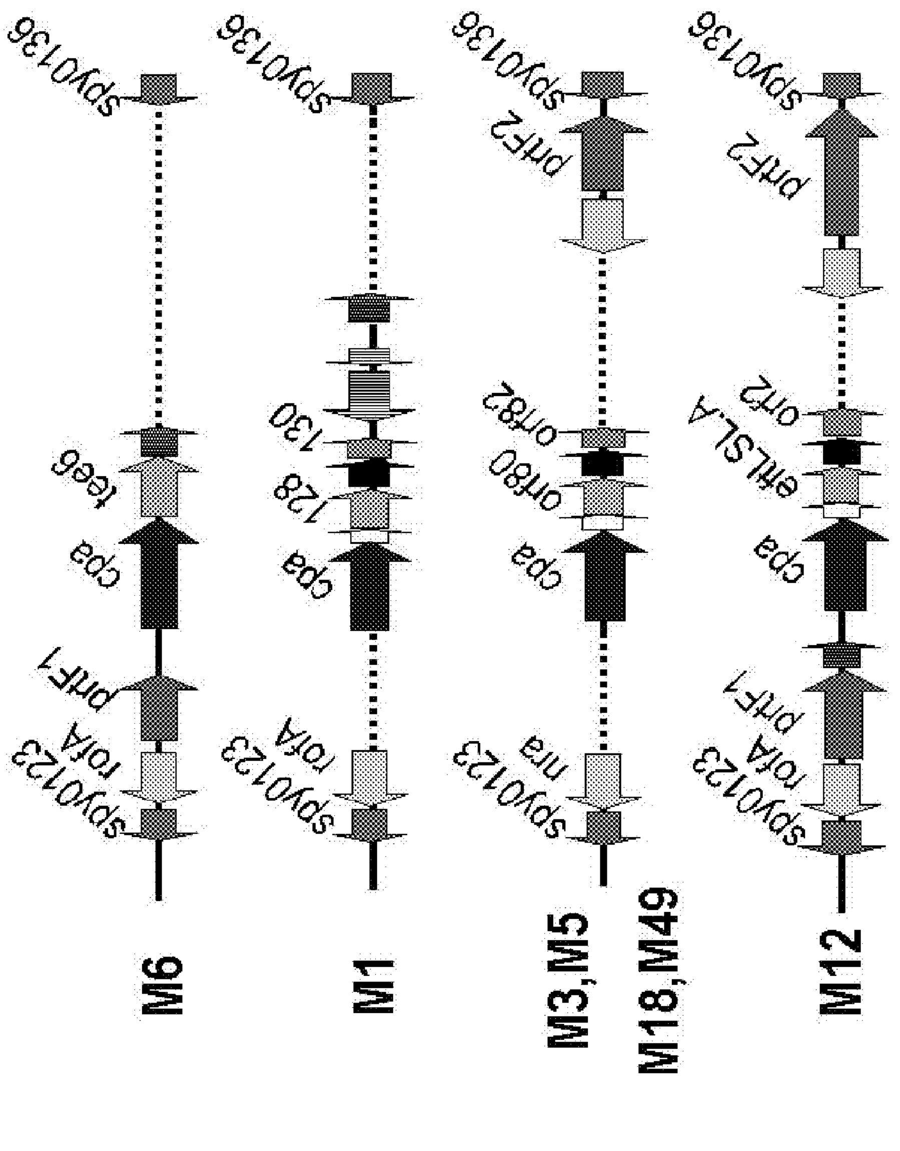

FIG. 164: Schematic representation of the FCT region from 7 GAS strains

Figure 165:
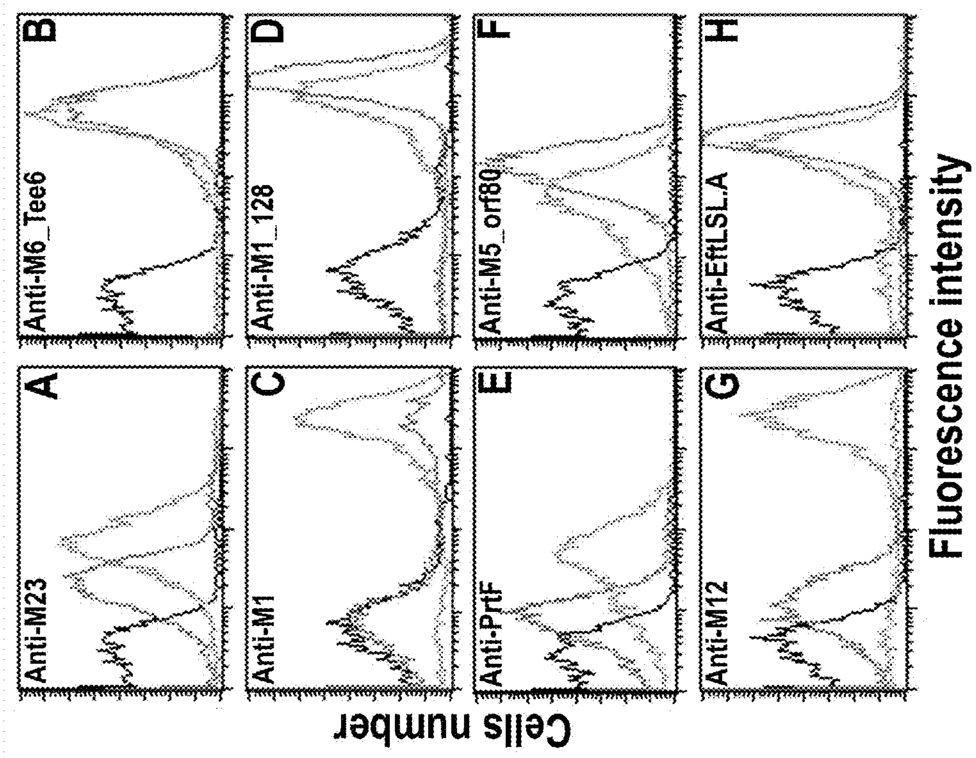

FIGS. 165 A-H: Flow cytometry of GAS bacteria treated or not with trypsin and stained with sera specific for the major pilus component. Preimmune staining; black lines, untreated bacteria; green lines and trypsin treated bacteria; blue lines. M6_ISS3650 stained with sera which recognize the M6 protein (A) or anti-M6_T6 (B), M1_SF370 stained with anti-M1 (C) or anti-M1__128 (D), M5_ISS4883 stained with anti-PrtF (E) or anti-M5_orf80 (F) and M12__20010296 with anti-M12 (G) or anti-EftLSL.A (H)

FIGS. 166A-C: Immunoblots of recombinant pilin components with polyvalent Lancefield T-typing sera. The recombinant proteins are shown above the blot and the sera pool used is shown below the blot.

FIGS. 166D-G: Immunoblots of pilin proteins with monovalent T-typing sera. The recombinant proteins are shown below the blot and the sera used above the blot.

FIGS. 166H-I: Flow cytometry analysis of strain M1_SF370 (H) and the deletion strain M1_SF370.DELTA.128 (I) with T-typing antisera pool T.

FIG. 167: Chart describing the number and type of sortase sequences identified within GAS AIs.

Figure 168:
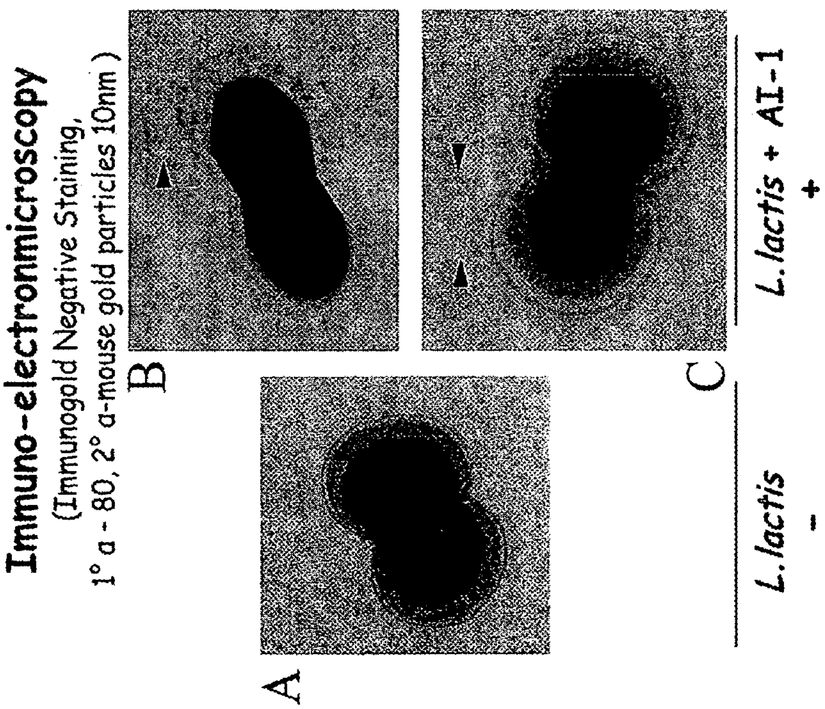

FIG. 168A: Immunogold-electronmicroscopy of *L. lactis* lacking an expression construct for GBS AI-1 using anti-GBS 80 antibodies.

FIGS. 168B-C: Immunogold-electronmicroscopy detects GBS 80 in oligomeric (pilus) structures on surface of *L. lactis* transformed to express GBS AI-1

Figure 169:
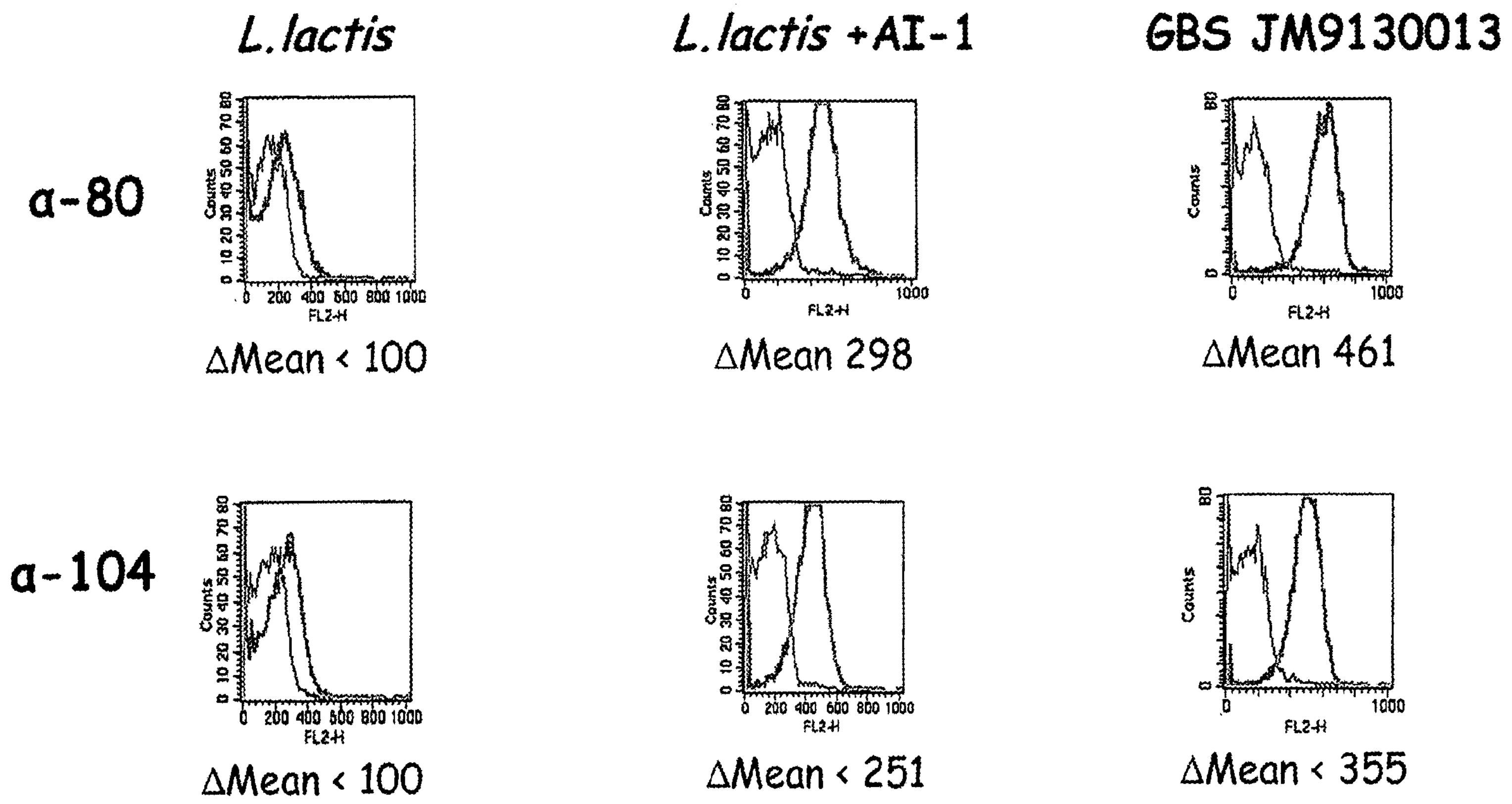

FIG. 169: FACS analysis detects expression of GBS 80 and GBS 104 on the surface of *L. lactis* transformed to express GBS AI-1.

Figure 170:
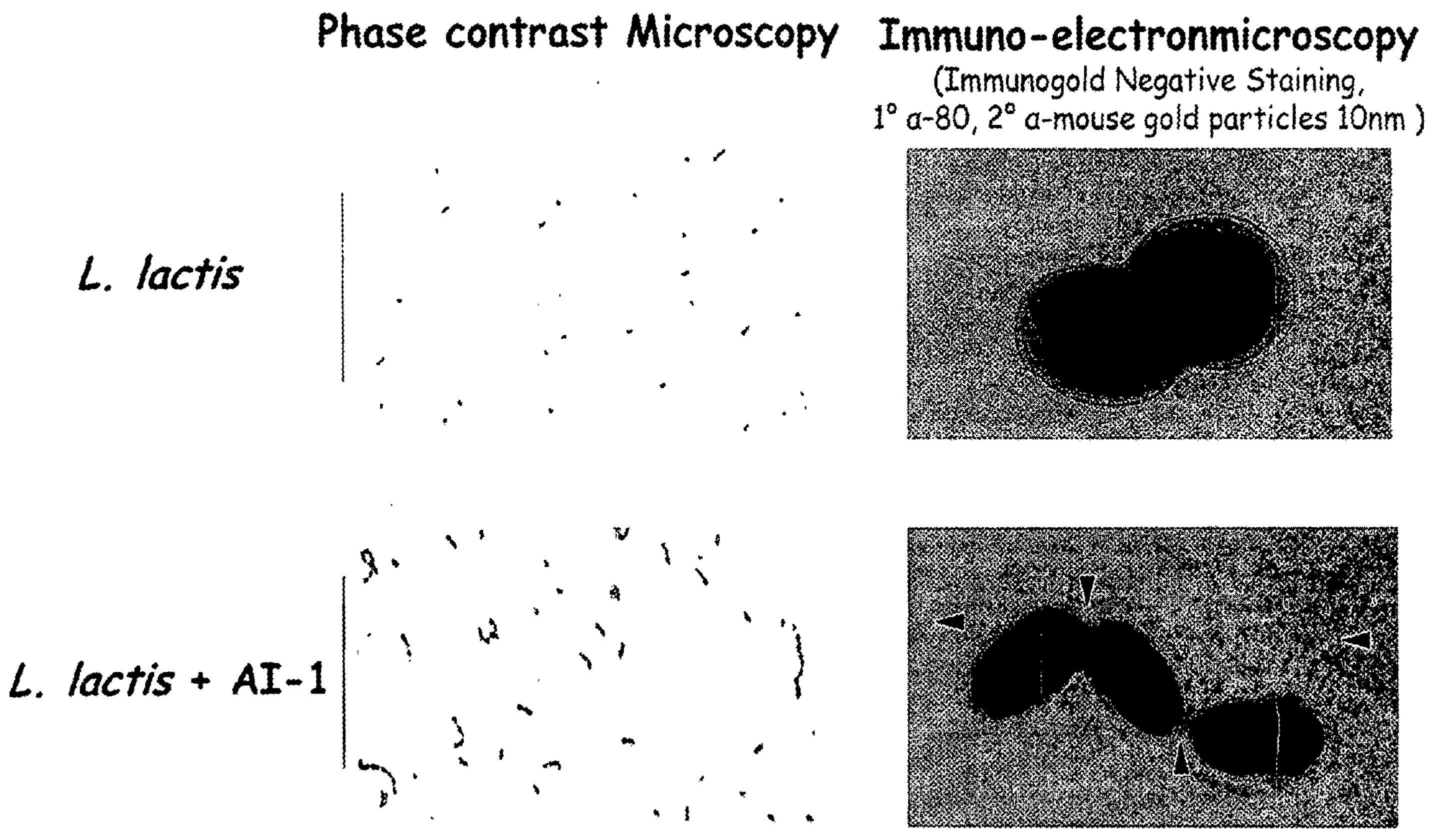

FIG. 170: Phase contrast microscopy and immuno-electronmicroscopy shows that expression of GBS AI-1 in *L. lactis* induces *L. lactis* aggregation.

Figure 171:
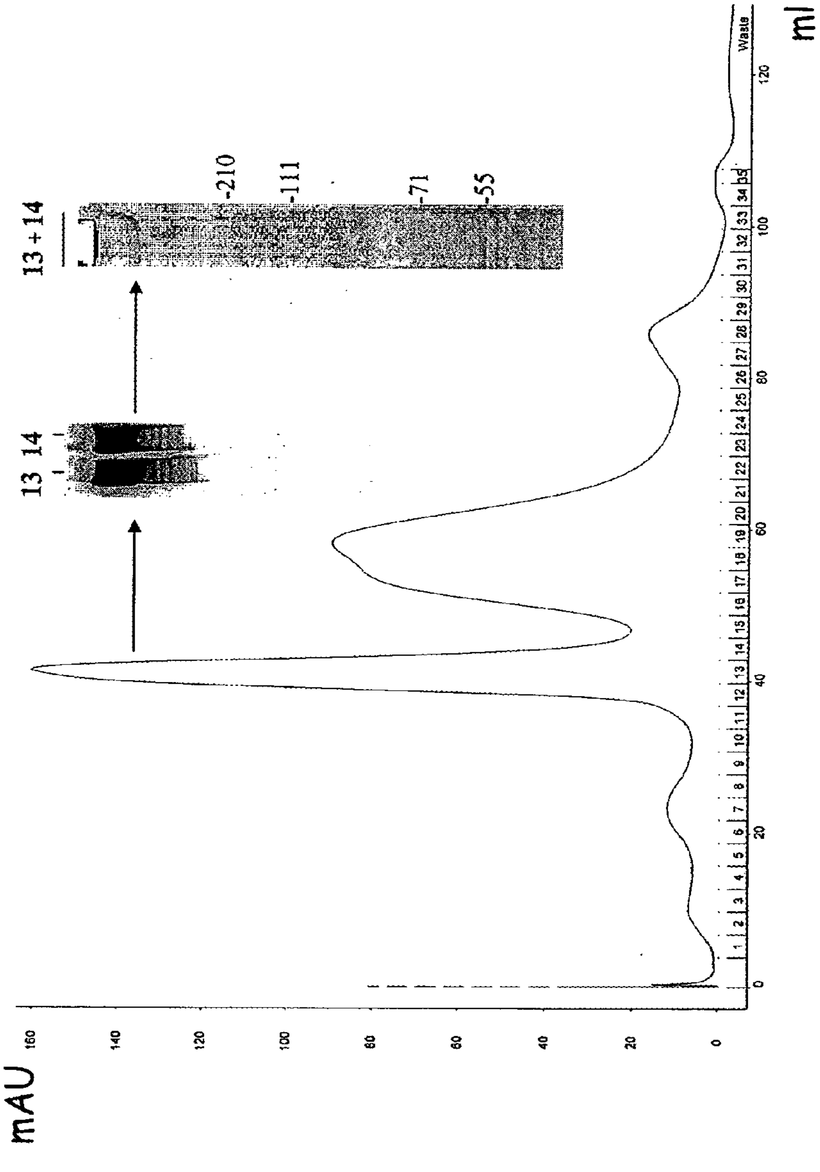

FIG. 171: Purification of GBS pili from *L. lactis* transformed to express GBS AI-1.

Figure 172:
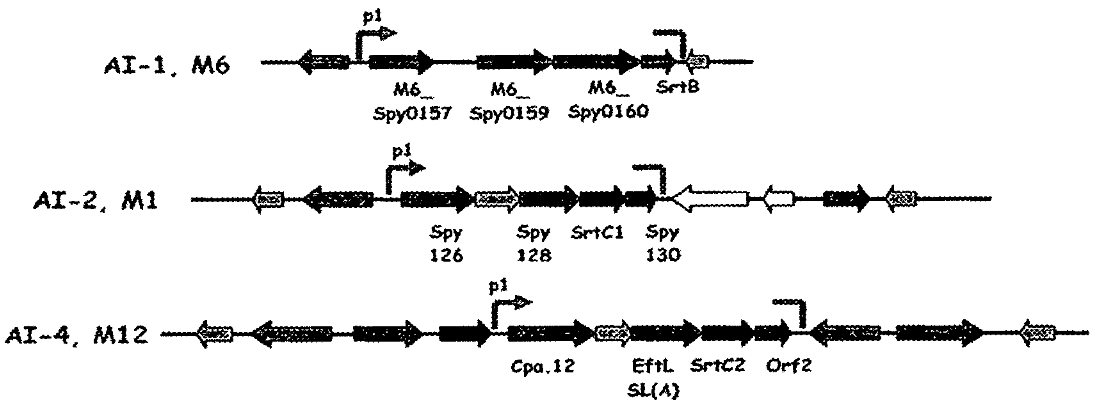

FIG. 172: Schematic depiction of GAS M6 (AI-1), M1 (AI-2), and M12 (AI-4) adhesin islands and portions of the adhesin islands inserted in the pAM401 construct for expression in *L. lactis*.

Figure 173:
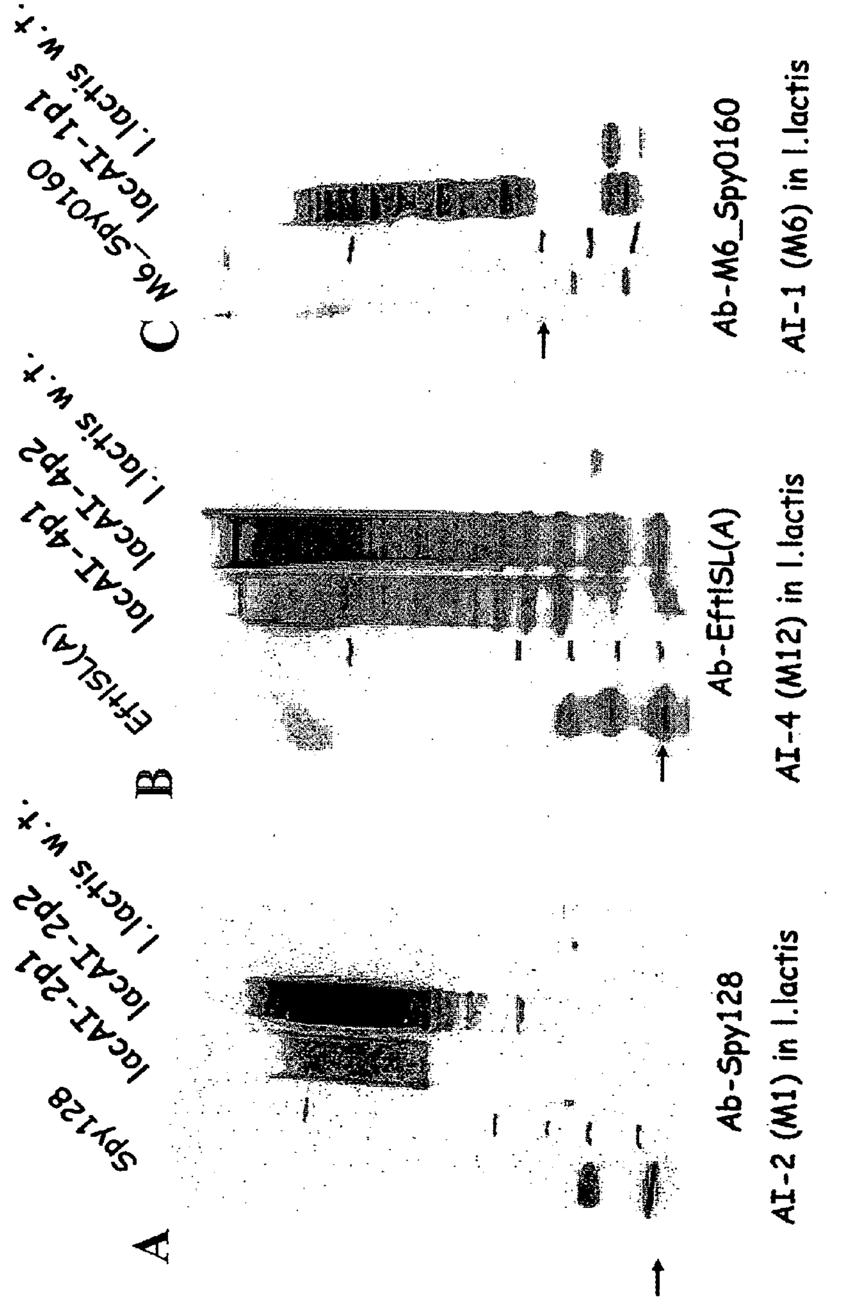

FIG. 173 A-C: Western blot analysis showing assembly of GAS pili in *L. lactis* expressing GAS AI-2 (M1) (A), GAS AI-4 (M12) (B), and GAS AI-1 (M6) (C).

Figure 174:
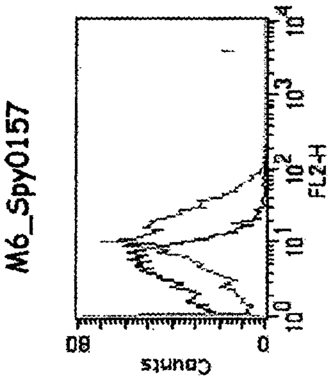

FIG. 174: FACS analysis of GAS serotype M6 for M6_Spy0157 surface expression.

Figure 175:
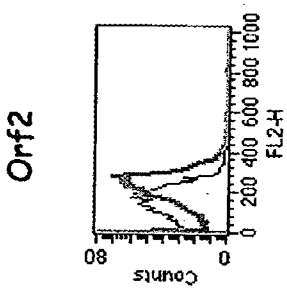

FIG. 175: FACS analysis of GAS serotype M12 for 19224139 surface expression.

Figure 176:
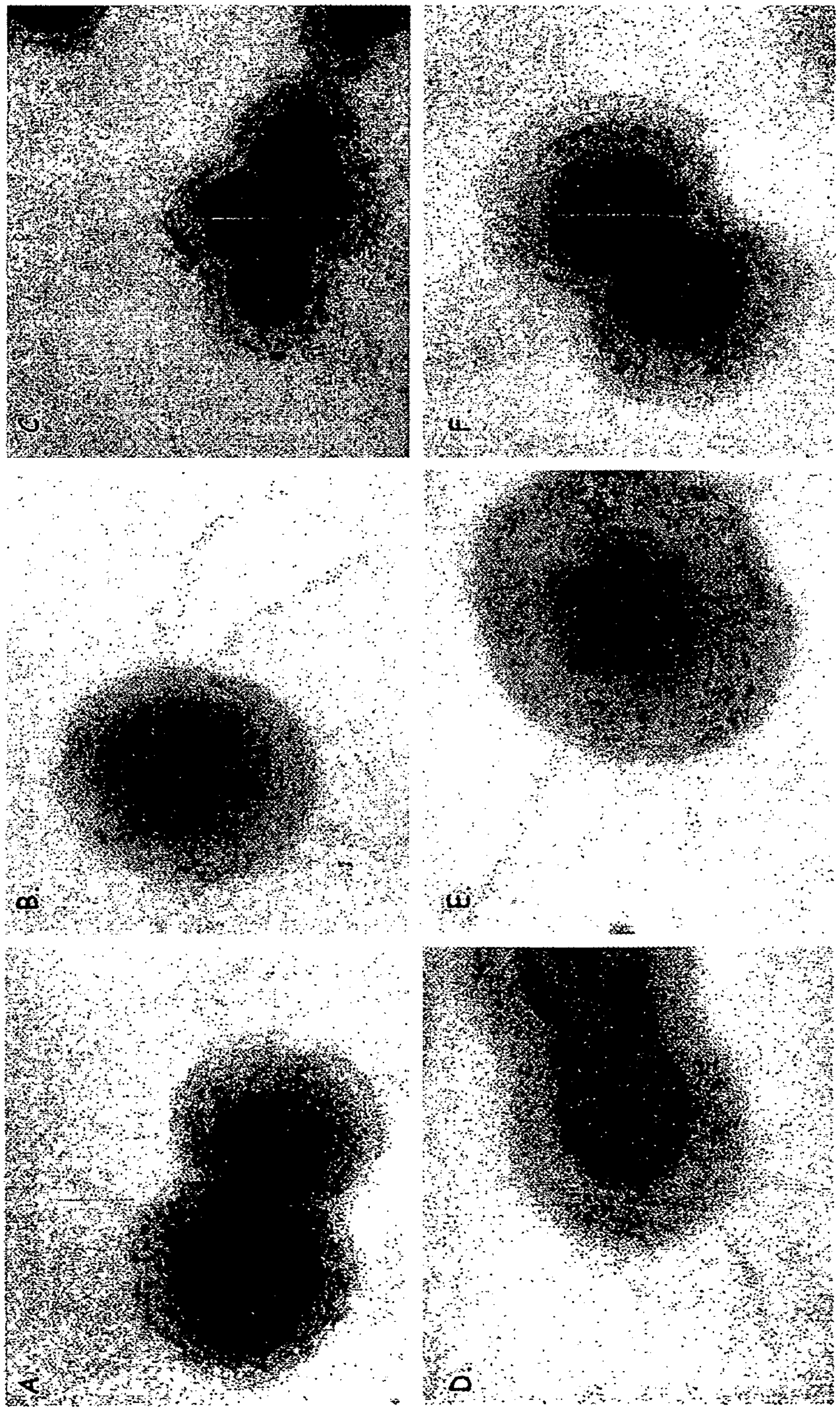

FIG. 176 A-E: Immunogold electron microscopy using antibodies against M6_Spy0160 detects pili on the surface of M6 strain 2724.

FIG. 176 F: Immunogold electron microscopy using antibodies against M6_Spy0159 detects M6_Spy0159 surface expression on M6 strain 2724.

Figure 177:
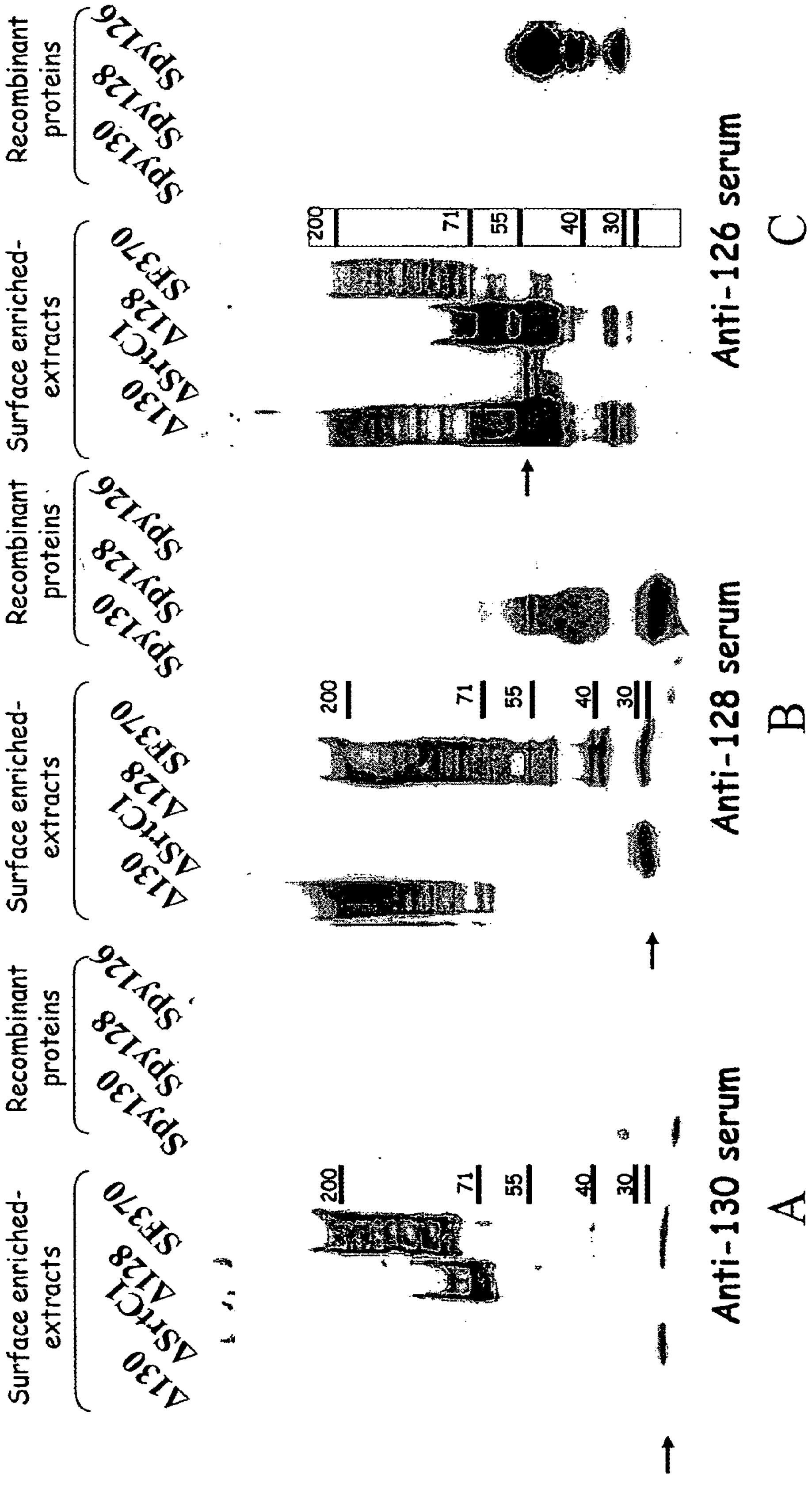

FIGS. 177 A-C: Western blot analysis of M1 strain SF370 GAS bacteria individually deleted for M1__130, SrtC1, or M1__128 using anti-M1__130 serum (A), anti-M1__128 serum (B), and anti-M1__126 serum (C).

FIGS. 178A-C: Immunogold electron microscopy using antibodies against M1__128 to detect surface expression on wildtype strain SF370 bacteria (A), M1__128 deleted SF370 bacteria (B), and SrtC1 deleted SF370 bacteria (C).

FIGS. 179A-C: FACS analysis to detect expression of M1__1126 (A), M1__128 (B), and M1__130 (C) on the surface of wildtype SF370 GAS bacteria.

FIGS. 179D-F: FACS analysis to detect expression of M1__126 (D), M1__128 (E), and M1__130 (F) on the surface of M1__128 deleted SF370 GAS bacteria.

FIGS. 179G-I: FACS analysis to detect expression of M1__126 (G), M1__128 (H), and M1__130 (I) on the surface of SrtC1 deleted SF370 GAS bacteria.

Figure 180:
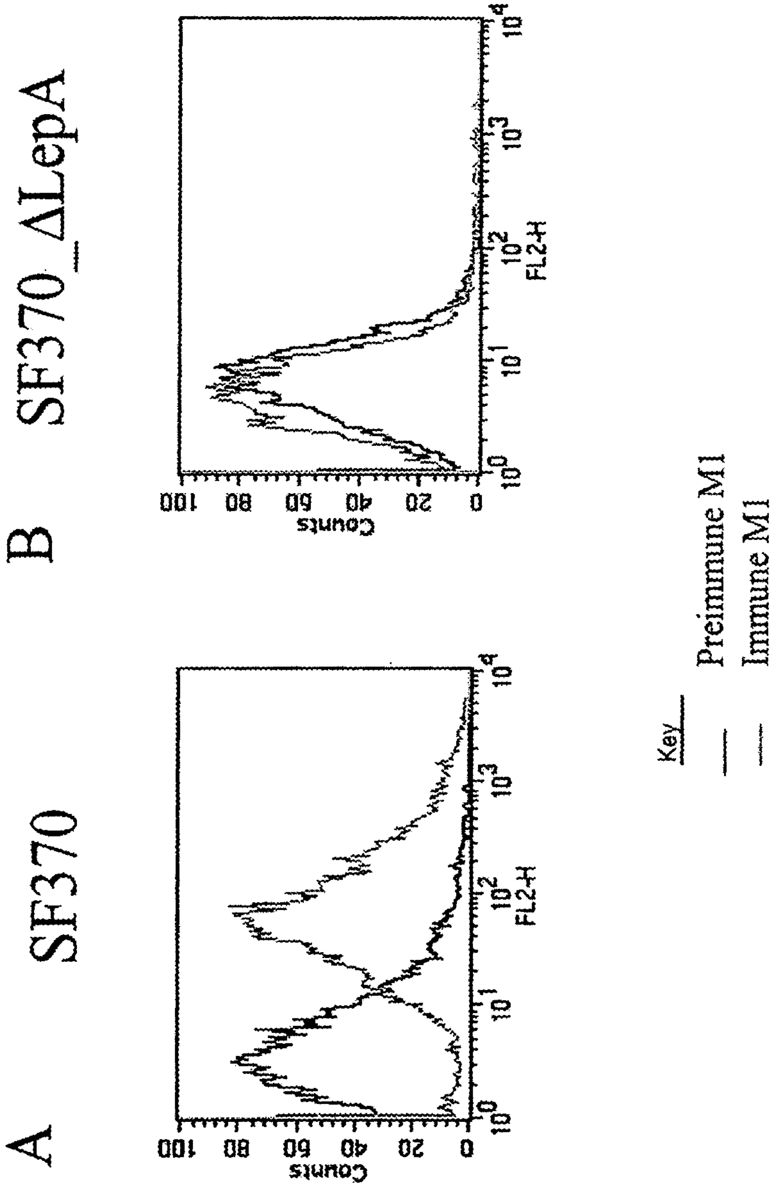

FIGS. 180A-B: FACS analysis of wildtype (A) and LepA deletion mutant (B) strains of SF370 bacteria for M1 surface expression.

Figure 181:
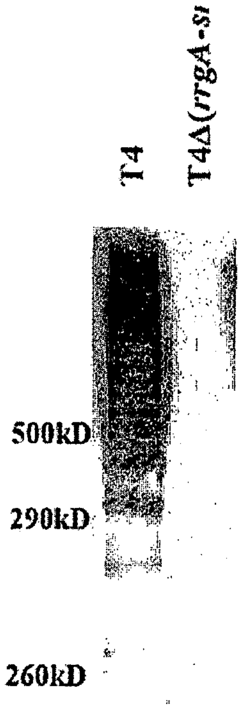

FIG. 181: Western blot analysis detects high molecular weight polymers in *S. pneumoniae* TIGR4 using anti-RrgB antisera.

Figure 182:
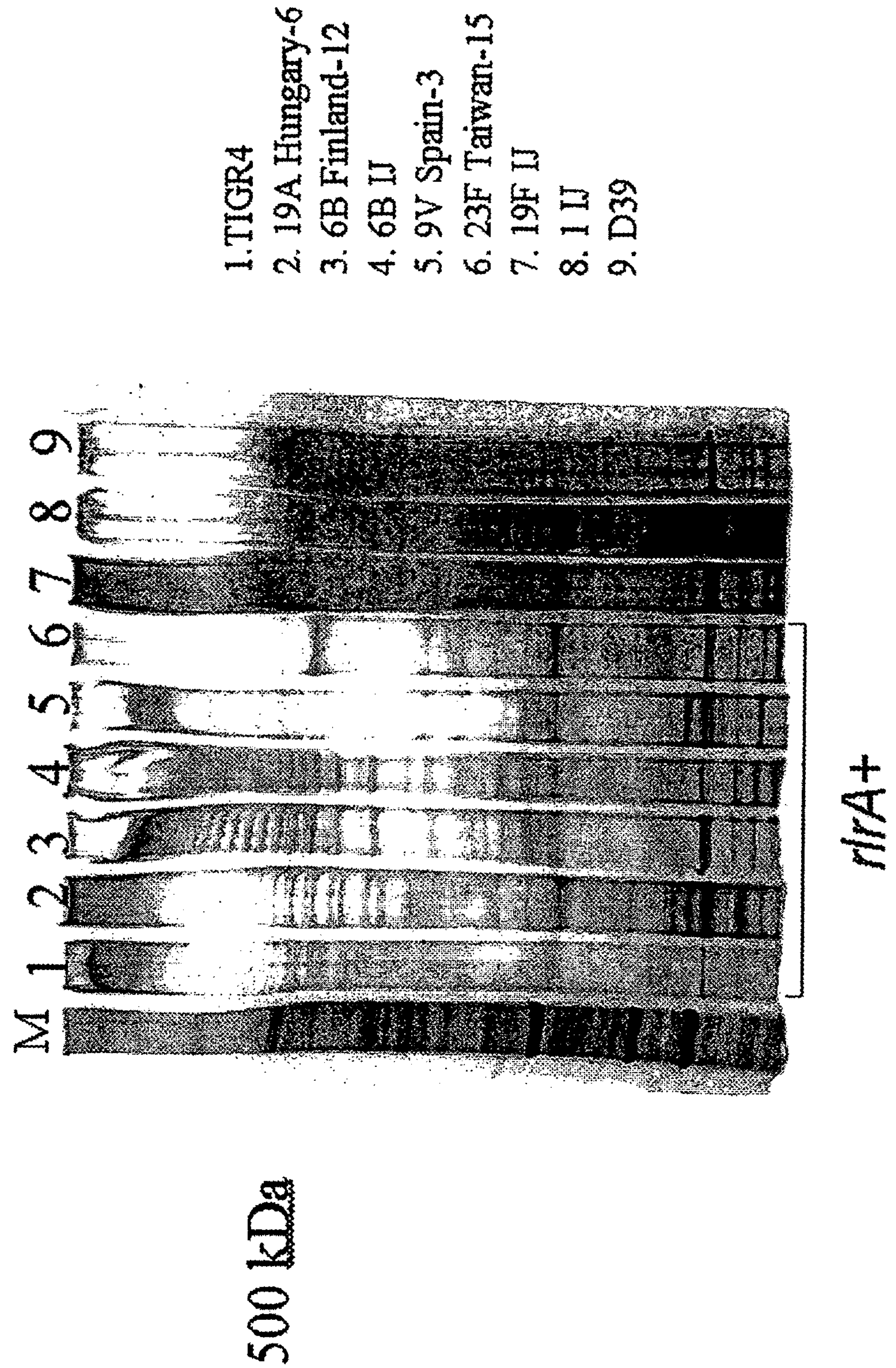

FIG. 182: Detection of high molecular weight polymers in *S. pneumoniae* rlrA positive strains.

Figure 183:
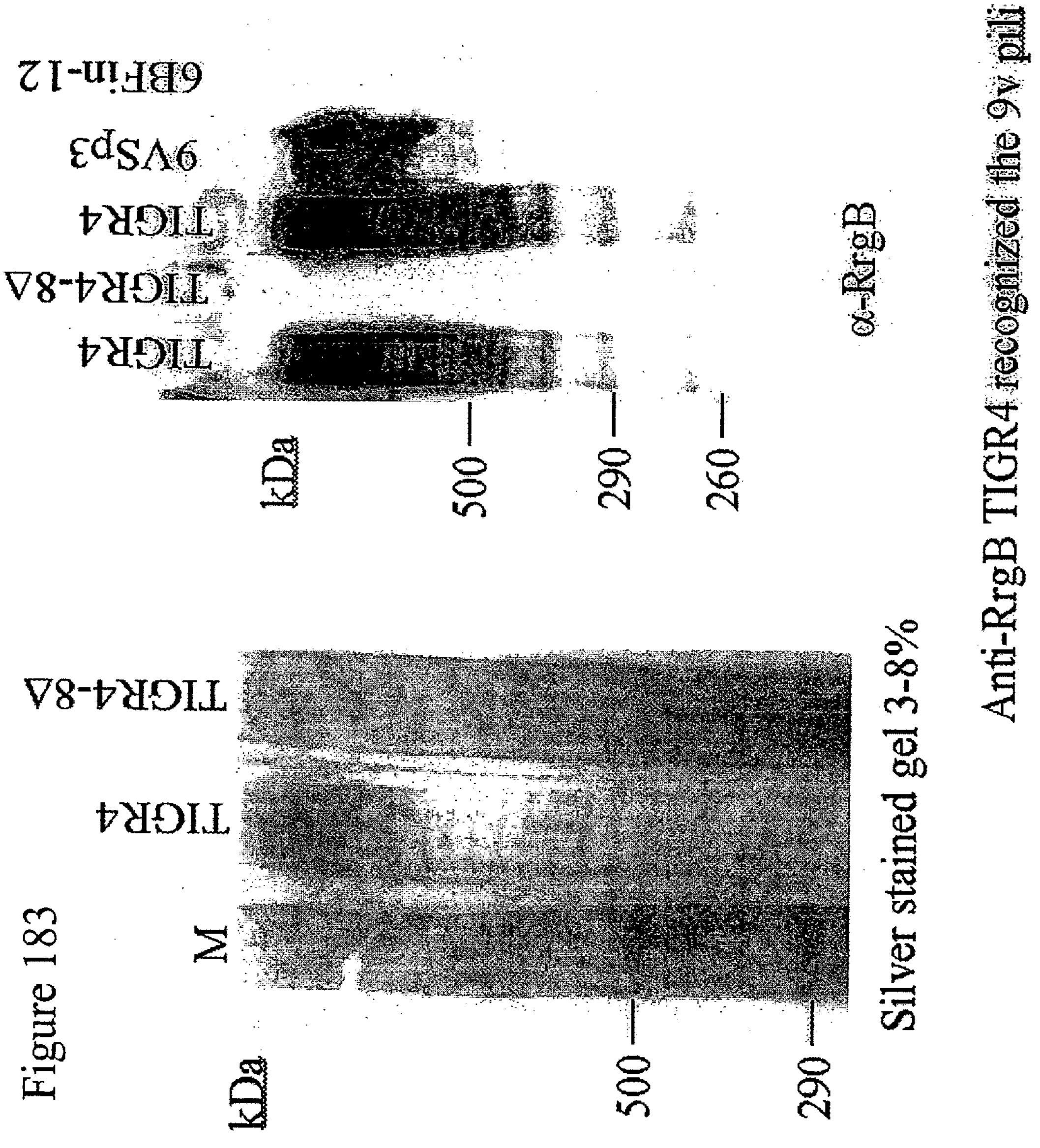

FIG. 183: Detection of high molecular weight polymers in *S. pneumoniae* TIGR4 by silver staining and Western blot analysis using anti-RrgB antisera.

Figure 184:
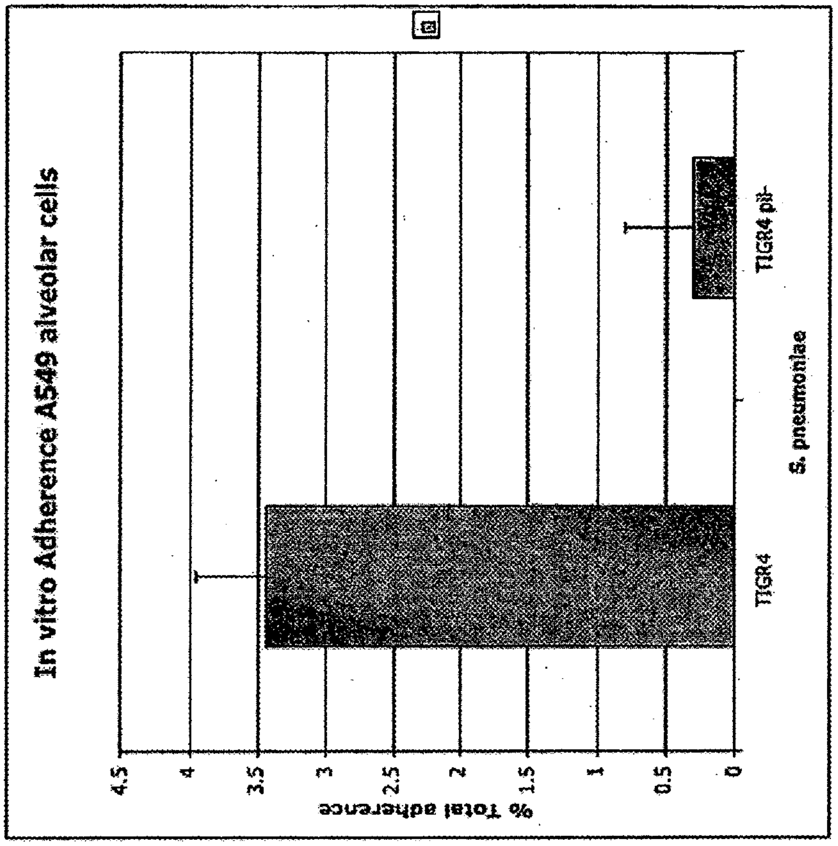

FIG. 184: Deletion of *S. pneumoniae* TIGR4 adhesin island sequences interferes with the ability of *S. pneumoniae* to adhere to A549 alveolar cells.

Figure 185:
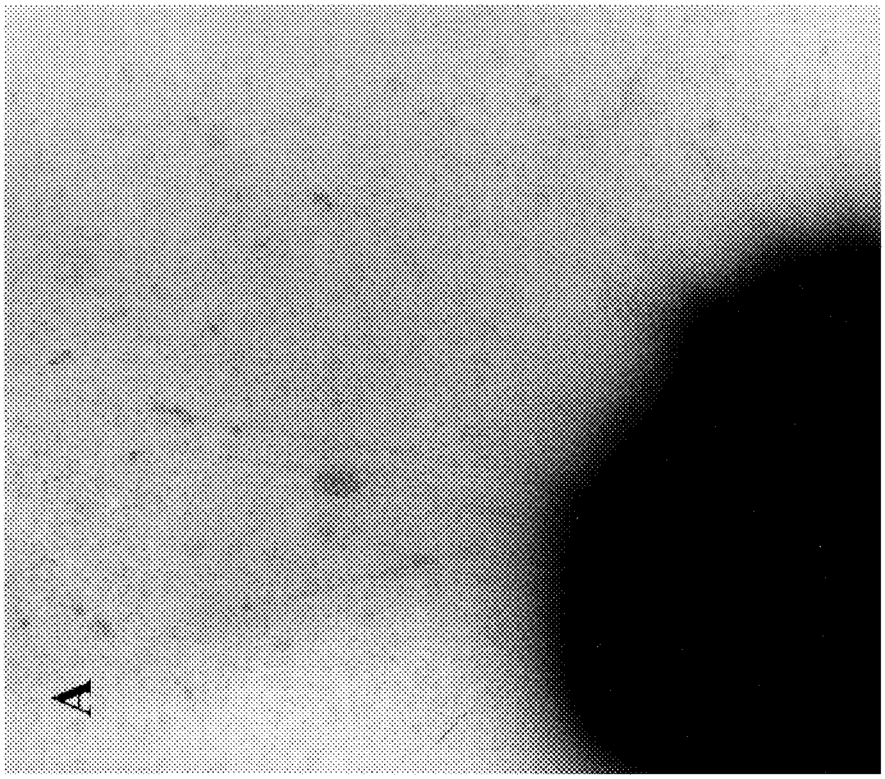

FIG. 185: Negative staining of *S. pneumoniae* strain TIGR4 showing abundant pili on the bacterial surface.

Figure 186:
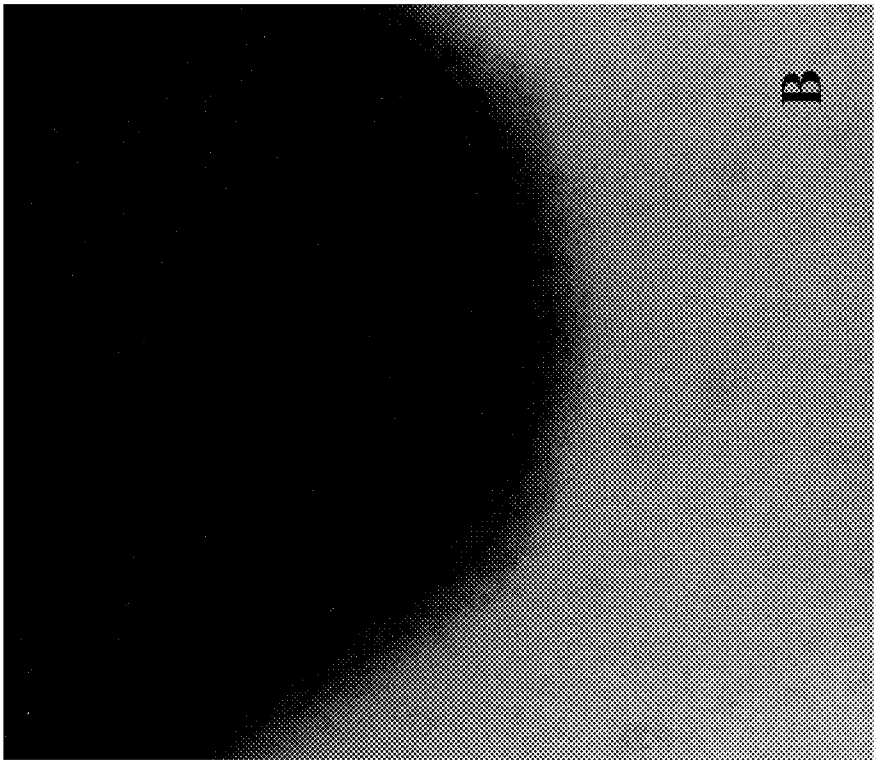
Figure 187:
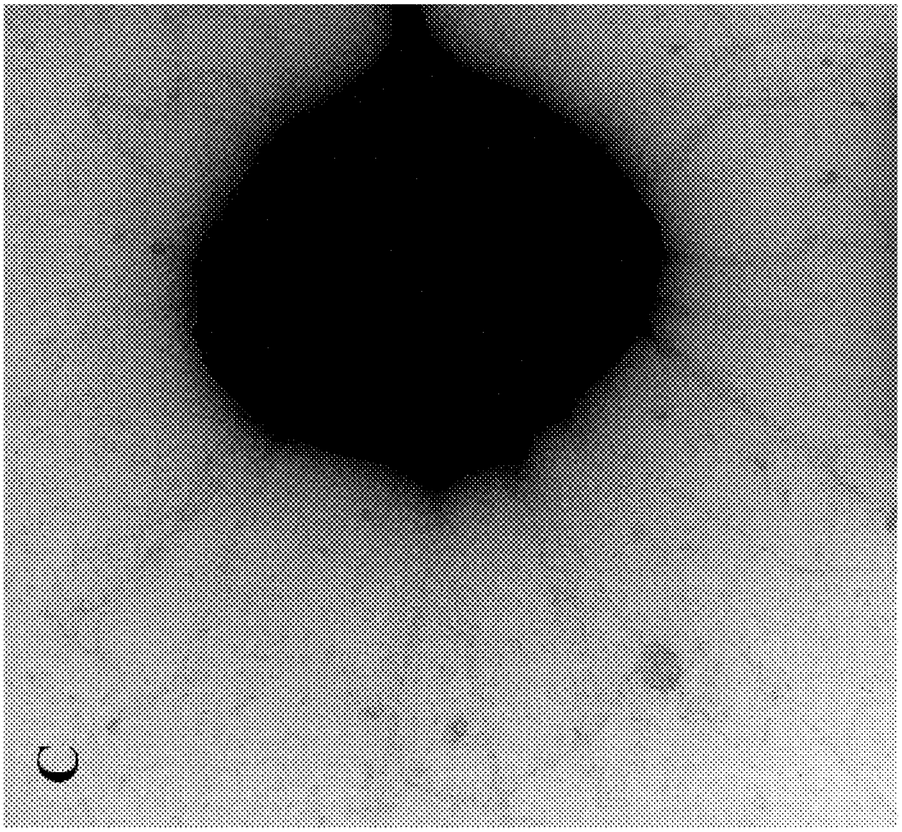

FIG. 186: Negative staining of strain TIGR4 deleted for rrgA-srtD adhesin island sequences showing no pili on the bacterial surface FIG. 187: Negative staining of the TIGR4 mgrA mutant showing abundant pili on the bacterial surface.

Figure 188:
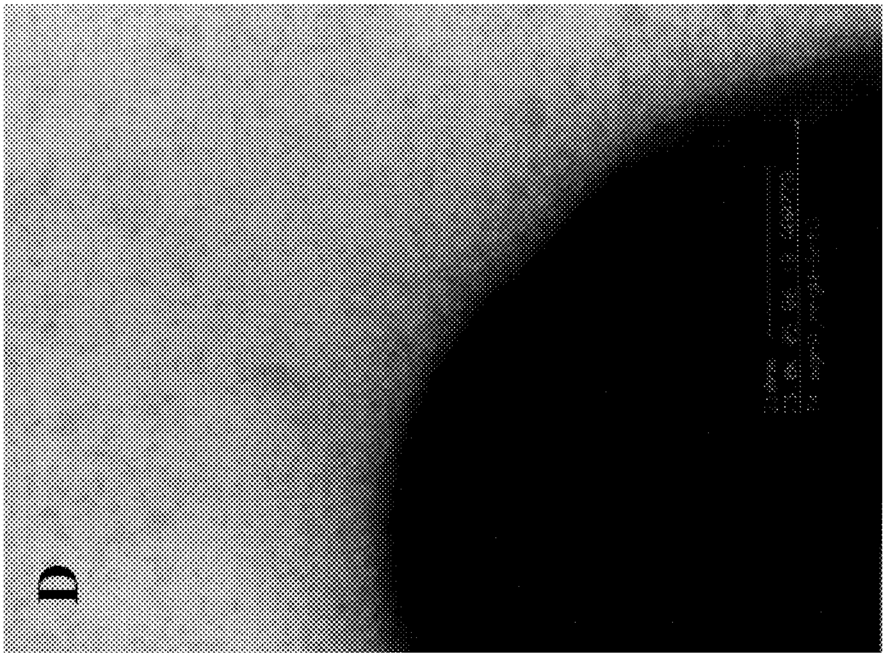

FIG. 188: Negative staining of the negative control TIGR4 mgrA mutant deleted for adhesin island sequences rrgA-srtD showing no pili on the bacterial surface.

Figure 189:
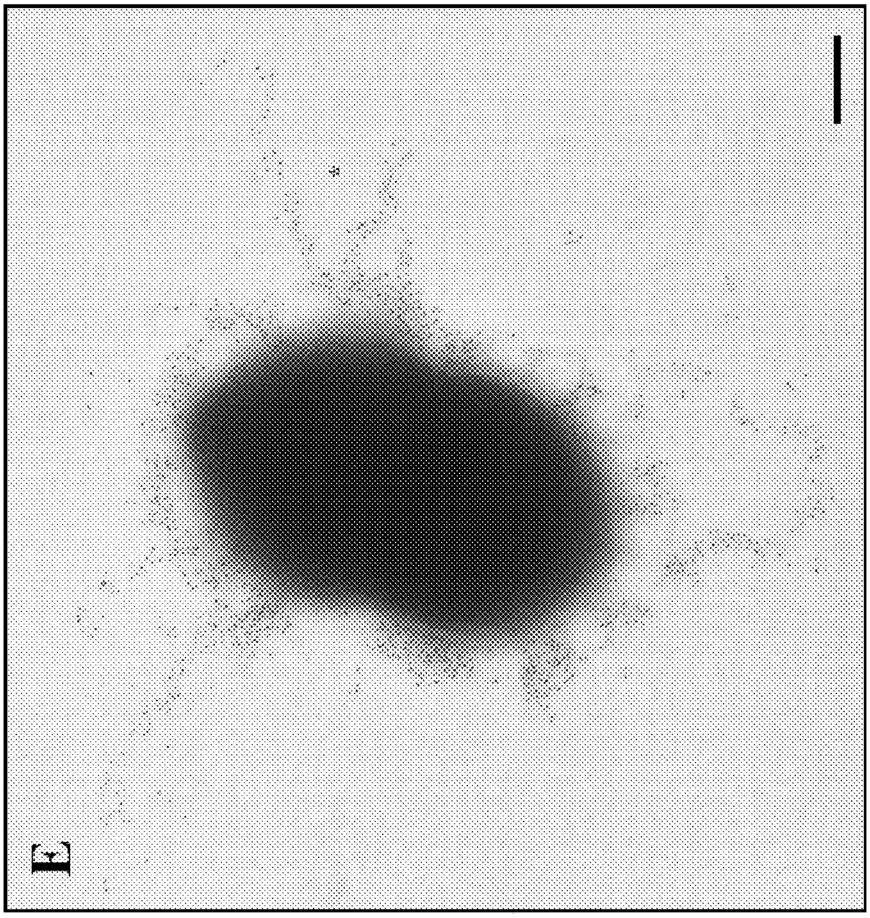

FIG. 189: Immuno-gold labeling of *S. pneumoniae* strain TIGR4 grown on blood agar solid medium using α-RrgB (5 nm) and α-RrgC (10 nm). Bar represents 200 nm.

FIGS. 190A-B: Detection of expression and purification of *S. pneumoniae* RrgA protein by SDS-PAGE (FIG. 190A) and Western blot analysis (FIG. 190B).

Figure 191:
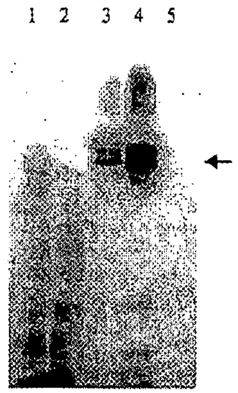

FIG. 191: Detection of RrgB by antibodies produced in mice.

Figure 192:
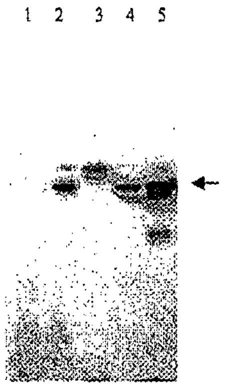

FIG. 192: Detection of RrgC by antibodies produced in mice.

Figure 193:
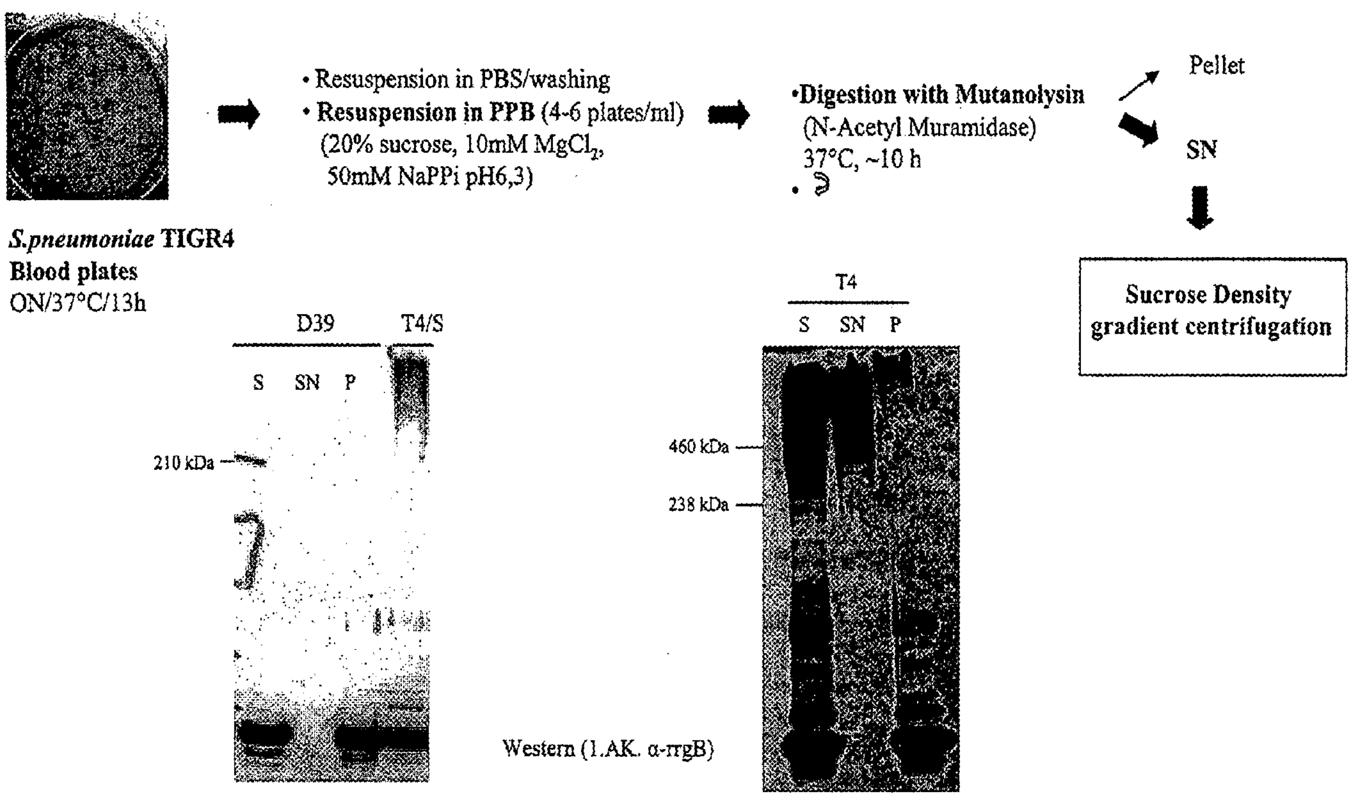

FIG. 193: Purification of *S. pneumoniae* TIGR 4 pili by a cultivation and digestion method and detection of the purified TIGR4 pili.

Figure 194:
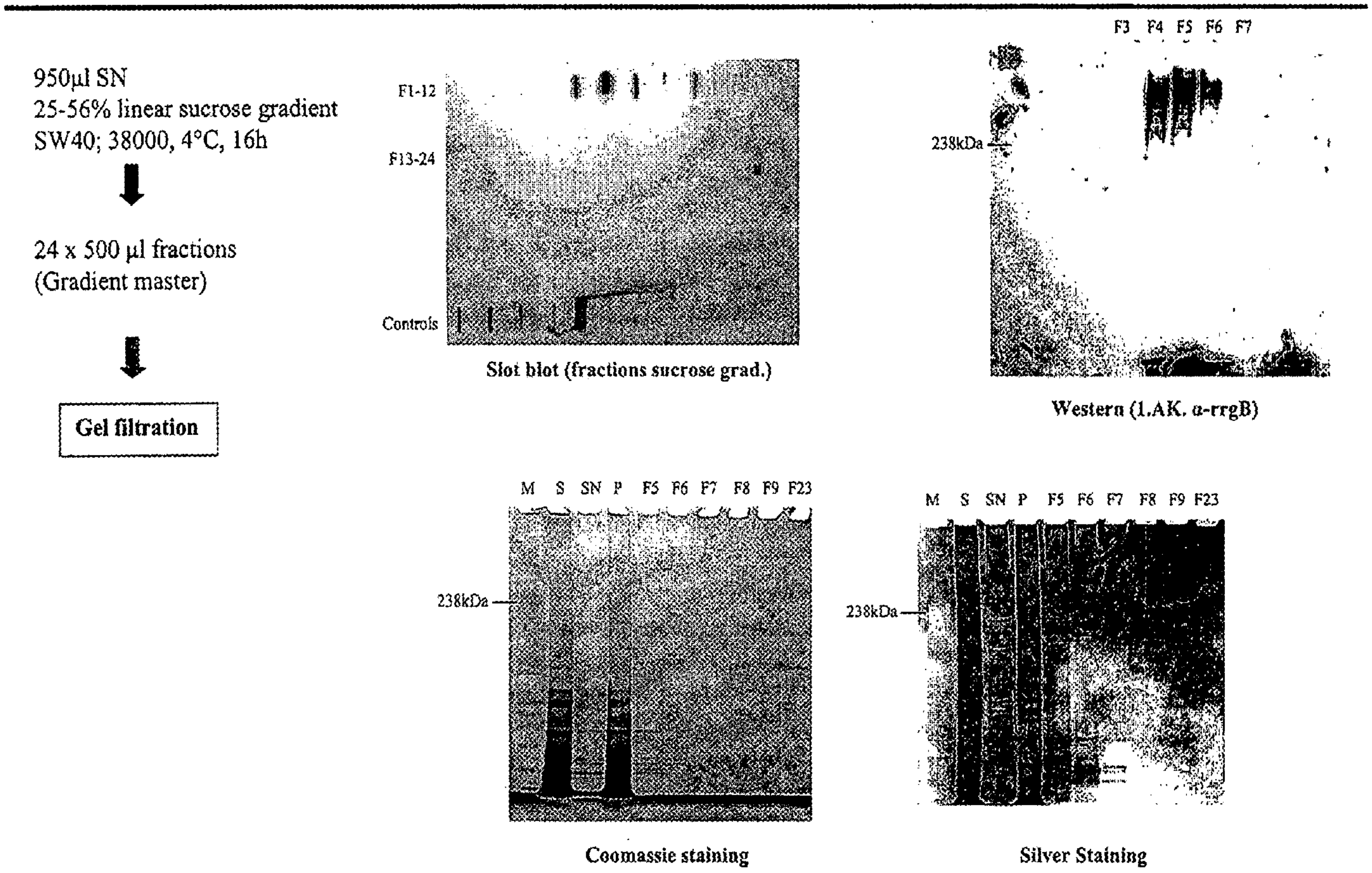

FIG. 194: Purification of *S. pneumoniae* TIGR 4 pili by a sucrose gradient centrifugation method and detection of the purified TIGR4 pili.

Figure 195:
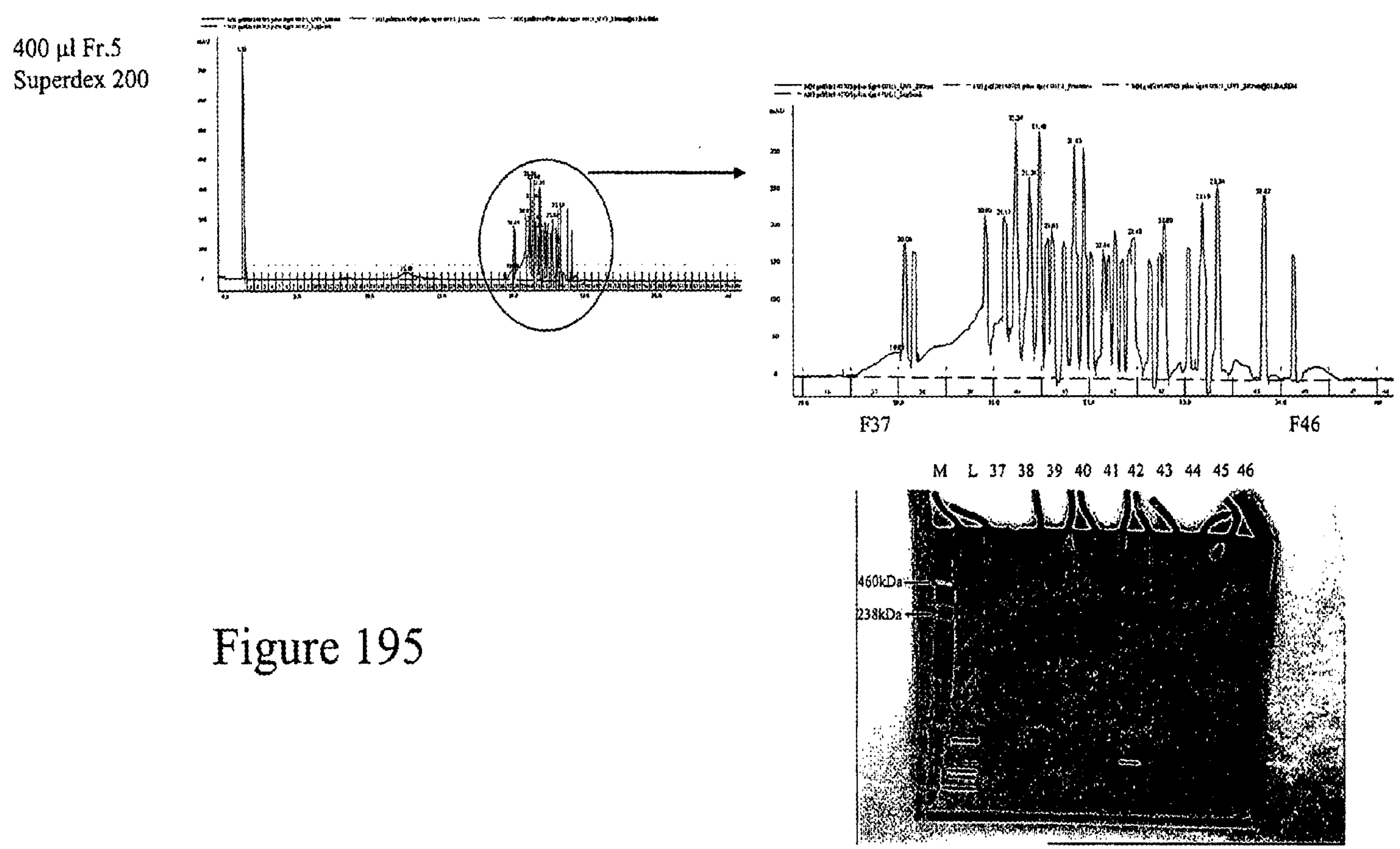

FIG. 195: Purification of *S. pneumoniae* TIGR 4 pili by a gel filtration method and detection of the purified TIGR4 pili.

FIGS. 196A-AM: Alignment of full length *S. pneumoniae* adhesin island sequences from ten *S. pneumoniae* strains. 14CSR, SEQ ID NO:495; 670, SEQ ID NO:496; 6BF, SEQ ID NO:497; 6BSP, SEQ ID NO:498; 19AH, SEQ ID NO:499; 23FPO, SEQ ID NO:500; 19FTW, SEQ ID NO:501; 9VSP, SEQ ID NO:502; TIGR4, SEQ ID NO:503; 23FTW, SEQ ID NO:504.

FIG. 197A: Schematic of GBS AI-1 coding sequences.

FIG. 197B: Nucleotide sequence of intergenic region between AraC and GBS 80 (SEQ ID NO:505).

FIG. 197C: FACS analysis results for GBS 80 expression in GBS strains having different length polyA tracts in the intergenic region between AraC and GBS 80. LPXTG, SEQ ID NO:122).

FIG. 198: Table comparing the percent identity of surface proteins encoded by a serotype M6 (harbouring a GAS AI-1) adhesin island relative to other GAS serotypes harbouring an adhesin island.

FIG. 199: Table comparing the percent identity of surface proteins encoded by a serotype M1 (harbouring a GAS AI-2) adhesin island relative to other GAS serotypes harbouring an adhesin island.

FIG. 200: Table comparing the percent identity of surface proteins encoded by serotypes M3, M18, M5, and M49 (harbouring GAS AI-3) adhesin islands relative to other GAS serotypes harbouring an adhesin island.

FIG. 201: Table comparing the percent identity of surface proteins encoded by a serotype M12 (harbouring a GAS AI-1) adhesin island-relative to other GAS serotypes harbouring an adhesin island.

Figure 202:
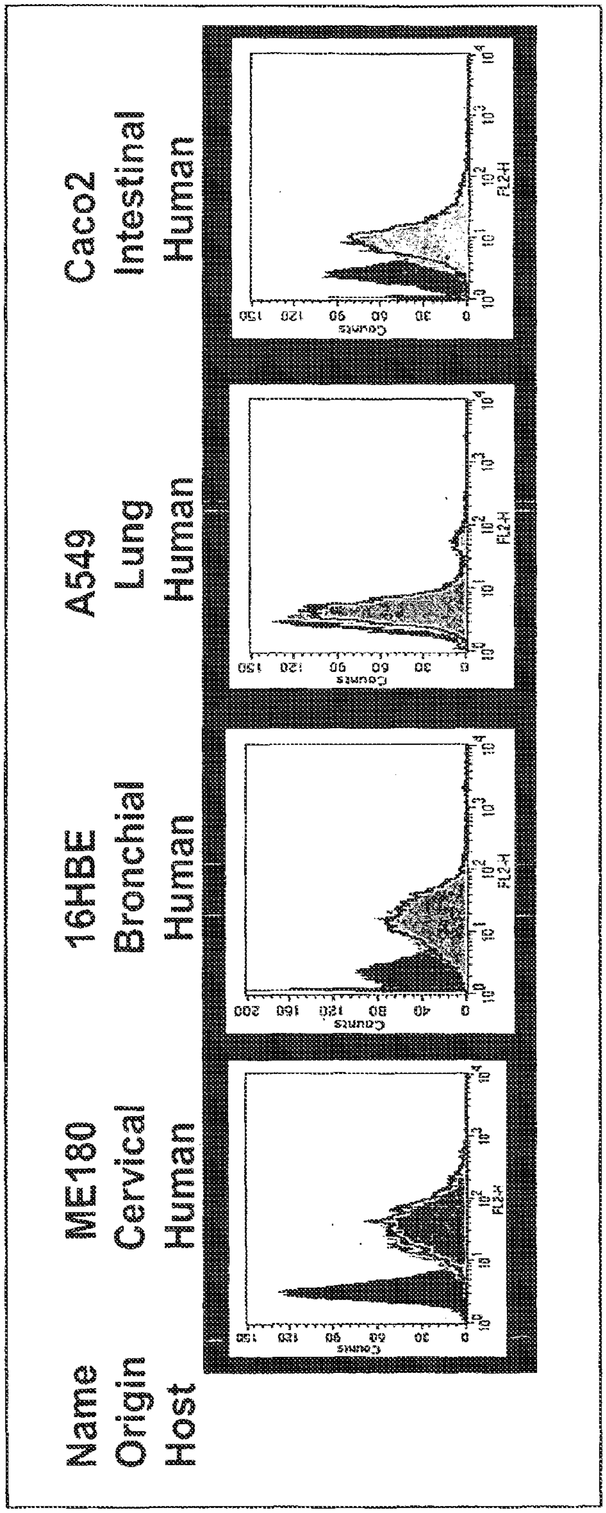

FIG. 202: GBS 80 recombinant protein does not bind to epithelial cells. Epithelial cells were incubated in the presence or absence of GBS80 protein and then a mouse anti-GBS80 polyclonal antibody was added. The cells were then stained with FITC-conjugated anti-mouse IgG antibody. The violet area indicates cells treated with FITC-conjugated antibody alone. GBS80 binding, expressed as Dmean channel values, was measured by FACScan cytometer as difference in fluorescence intensity between cells incubated with or without GBS80. The same protocol was used for GBS104 protein binding to epithelial cells.

Figure 203:
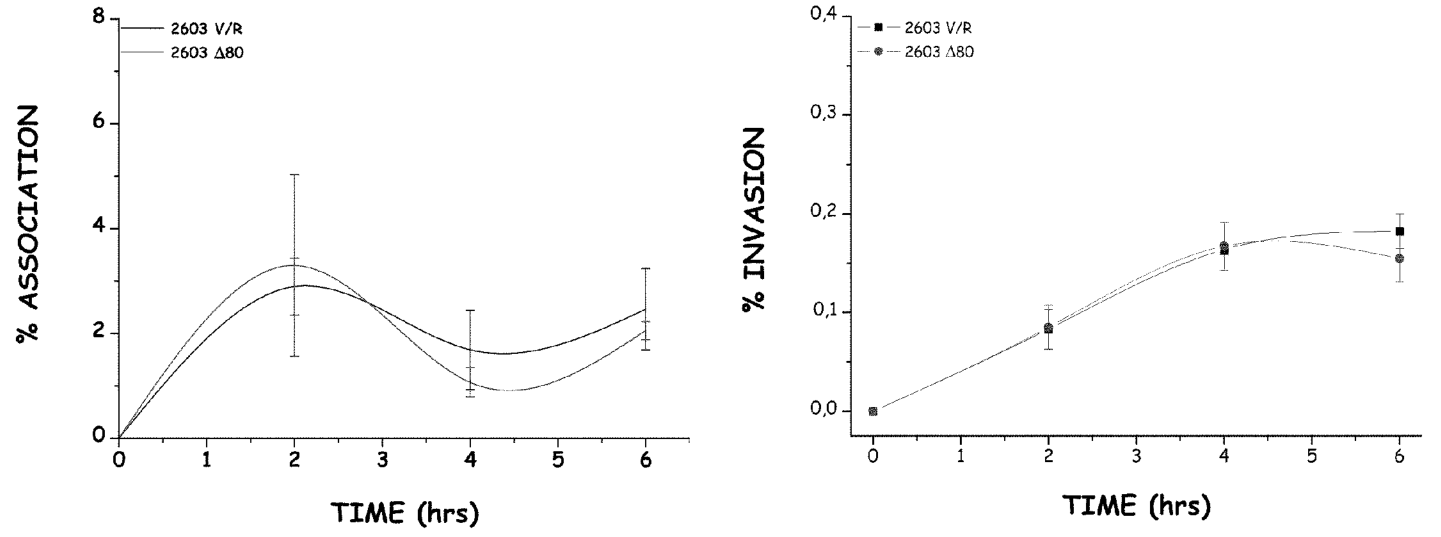

FIG. 203: Deletion of GBS 80 protein does not affect the ability of GBS to adhere and invade ME180 cervical epithelial cells.

Figure 204:
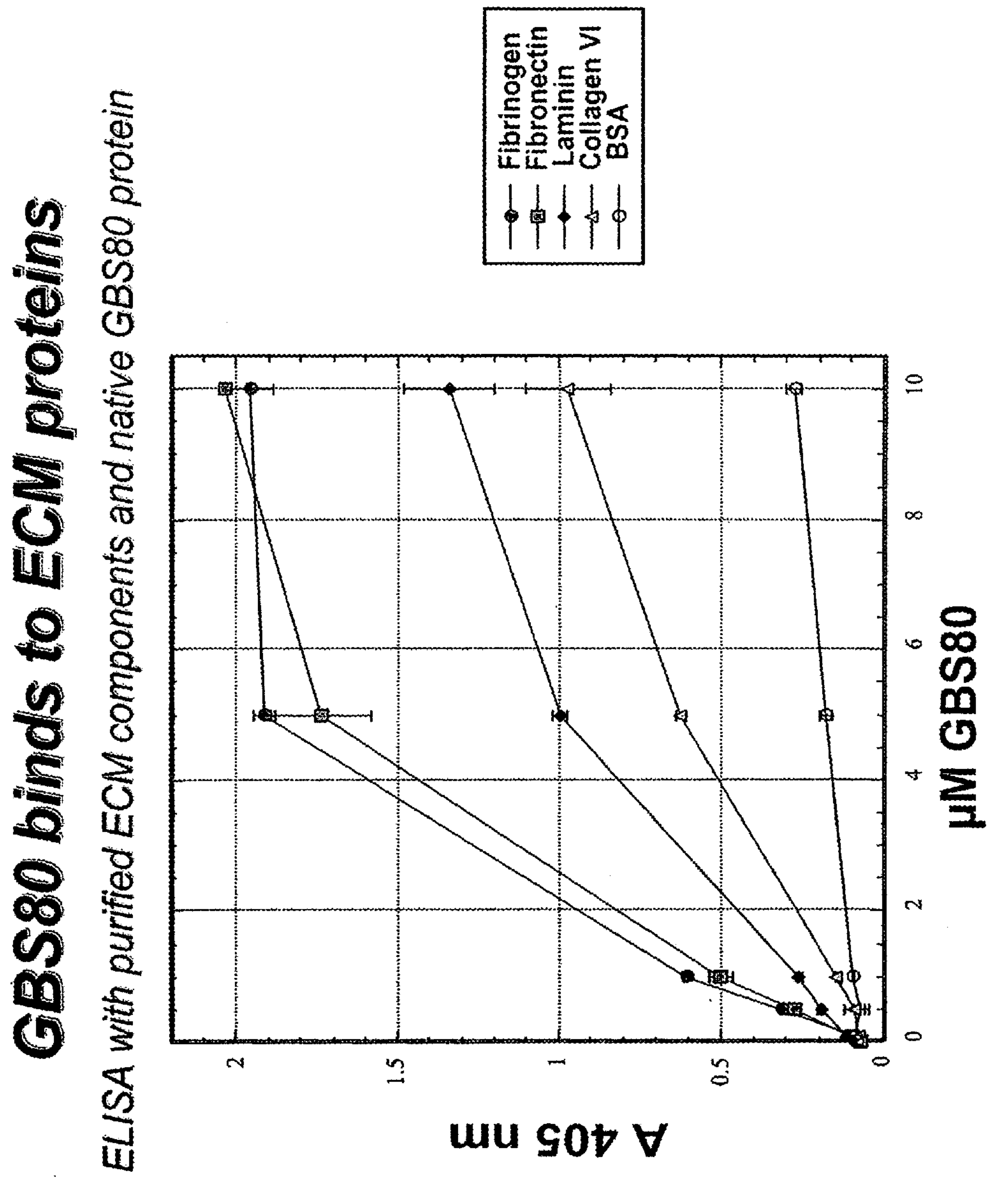

FIG. 204: GBS 80 binds to extracellular matrix proteins.

Figure 205:
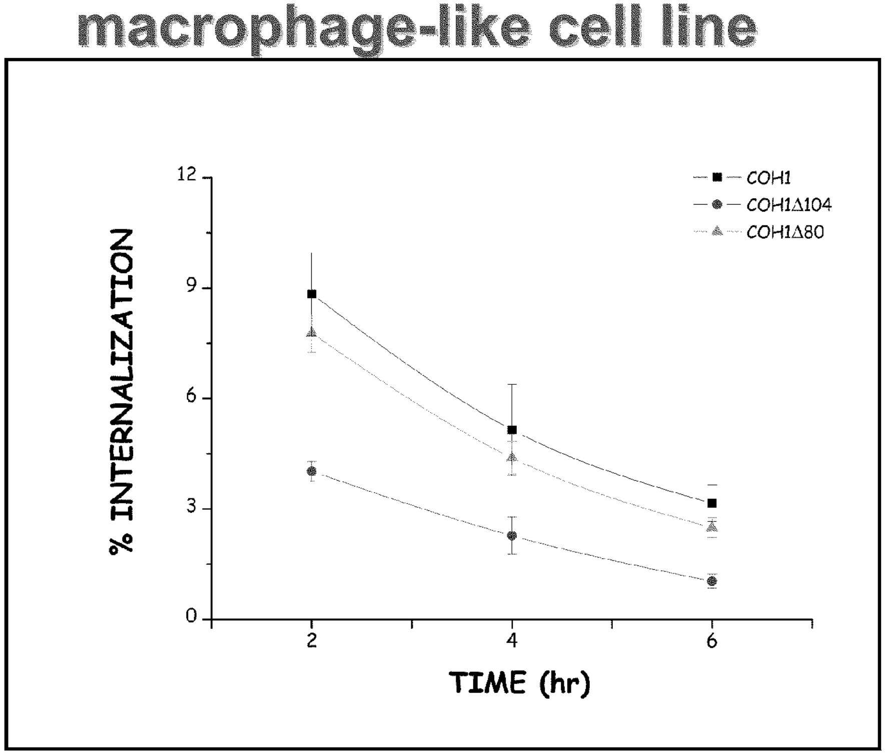
Figure 206:
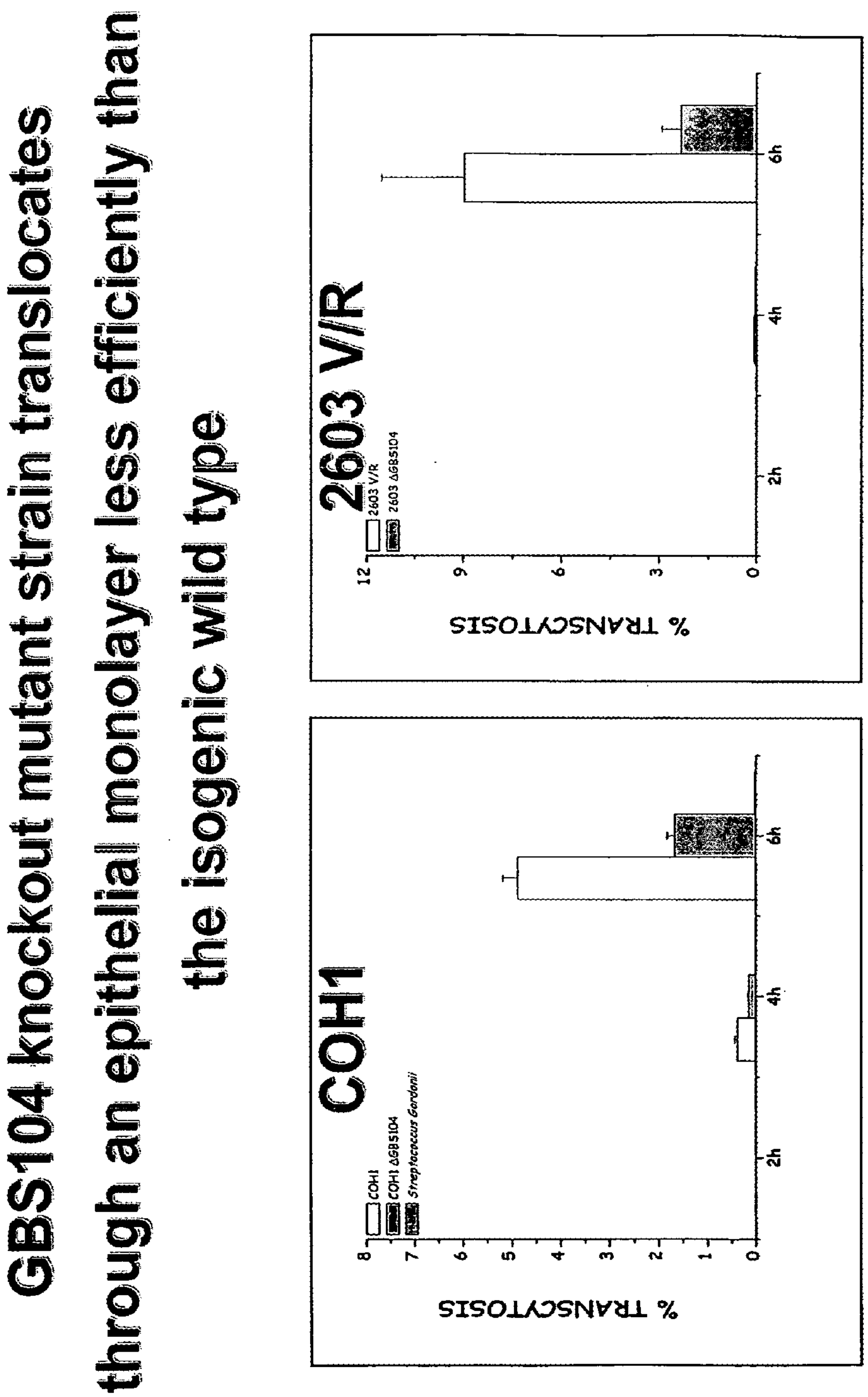

FIG. 205: Deletion of GBS 104 protein, but not GBS 80, reduces the capacity of GBS to invade J774 macrophage-like cells FIG. 206: GBS 104 knockout mutant strains of bacteria translocate through an epithelial monolayer less efficiently that the isogenic wild type strain.

Figure 207:
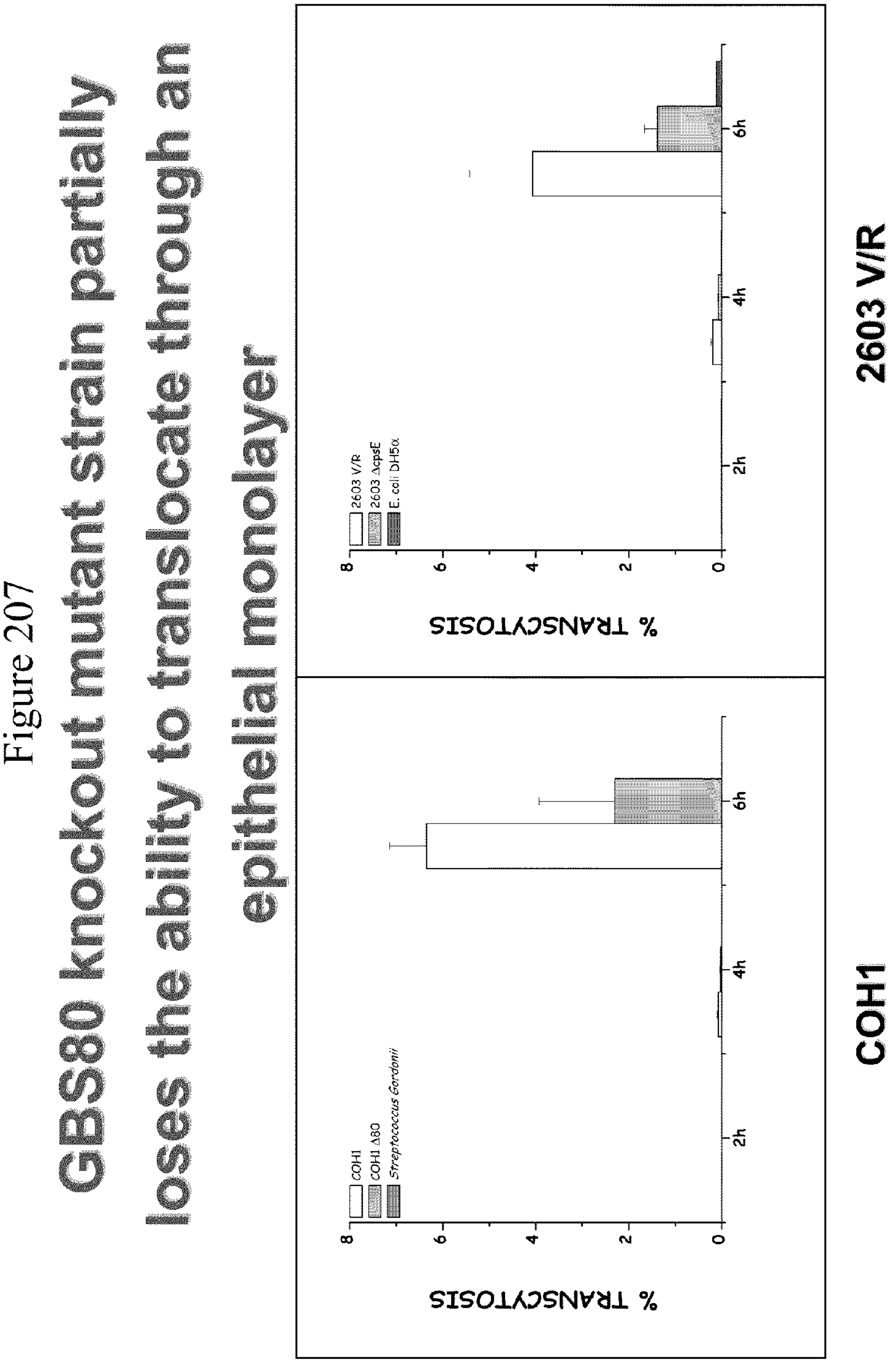

FIG. 207: GBS 80 knockout mutant strains of bacteria partially lose the ability to translocate through an epithelial monolayer.

Figure 208:
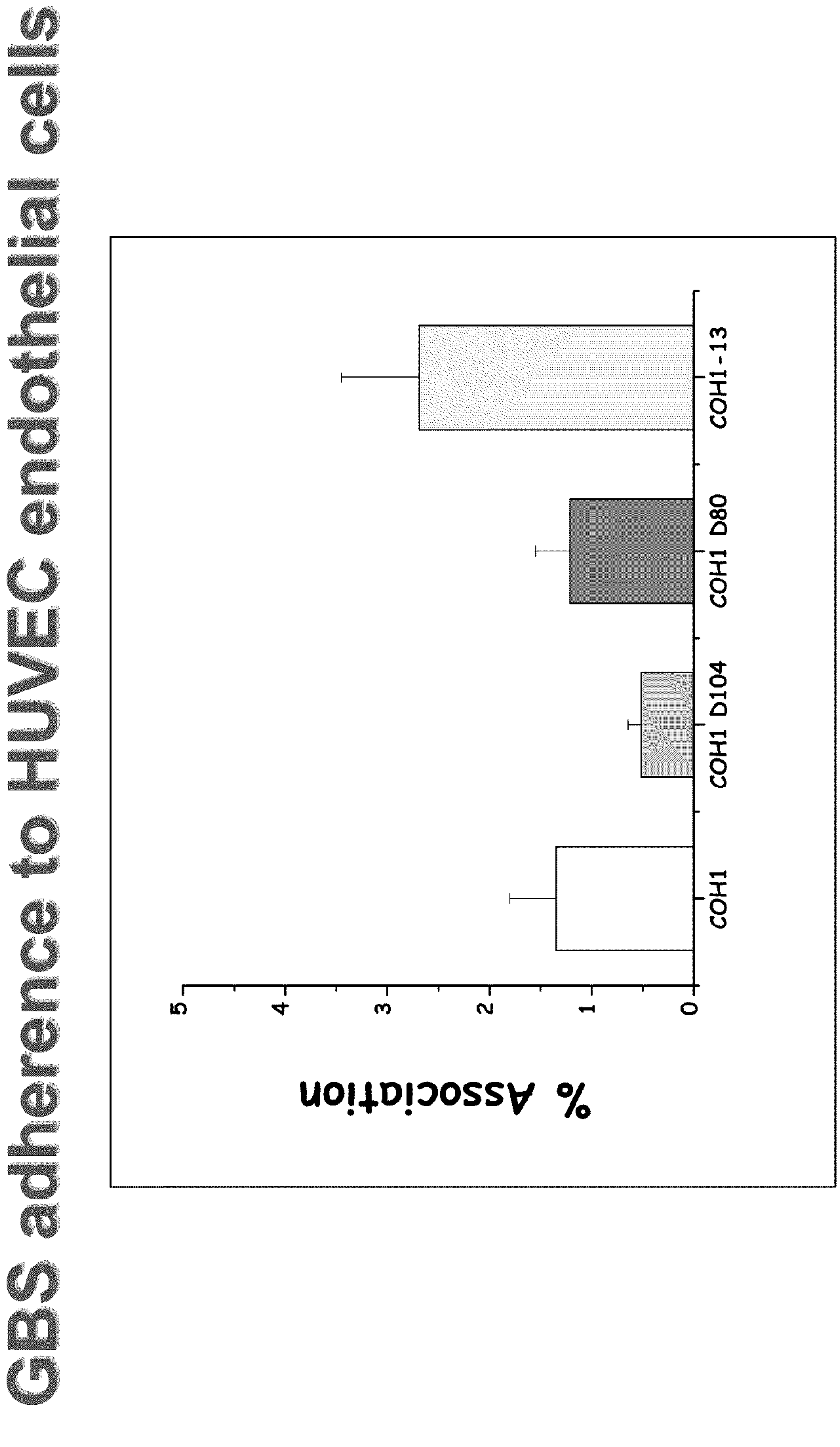

FIG. 208: GBS adherence to HUVEC endothelial cells.

Figure 209:
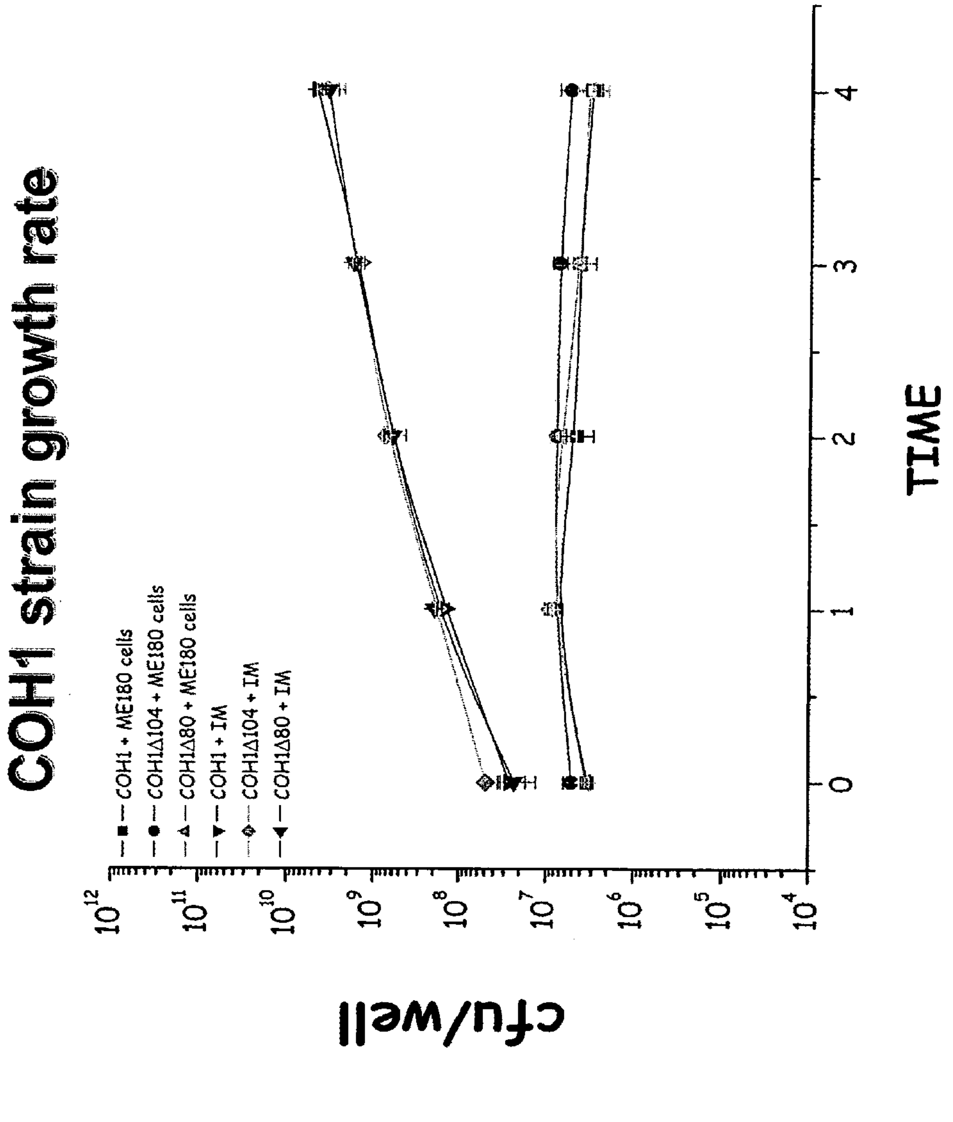

FIG. 209: Strain growth rate of wildtype, GBS 80-deleted, or GBS 104 deleted COH1 GBs.

Figure 210:
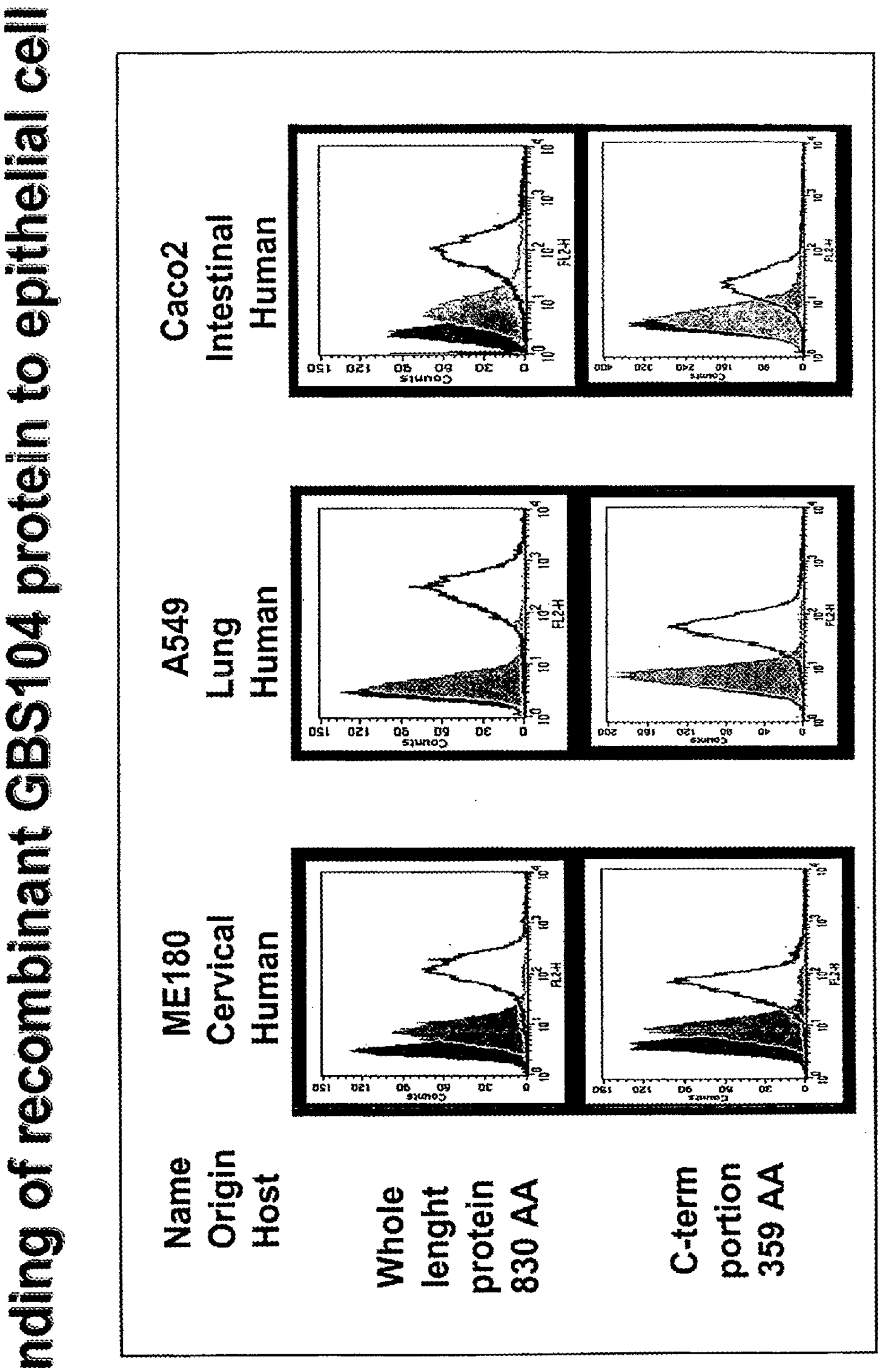

FIG. 210: Binding of recombinant GBS 104 protein to epithelial cells by FACS analysis.

Figure 211:
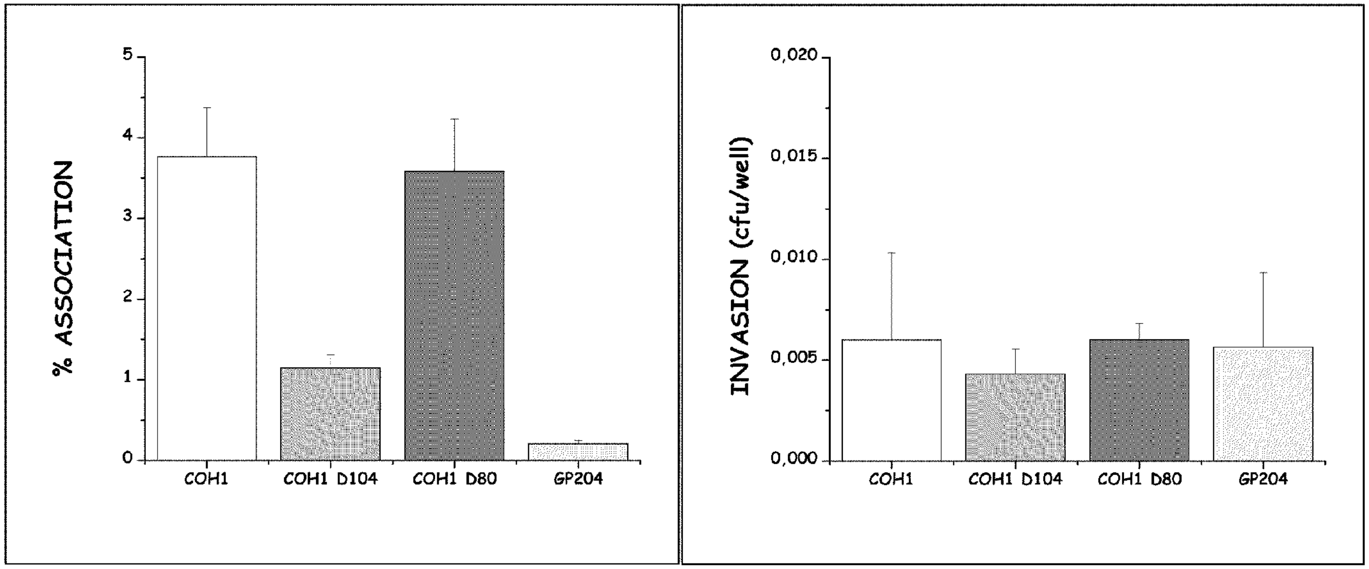

FIG. 211: Deletion of GBS 104 protein in the GBS strain COH1 reduces the ability of GBS to adhere to ME180 cervical epithelial cells.

Figure 212:
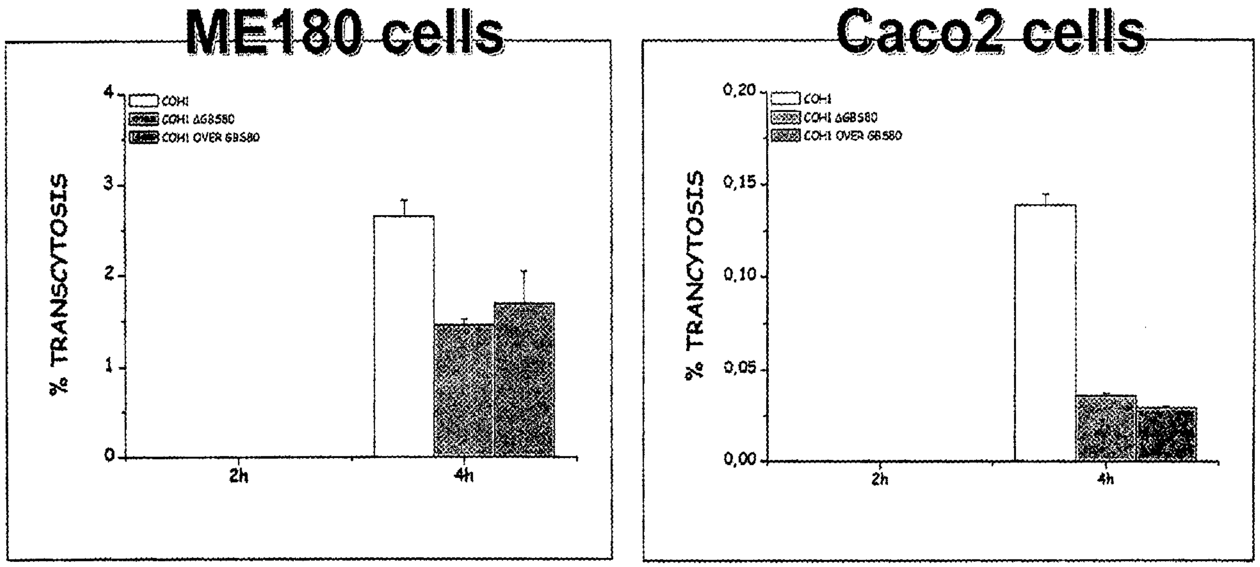

FIG. 212: COH1 strain GBS overexpressing GBS 80 protein has an impaired capacity to translocate through an epithelial monolayer.

Figure 213:
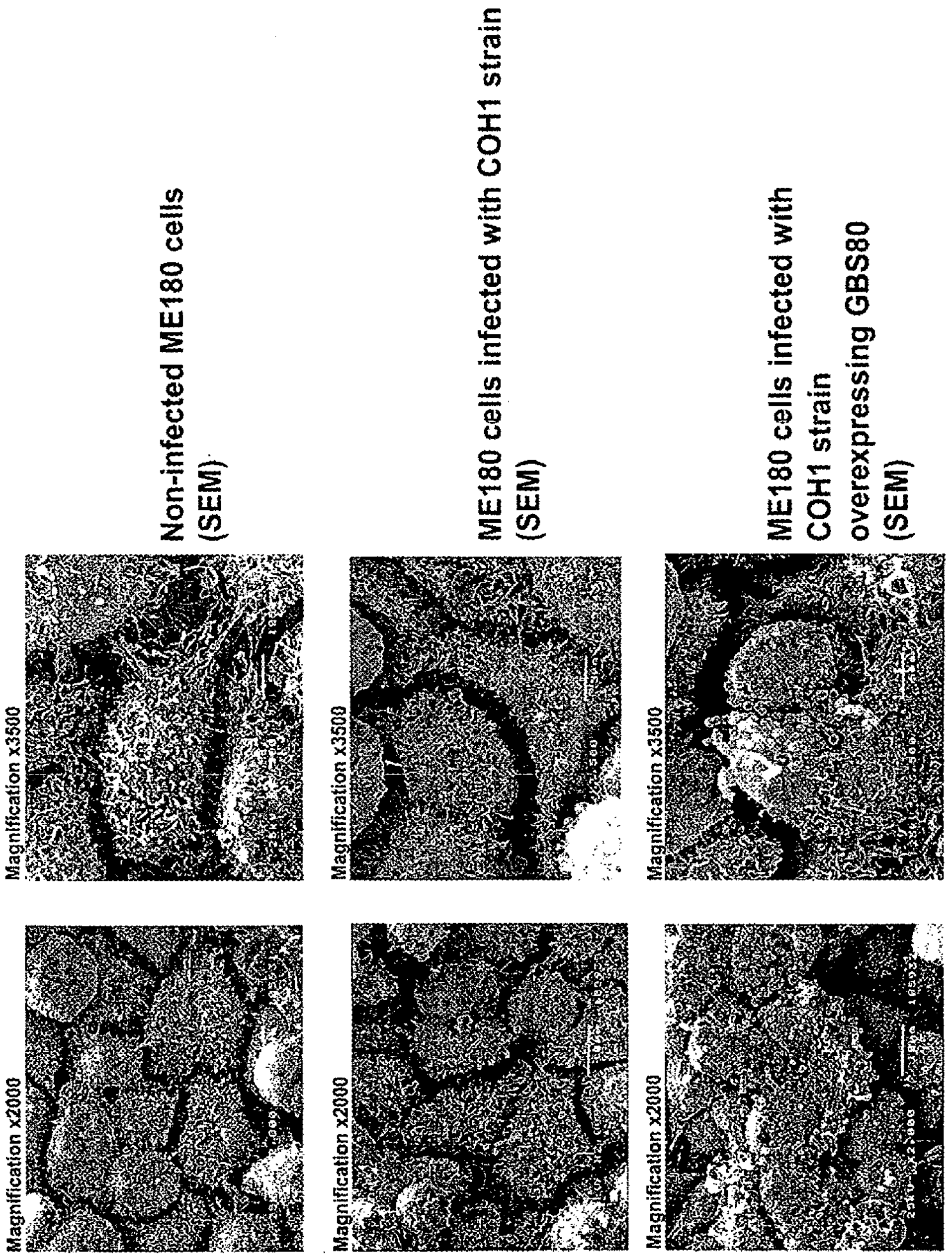

FIG. 213: Scanning electron microscopy shows that overexpression of GBS 80 protein on COH1 strain GBS enhances the capacity of the COH1 bacteria to form microcolonies on epithelial cells.

Figure 214:
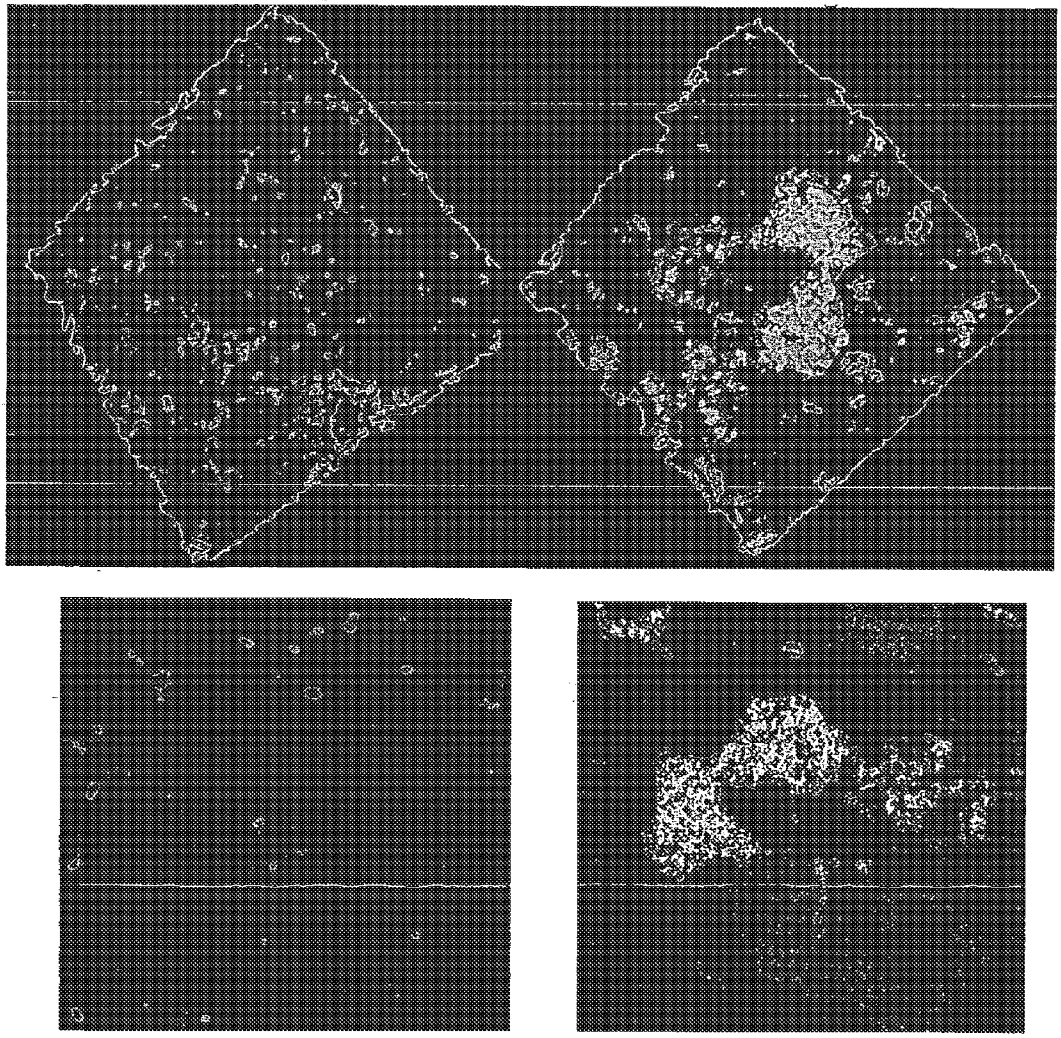

FIG. 214: Confocal imaging shows that overexpression of GBS 80 proteins on COH1 strain GBS enhances the capacity of the COH1 bacteria to form microcolonies on epithelial cells.

Figure 215:
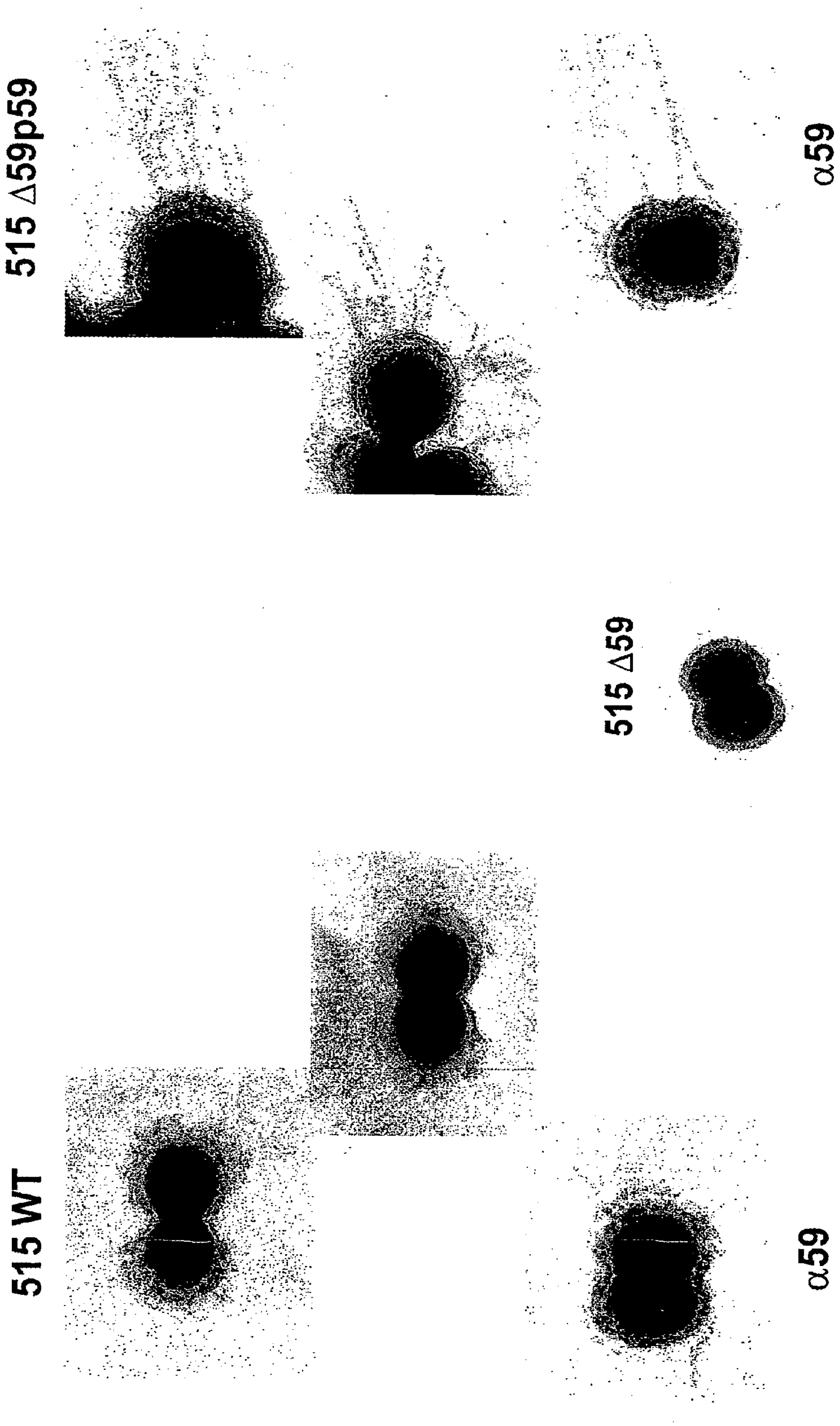

FIG. 215: Detection of GBS 59 on the surface of GBS strain 515 by immuno-electron microscopy.

Figure 216:
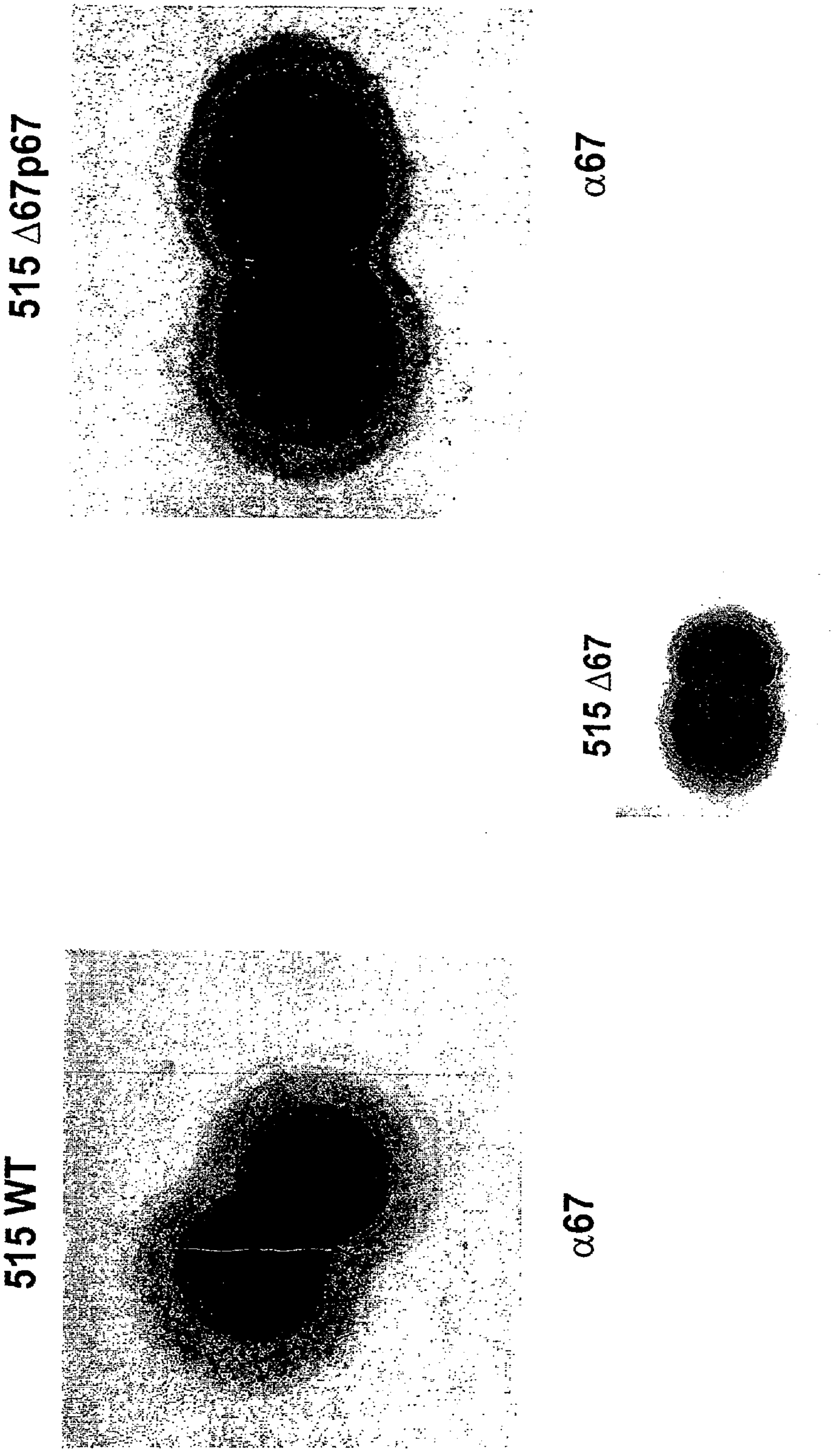

FIG. 216: Detection of GBS 67 on the surface of GBS strain 515 by immuno-electron microscopy.

Figure 217:
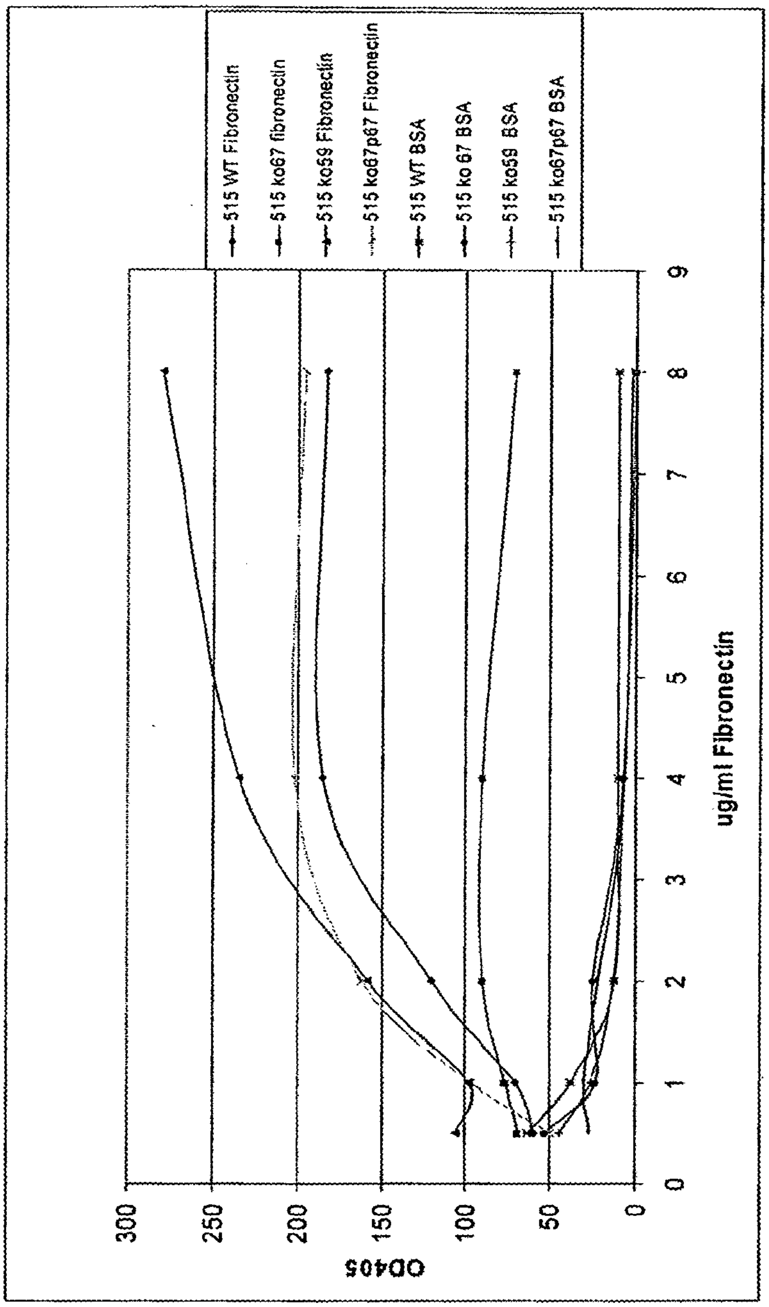

FIG. 217: GBS 67 binds to fibronectin.

Figure 218:
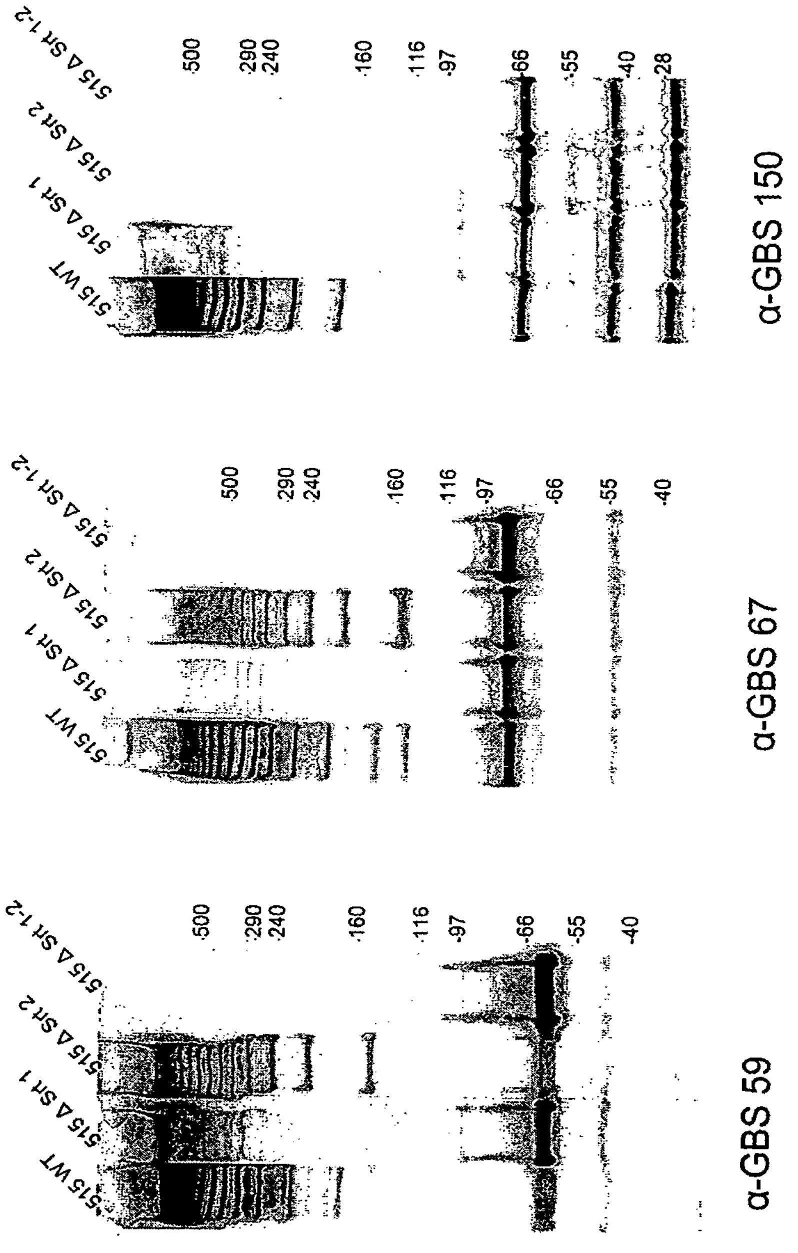

FIG. 218: Western blot analysis shows that deletion of both GBS AI-2 sortase genes abolishes assembly of the pilus.

Figure 219:
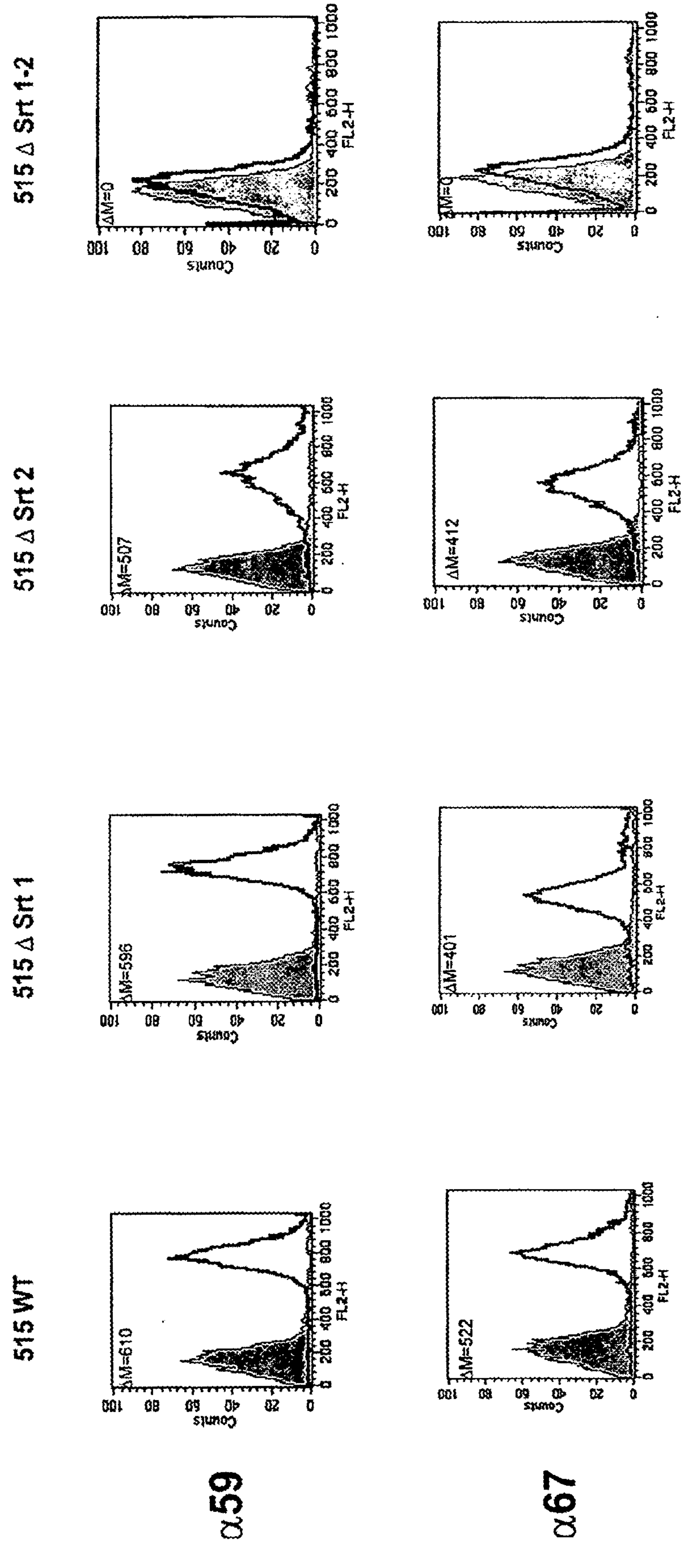

FIG. 219: FACS analysis shows that deletion of both GBS AI-2 sortase genes abolishes assembly of the pilus.

Figure 220:
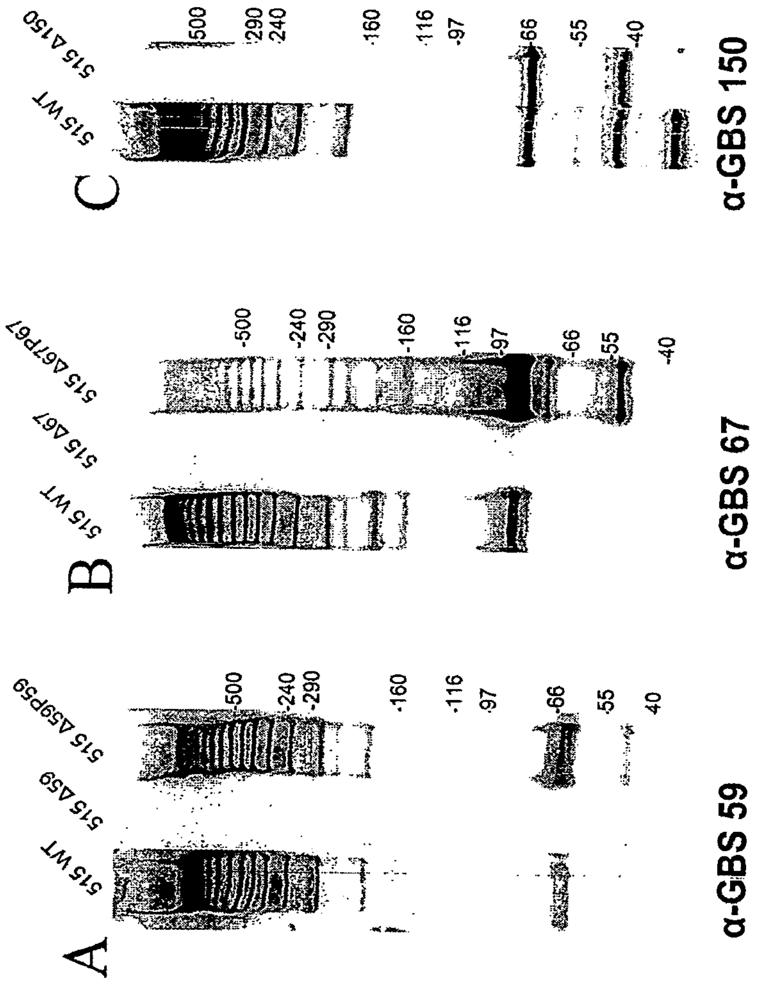

FIG. 220 A-C: Western blot analysis shows that GBS 59, GBS 67, and GBS 150 form high molecular weight complexes.

Figure 221:
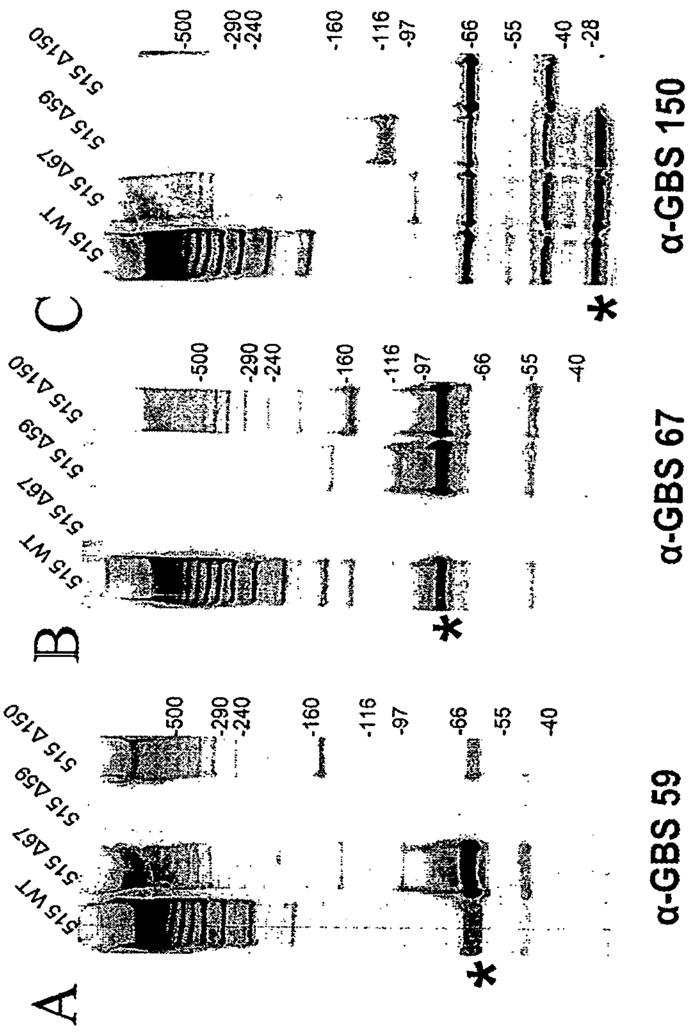

FIG. 221 A-C: Western blot analysis shows that GBS 59 is required for polymer formation of GBS 67 and GBS 150.

Figure 222:
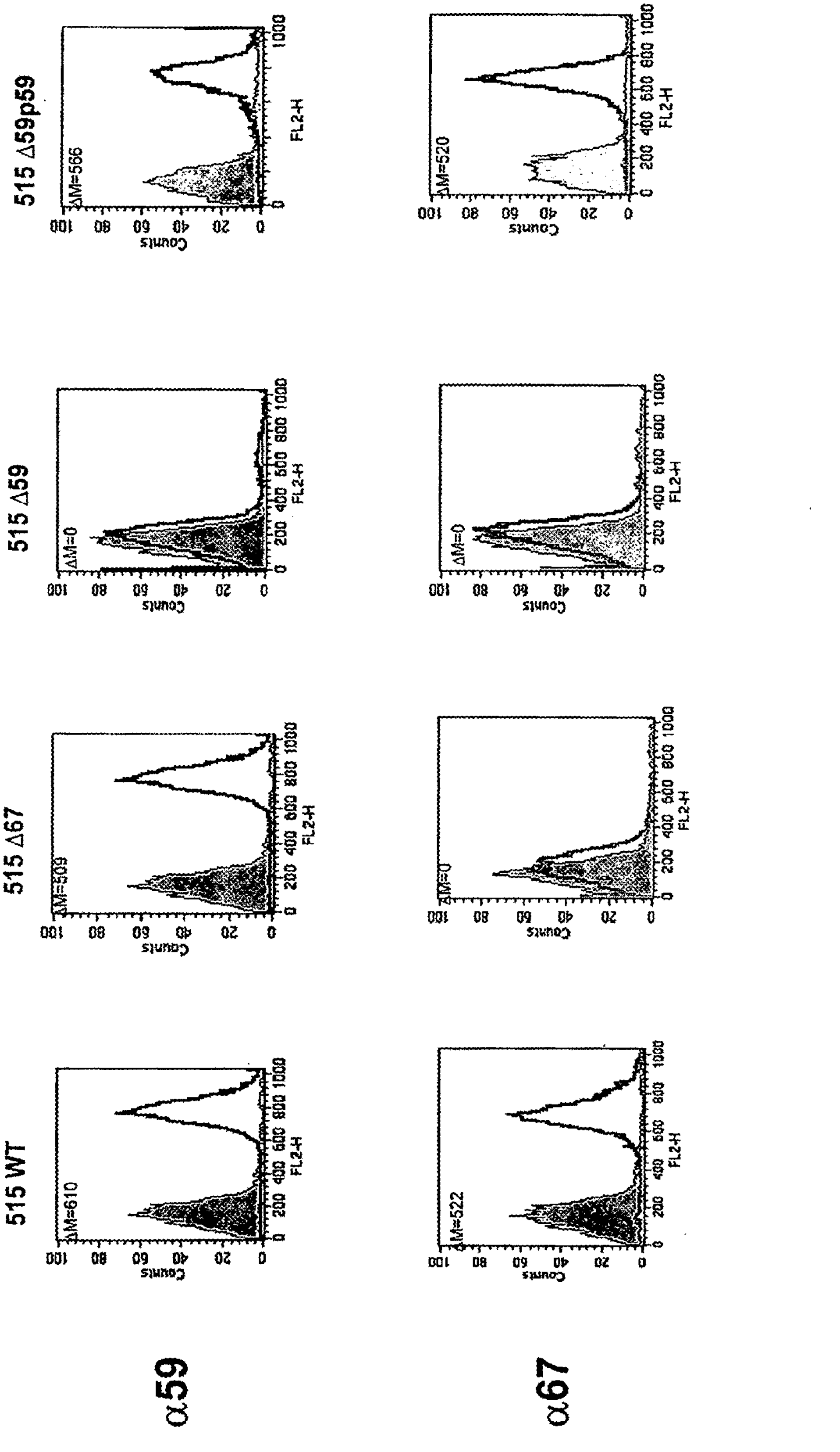

FIG. 222: FACS analysis shows that GBS 59 is required for surface exposure of GBS 67.

Figure 223:
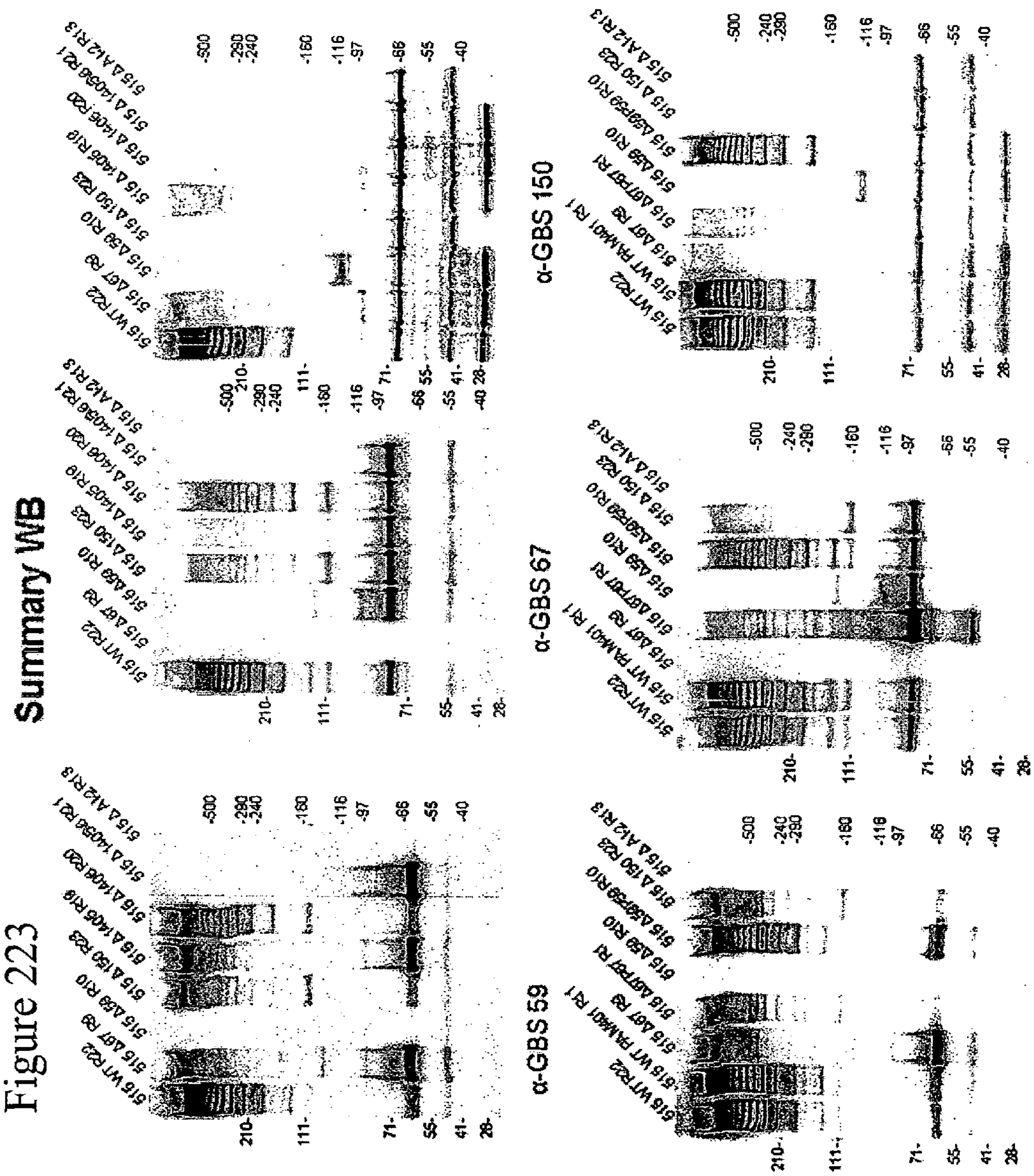

FIG. 223: Summary Western blots for detection of GBS 59, GBS 67, or GBS 150 in GBS 515 and GBS 515 mutant strain.

Figure 224:
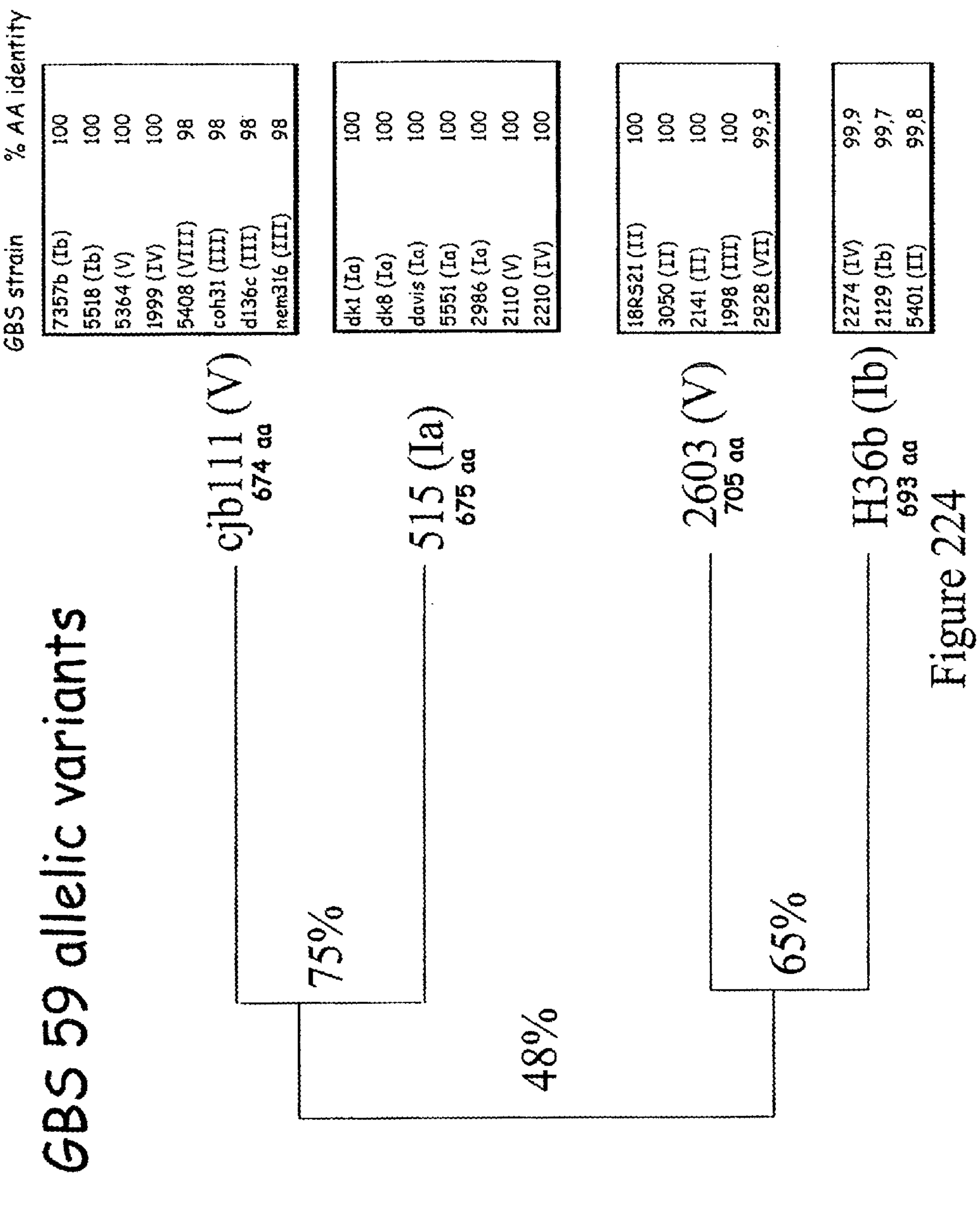

FIG. 224: Description of GBS 59 Allelic variants.

Figure 225:
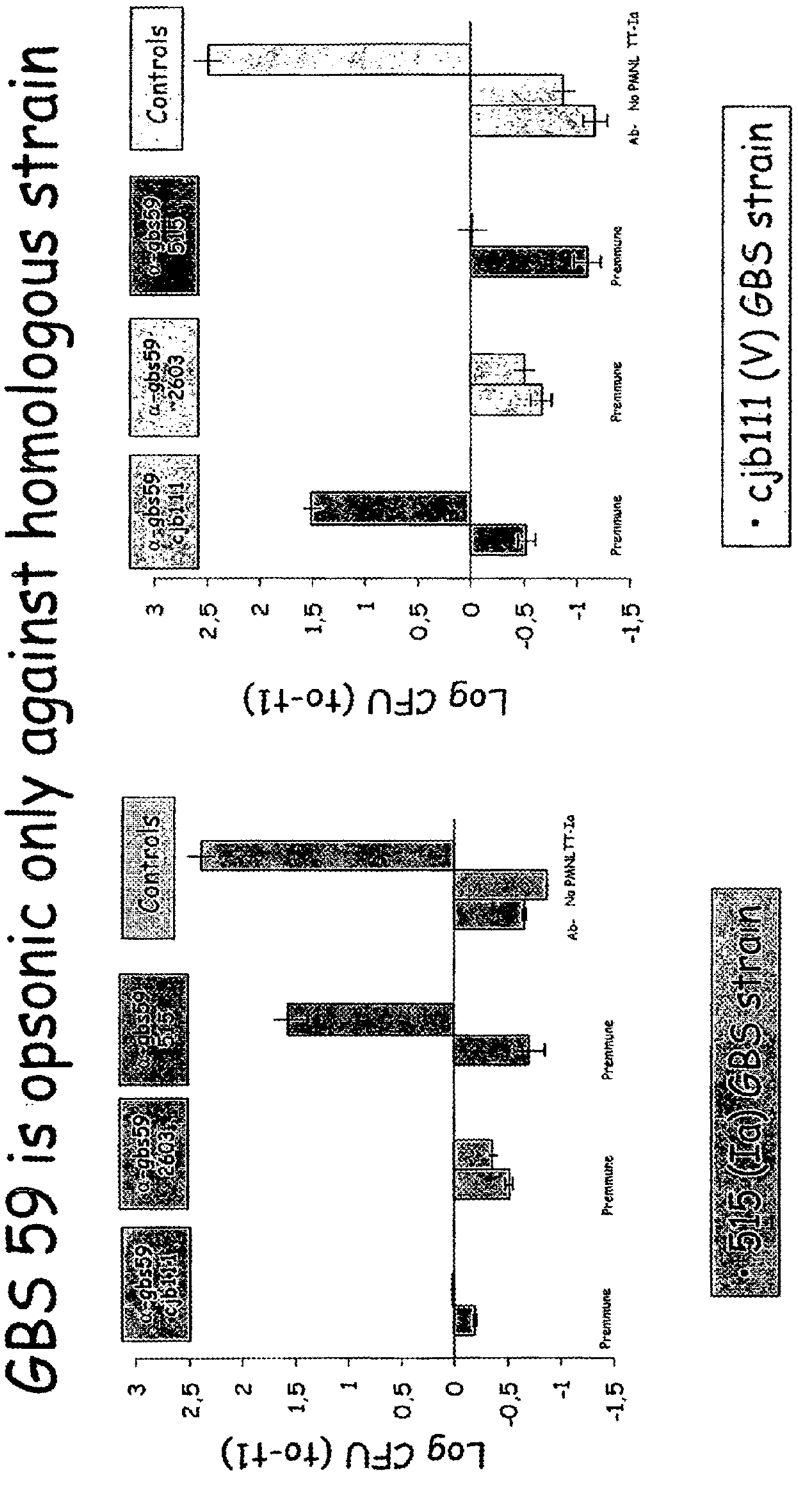

FIG. 225: GBS 59 is opsonic only against a strain of GBS expressing a homologous GBS 59.

FIGS. 226A-B: Results of FACS analysis for surface expression of GBS 59 using antibodies specific for different GBS 59 isoforms.

FIGS. 227A-B: Results of FACS analysis for surface expression of GBS 80, GBS 104, GBS 322, GBS 67, and GBS 59 on 41 various strains of GBS bacteria.

FIG. 228: Results of FACS analysis for surface expression of GBS 80, GBS 104, GBS 322, GBS 67, and GBS 59 on 41 strains of GBS bacteria obtained from the CDC.

FIG. 229: Expected immunogenicity coverage of different combinations of GBS 80, GBS 104, GBS 322, GBS 67, and GBS 59 across strains of GBS bacteria.

Figure 230:
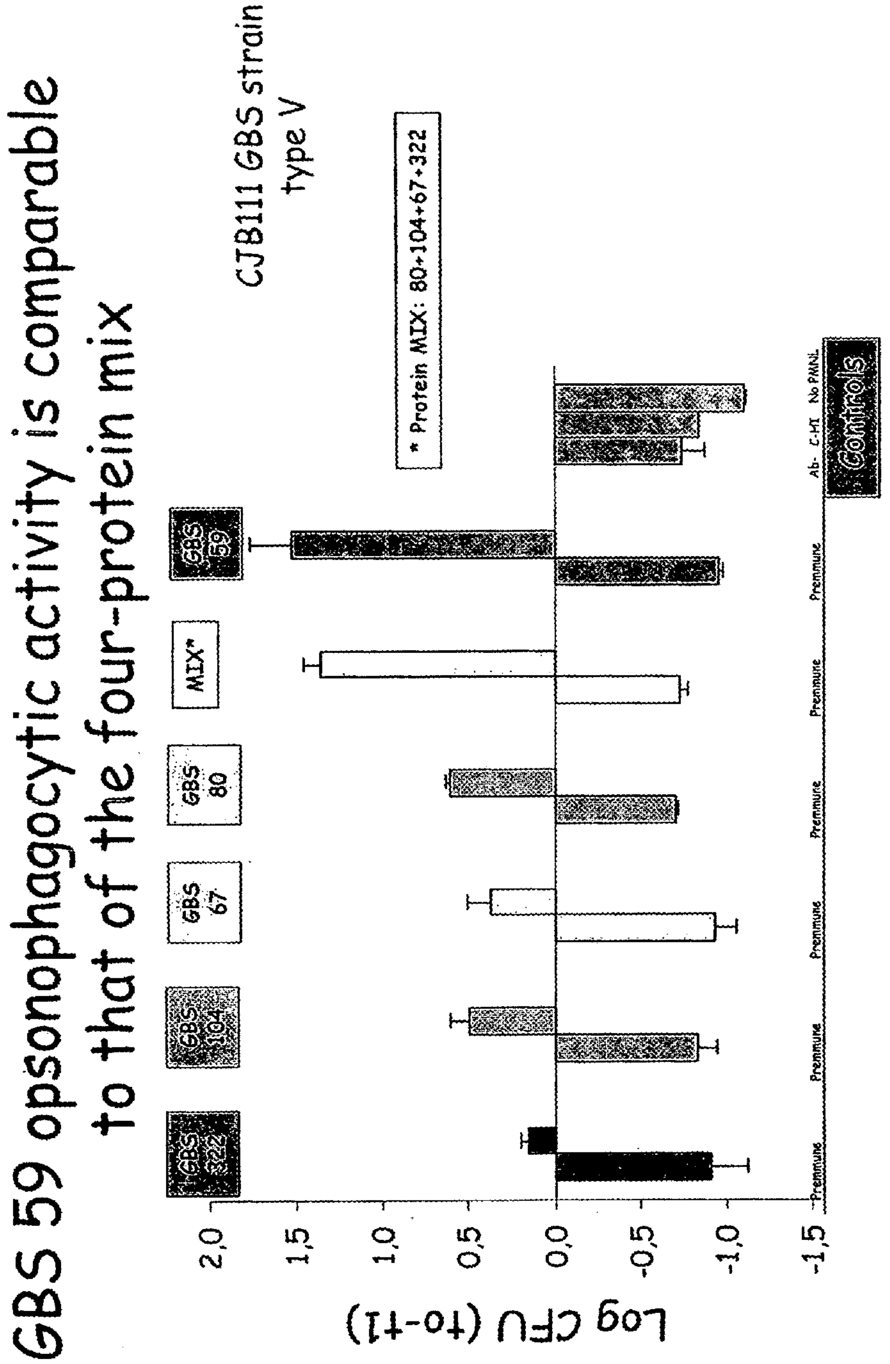

FIG. 230: GBS 59 opsonophagocytic activity is comparable to that of a mixture of GBS 80, GBS 104, GBS 322 and GBS 67.

FIGS. 231A-C: Schematic presentation of example hybrid GBS AIs.

Figure 232:
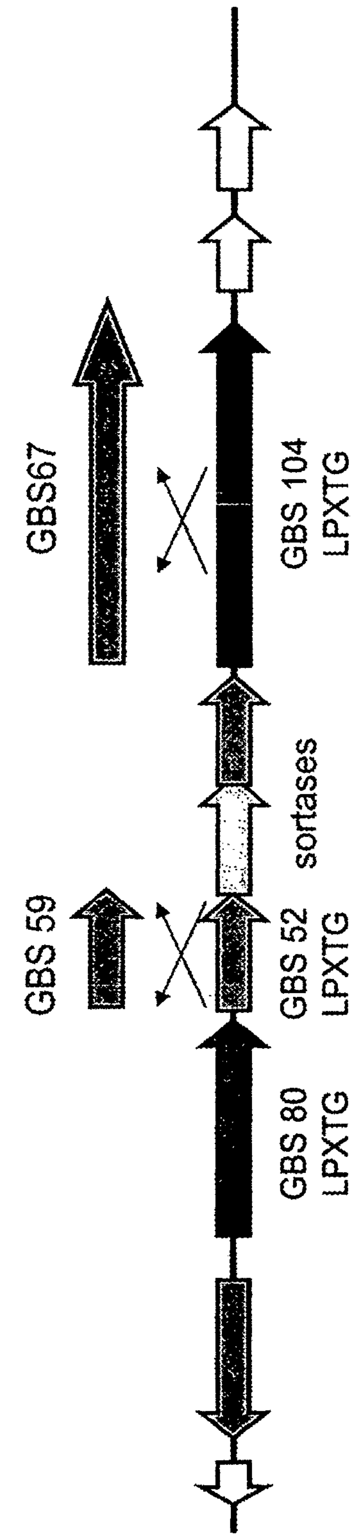

FIG. 232: Schematic presentation of an example hybrid GBS AI.

Figure 233:
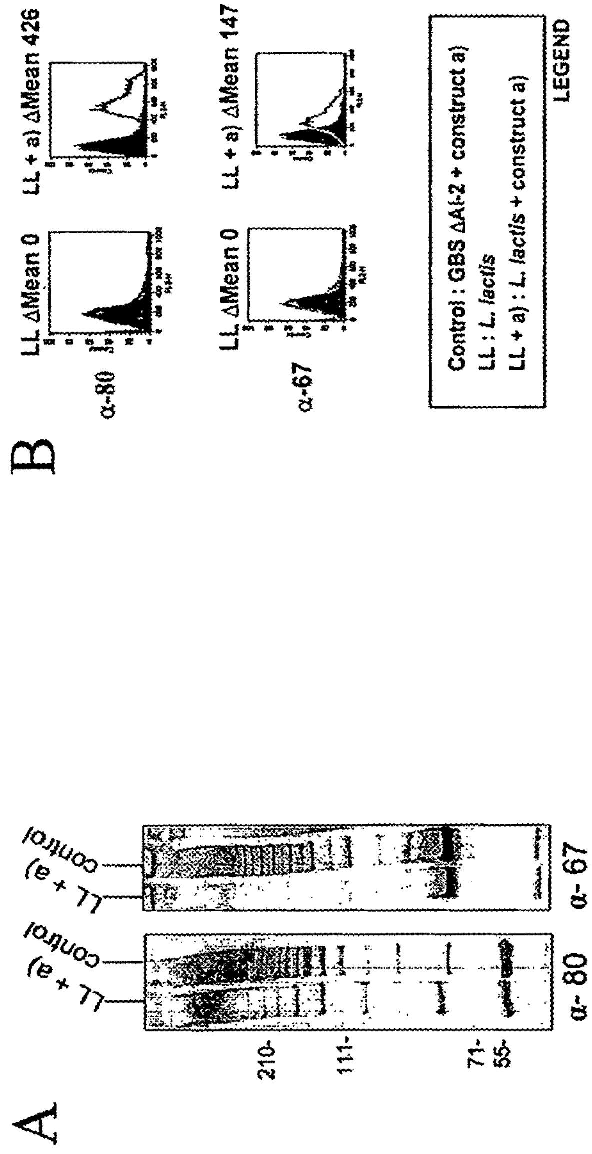

FIGS. 233A-B: Western blot and FACS analysis detect expression of GBS 80 and GBS 67 on the surface of *L. lactis* transformed with a hybrid GBS AI.

FIGS. 234A-E: Hybrid GBS AI cloning strategy. FIG. 234A, SEQ ID NOS:5June 513; FIG. 235B, SEQ ID NO:514; FIG. 236C, SEQ ID NOS:515-523; FIG. 236D, SEQ ID NO:524; FIG. 236E, SEQ ID NO:525.

Figure 235:

FIG. 235: High magnification of *S. pneumoniae* strain TIGR4 pili double labeled with α-RrgB (5 nm) and α-RrgC (10 nm). Bar represents 100 nm.

Figure 236:
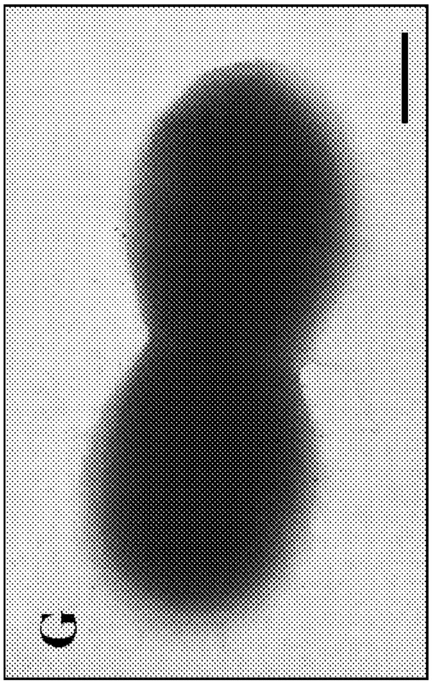

FIG. 236: Immuno-gold labeling of the *S. pneumoniae* TIGR4 rrgA-srtD deletion mutant with no visible pili on the surface detectable by α-RrgB- and α-RrgC. Bar represents 200 nm.

FIG. 237: Variability in GBS 67 amino acid sequences between strains 2603 (SEQ ID NO:316) and H36B (SEQ ID NO:320).

FIG. 238: Strain variability in GBS 67 amino acid sequences of allele I (2603).

FIG. 239: Strain variability in GBS 67 amino acid sequence of allele II (H36B).

BRIEF DESCRIPTION OF THE TABLES

TABLE 1: Active Maternal Immunization Assay for fragments of GBS 80

TABLE 2: Passive Maternal Immunization Assay for fragments of GBS 80

TABLE 3: Lethal dose 50% of AI-1 mutants from GBS strain isolate 2603.

TABLE 4: GAS AI-sequences from M6 isolate (MGAS10394).

TABLE 5: GAS AI-sequences from M1 isolate (SF370).

TABLE 6: GAS AI-sequences from M3 isolate (MGAS315).

TABLE 7: GAS AI-sequences from M3 isolate (SSI-1).

TABLE 8: GAS AI-sequences from M18 isolate (MGAS8232).

TABLE 9: *S. pneumoniae* AI sequences from TIGRsequence.

TABLE 10: GAS AI-sequences from M5 isolate (Manfredo).

TABLE 11: GAS AI-sequences from M12 isolate (A735).

TABLE 12: Conservation of GBS 80 and GBS 104 amino acid sequences.

TABLE 13: Conservation of GBS 322 and GBS 276 amino acid sequences.

TABLE 14: Active maternal immunization assay for a combination of fragments from GBS 322, GBS 80, GBS 104, and GBS 67.

TABLE 15: Antigen surface exposure of GBS 80, GBS 322, GBS 104, and GBS 67.

TABLE 16: Active maternal immunization assay for each of GBS 80 and GBS 322 antigens.

TABLE 17: Active maternal immunization assay for GBS 59.

TABLE 18: Summary of FACS values for surface expression of spyM6_0159.

TABLE 19: Summary of FACS values for surface expression of spyM6_0160.

TABLE 20: Summary of FACS values for surface expression of GAS 15.

TABLE 21: Summary of FACS values for surface expression of GAS 16.

TABLE 22: Summary of FACS values for surface expression of GAS 16 using a second antisera.

TABLE 23: Summary of FACS values for surface expression of GAS 18.

TABLE 24: Summary of FACS values for surface expression of GAS 18 using a second antisera.

TABLE 25: Summary of FACS values for surface expression of SpyM3_0098.

TABLE 26: Summary of FACS values for surface expression of SpyM3_0100.

TABLE 27: Summary of FACS values for surface expression of SpyM3_0102 in M3 serotypes.

TABLE 28: Summary of FACS values for surface expression of SpyM3_0102 in M6 serotypes.

TABLE 29: Summary of FACS values for surface expression of SpyM3_0104 in M3 serotypes.

TABLE 30: Summary of FACS values for surface expression of SpyM3_0104 in an M12 serotype.

TABLE 31: Summary of FACS values for surface expression of SPs_0106 in M3 serotypes.

TABLE 32: Summary of FACS values for surface expression of SPs_0106 in an M12 serotype.

TABLE 33: Summary of FACS values for surface expression of 19224134 in an M12 serotype.

TABLE 34: Summary of FACS values for surface expression of 19224134 in M6 serotypes.

TABLE 35: Summary of FACS values for surface expression of 19224135 in an M12 serotype.

TABLE 36: Summary of FACS values for surface expression of 19224137 in an M12 serotype.

TABLE 37: Summary of FACS values for surface expression of 19224141 in an M12 serotype.

TABLE 38: *S. pneumoniae* strain 670 μl sequences.

TABLE 39: Percent identity comparison of *S. pneumoniae* strains AI sequences.

TABLE 40: FACS analysis of *L. lactis* and GBS bacteria strains expressing GBS AI-1.

TABLE 41: Sequences of primers used to amplify AI locus.

TABLE 42: Conservation of amino acid sequences encoded by the *S. pneumoniae* AI locus.

TABLE 43: Protection of Mice Immunized with *L. lactis* expressing GBS AI-1.

TABLE 44: GAS AI-sequences from M49 isolate (591).

TABLE 45: Comparison of Sequences Between the Four GAS AIs.

TABLE 46: Antibody Responses against GBS 80 in Serum of Mice Immunized with *L. lactis* Expressing GBS AI-1

TABLE 47: Anti-GBS 80 IgA Antibodies Detected in Mouse Tissues Following Immunization with *L. lactis* Expressing GBS AI-1

TABLE 48: GBS 67 Protects Mice in an Immunization Assay.

TABLE 49: Exposure Levels of GBS 80, GBS 104, GBS 67, GBS 322, and GBS 59 on GBS Strains.

TABLE 50: High Levels of Surface Protein Expression on GBS Serotypes.

TABLE 51: Further Protection of Mice Immunized with *L. lactis* expressing GBS AI-1.

DETAILED DESCRIPTION OF THE INVENTION

The practice of the present invention will employ, unless otherwise indicated, conventional methods of chemistry, biochemistry, molecular biology, immunology and pharmacology, within the skill of the art. Such techniques are explained fully in the literature. See, e.g., Remington's Pharmaceutical Sciences, Mack Publishing Company, Easton, Pa., 19th Edition (1995); Methods In Enzymology (s. Colowick and N. Kaplan, eds., Academic Press, Inc.); and Handbook of Experimental Immunology, Vols. I-IV (D. M. Weir and C. C. Blackwell, eds., 1986, Blackwell Scientific Publications); Sambrook, et al., Molecular Cloning: A Laboratory Manual (2nd Edition, 1989); Handbook of Surface and Colloidal Chemistry (Birdi, K. s. ed., CRC Press, 1997); Short Protocols in Molecular Biology, 4th ed. (Ausubel et al. eds., 1999, John Wiley & Sons); Molecular Biology Techniques: An Intensive Laboratory Course, (Ream et al., eds., 1998, Academic Press); PCR (Introduction to Biotechniques Series), 2nd ed. (Newton & Graham eds., 1997, Springer Verlag); Peters and Dalrymple, Fields Virology (2d ed), Fields et al. (eds.), B. N. Raven Press, New York, N.Y.

All publications, patents and patent applications cited herein, are hereby incorporated by reference in their entireties.

As used herein, an "Adhesin Island" or "AI" refers to a series of open reading frames within a bacterial genome, such as the genome for Group A or Group B *Streptococcus* or other gram positive bacteria, that encodes for a collection of surface proteins and sortases. An Adhesin Island may encode for amino acid sequences comprising at least one surface protein. The Adhesin Island may encode at least one surface protein. Alternatively, an Adhesin Island may encode for at least two surface proteins and at least one sortase. Preferably, an Adhesin Island encodes for at least three surface proteins and at least two sortases. One or more of the surface proteins may include an LPXTG motif (such as LPXTG (SEQ ID NO:122)) or other sortase substrate motif. One or more AI surface proteins may participate in the formation of a pilus structure on the surface of the gram positive bacteria.

Adhesin Islands of the invention preferably include a divergently transcribed transcriptional regulator (i.e., the transcriptional regulator is located near or adjacent to the AI protein open reading frames, but it transcribed in the opposite direction). The transcriptional regulator may regulate the expression of the AI operon.

GBS Adhesin Island 1

As discussed above, Applicants have identified a new adhesin island, "Adhesin Island 1", "AI-1", or "GBS AI-1", within the genomes of several Group B *Streptococcus* serotypes and isolates. AI-1 comprises a series of approximately five open reading frames encoding for a collection of amino acid sequences comprising surface proteins and sortases ("AI-1 proteins"). Specifically, AI-1 includes open reading frames encoding for two or more (i.e., 2, 3, 4 or 5) of GBS 80, GBS 104, GBS 52, SAG0647 and SAG0648. One or more of the AI-1 open reading frame polynucleotide sequences may be replaced by a polynucleotide sequence coding for a fragment of the replaced ORF. Alternatively, one or more of the AI-1 open reading frames may be replaced by a sequence having sequence homology to the replaced ORF.

Figure 1:
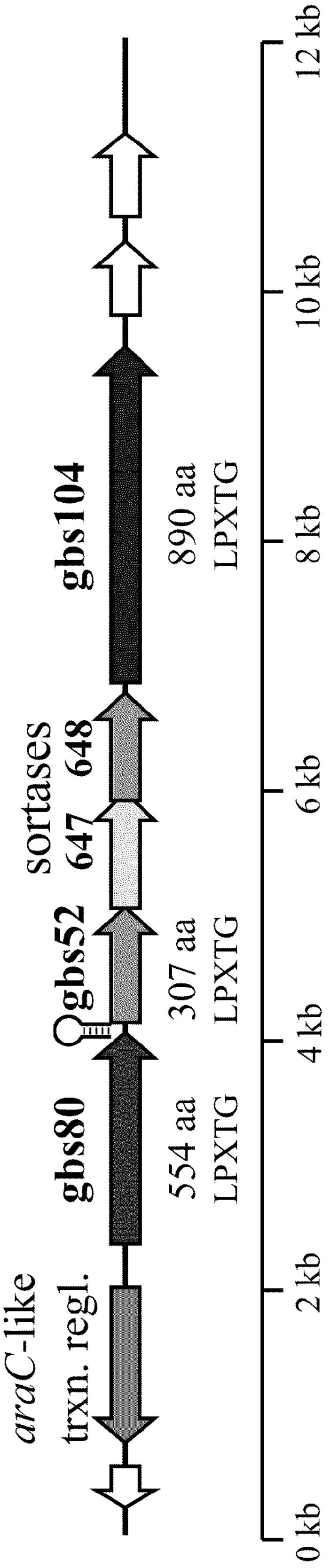
FIG. 1 presents a schematic depiction of Adhesin Island 1 ("AI-1") comprising open reading frames for GBS 80, GBS 52, SAG0647, SAG0648 and GBS 104.

A schematic of AI-1 is presented in FIG. 1. AI-1 typically resides on an approximately 16.1 kb transposon-like element frequently inserted into the open reading frame for trmA. One or more of the AI-1 surface protein sequences typically include an LPXTG motif (such as LPXTG (SEQ ID NO:122)) motif or other sortase substrate motif. The AI surface proteins of the invention may affect the ability of the GBS bacteria to adhere to and invade epithelial cells. AI surface proteins may also affect the ability of GBS to translocate through an epithelial cell layer. Preferably, one or more AI surface proteins are capable of binding to or otherwise associating with an epithelial cell surface. AI surface proteins may also be able to bind to or associate with fibrinogen, fibronectin, or collagen.

The AI-1 sortase proteins are predicted to be involved in the secretion and anchoring of the LPXTG containing surface proteins. AI-1 may encode for at least one surface protein. Alternatively, AI-1 may encode for at least two surface exposed proteins and at least one sortase. Preferably, AI-1 encodes for at least three surface exposed proteins and at least two sortases. The AI-1 protein preferably includes GBS 80 or a fragment thereof or a sequence having sequence identity thereto.

As used herein, an LPXTG motif represents an amino acid sequence comprising at least five amino acid residues. Preferably, the motif includes a leucine (L) in the first amino acid position, a proline (P) in the second amino acid position, a threonine (T) in the fourth amino acid position and a glycine (G) in the fifth amino acid position. The third position, represented by X, may be occupied by any amino acid residue. Preferably, the X is occupied by lysine (K), Glutamate (E), Asparagine (N), Glutamine (Q) or Alanine (A). Preferably, the X position is occupied by lysine (K). In some embodiments, one of the assigned LPXTG amino acid positions is replaced with another amino acid. Preferably, such replacements comprise conservative amino acid replacements, meaning that the replaced amino acid residue has similar physiological properties to the removed amino acid residue. Genetically encoded amino acids may be divided into four families based on physiological properties: (1) acidic (aspartate and glutamate), (2) basic (lysine, arginine, histidine), (3) non-polar (alanine, valine, leucine, isoleucine, proline, phenylalanine, methionine, tryptophan) and (4) uncharged polar (glycine, asparagines, glutamine, cysteine, serine, threonine, and tyrosine). Phenylalanine, tryptophan and tyrosine are sometimes classified jointly as aromatic amino acids. For example, it is reasonably predictable that an isolated replacement of a leucine with an isoleucine or valine, an aspartate with a glutamate, a threonine with a serine, or a similar conservative replacement of an amino acid with a structurally related amino acid will not have a major effect on the biological activity.

The first amino acid position of the LPXTG motif may be replaced with another amino acid residue. Preferably, the first amino acid residue (leucine) is replaced with an alanine (A), valine (V), isoleucine (I), proline (P), phenylalanine (F), methionine (M), glutamic acid (E), glutamine (Q), or tryptophan (Y) residue. In one preferred embodiment, the first amino acid residue is replaced with an isoleucine (I).

The second amino acid residue of the LPXTG motif may be replaced with another amino acid residue. Preferably, the second amino acid residue praline (P) is replaced with a valine (V) residue.

The fourth amino acid residue of the LPXTG motif may be replaced with another amino acid residue. Preferably, the fourth amino acid residue (threonine) is replaced with a serine (S) or an alanine (A).

In general, an LPXTG motif may be represented by the amino acid sequence XXXXG, in which X at amino acid position 1 is an L, a V, an E, an I, an F, or a Q; X at amino acid position 2 is a P if X at amino acid position 1 is an L, an I, or an F; X at amino acid position 2 is a V if X at amino acid position 1 is a E or a Q; X at amino acid position 2 is a V or a P if X at amino acid position 1 is a V; X at amino acid position 3 is any amino acid residue; X at amino acid position 4 is a T if X at amino acid position 1 is a V, E, I, F, or Q; and X at amino acid position 4 is a T, S, or A if X at amino acid position 1 is an L.

Generally, the LPXTG motif of a GBS AI protein may be represented by the amino acid sequence XPXTG, in which X at amino acid position 1 is L, I, or F, and X at amino acid position 3 is any amino acid residue. Specific examples of LPXTG motifs in GBS AI proteins may include LPXTG (SEQ ID NO:122) or IPXTG (SEQ ID NO:133).

As discussed further below, the threonine in the fourth amino acid position of the LPXTG motif may be involved in the formation of a bond between the LPXTG containing protein and a cell wall precursor. Accordingly, in preferred LPXTG motifs, the threonine in the fourth amino acid position is not replaced with another amino acid or, if the threonine is replaced, the replacement amino acid is preferably a conservative amino acid replacement, such as serine.

Instead of an LPXTG motif, the AI surface proteins of the invention may contain alternative sortase substrate motifs such as NPQTN (SEQ ID NO:142), NPKTN (SEQ ID NO:168), NPQTG (SEQ ID NO:169), NPKTG (SEQ ID NO:170), XPXTGG (SEQ ID NO:143), LPXTAX (SEQ ID NO:144), or LAXTGX (SEQ ID NO:145). (Similar conservative amino acid substitutions can also be made to these membrane motifs).

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

Figure 44:
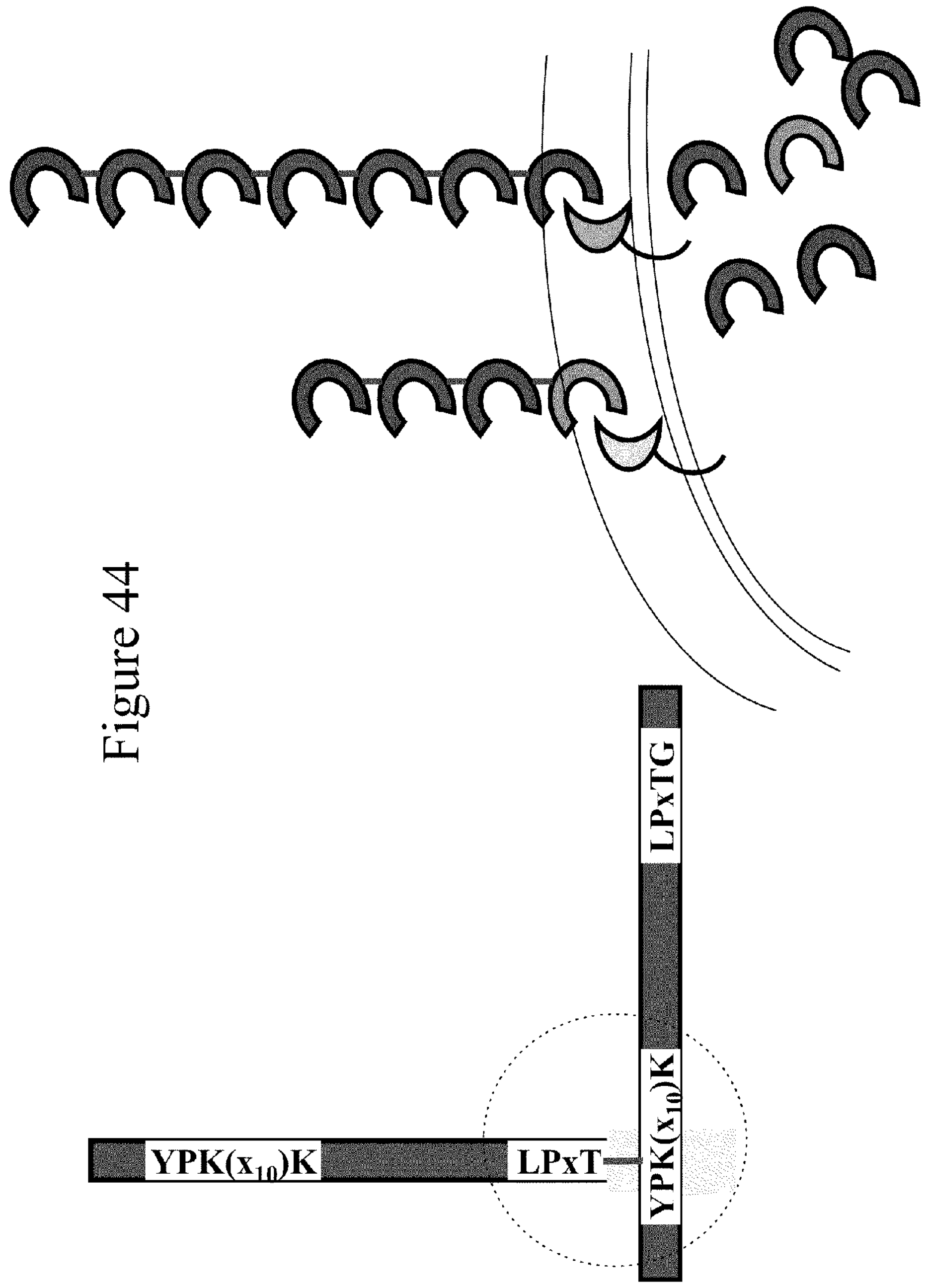
FIG. 44: Illustrates pilin assembly.

The AI surface proteins may be polymerized into pili by sortase-catalysed transpeptidation. (See FIG. 44.) Cleavage of AI surface proteins by sortase between the threonine and glycine residues of an LPXTG motif yields a thioester-linked acyl intermediate of sortase. Many AI surface proteins include a pilin motif amino acid sequence which interacts with the sortase and LPXTG amino acid sequence. The first lysine residue in a pilin motif can serve as an amino group acceptor of the cleaved LPXTG motif and thereby provide a covalent linkage between AI subunits to form pili. For example, the pilin motif can make a nucleophilic attack on the acyl enzyme providing a covalent linkage between AI subunits to form pili and regenerate the sortase enzyme. Examples of pilin motifs may include ((YPKN($X_{10}$)K; SEQ ID NO:146), (YPKN($X_9$)K; SEQ ID NO:147), (YPK($X_7$)K; SEQ ID NO:148), (YPK($X_{11}$)K; SEQ ID NO:149), or (PKN ($X_9$)K; SEQ ID NO:150)). Preferably, the AI surface proteins of the invention include a pilin motif amino acid sequence.

Typically, AI surface proteins of the invention will contain an N-terminal leader or secretion signal to facilitate translocation of the surface protein across the bacterial membrane.

Group B Streptococci are known to colonize the urinary tract, the lower gastrointestinal tract and the upper respiratory tract in humans. Electron micrograph images of GBS infection of a cervical epithelial cell line (ME180) are presented in FIG. 25. As shown in these images, the bacteria closely associate with tight junctions between the cells and appear to cross the monolayer by a paracellular route. Similar paracellular invasion of ME180 cells is also shown in the contrast images in FIG. 26. The AI surface proteins of the invention may effect the ability of the GBS bacteria to adhere to and invade epithelial cells. AI surface proteins may also affect the ability of GBS to translocate through an epithelial cell layer. Preferably, one or more AI surface proteins are capable of binding to or otherwise associating with an epithelial cell surface.

Figure 29:
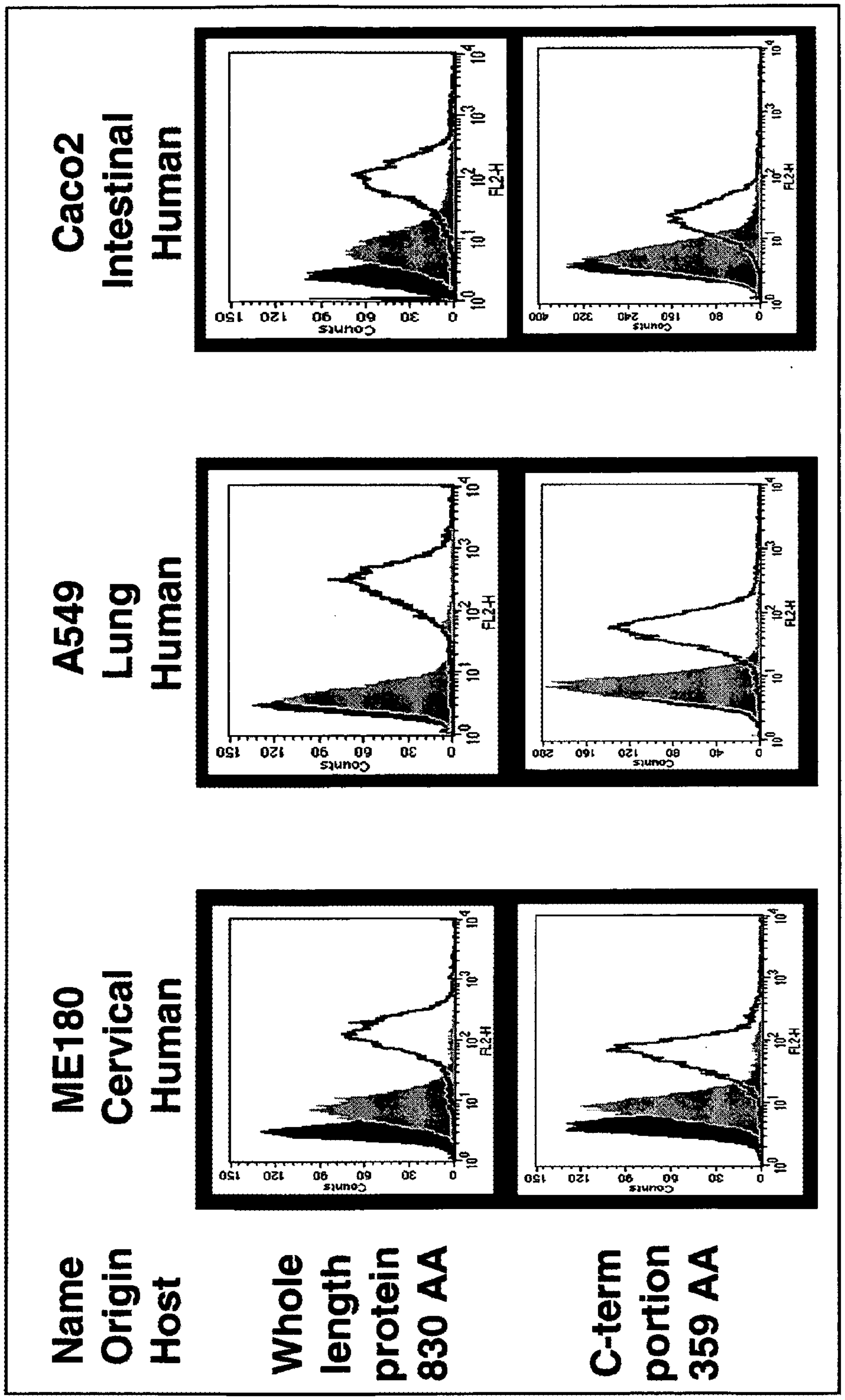
FIG. 29: Illustrates binding of recombinant GBS 104 protein to epithelial cells.

Applicants have discovered that AI-1 surface protein GBS 104 can bind epithelial cells such as ME180 human cervical cells, A549 human lung cells and Caco2 human intestinal cells (See FIGS. 29 and 210). Further, deletion of the GBS 1 sequence in a GBS strain reduces the capacity of GBS to adhere to ME180 cervical epithelial cells. (See FIGS. 30 and 211). Deletion of GBS 104 also reduces the capacity of GBS to invade J774 macrophage-like cells. (See FIGS. 32 and 205). Deletion of GBS 104 also causes GBS to translocate through epithelial monolayers less efficiently. See FIG. 206. GBS 104 protein therefore appears to bind to ME180 epithelial cells and to have a role in adhesion to epithelial cells and macrophage cell lines.

Similar to the GBS bacteria that are deletion mutants for GBS 104, GBS 80 knockout mutant strains also partially lose the ability to translocate through an epithelial monolayer. See FIG. 207. Deletion of either GBS 80 or GBS 104 in COH1 cells diminishes adherence to HUVEC endothelial cells. See FIG. 208. Deletion of GBS 80 or GBS 104 in COH1 does not, however, affect growth of COH1 either with ME180 cells or in incubation medium (IM). See FIG. 209. Both GBS 80 and GBS 104, therefore, appear to be involved in translocation of GBS through epithelial cells.

GBS 80 does not appear to bind to epithelial cells. Incubation of epithelial cells in the presence of GBS 80 protein followed by FACS analysis using an anti-GBS 80 polyclonal antibody did not detect GBS 80 binding to the epithelial cells. See FIG. 202. Furthermore, deletion of GBS 80 protein does not affect the ability of GBS to adhere and invade ME180 cervical epithelial cells. See FIG. 203

Figure 5:
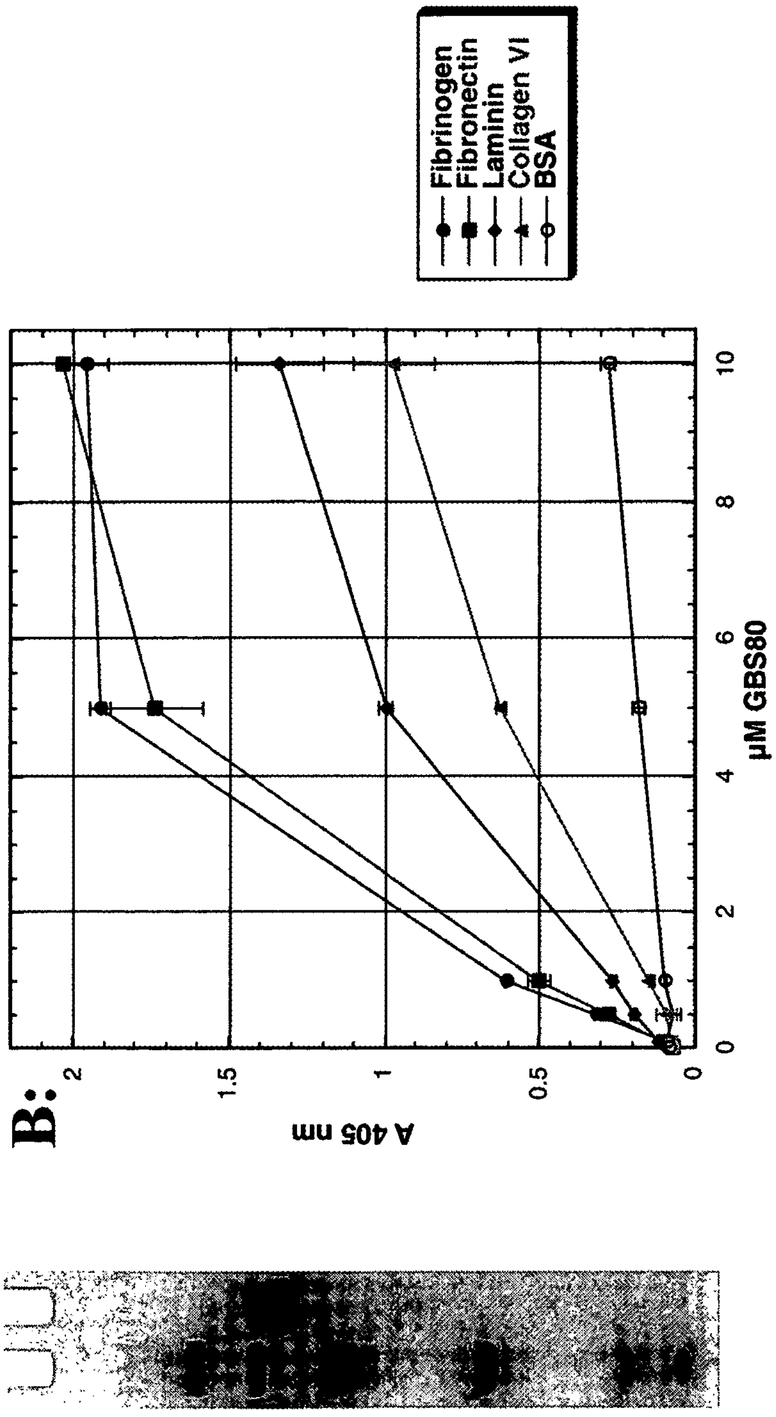
FIG. 5 presents data showing that GBS 80 binds to fibronectin and fibrinogen in ELISA.
Figure 27:
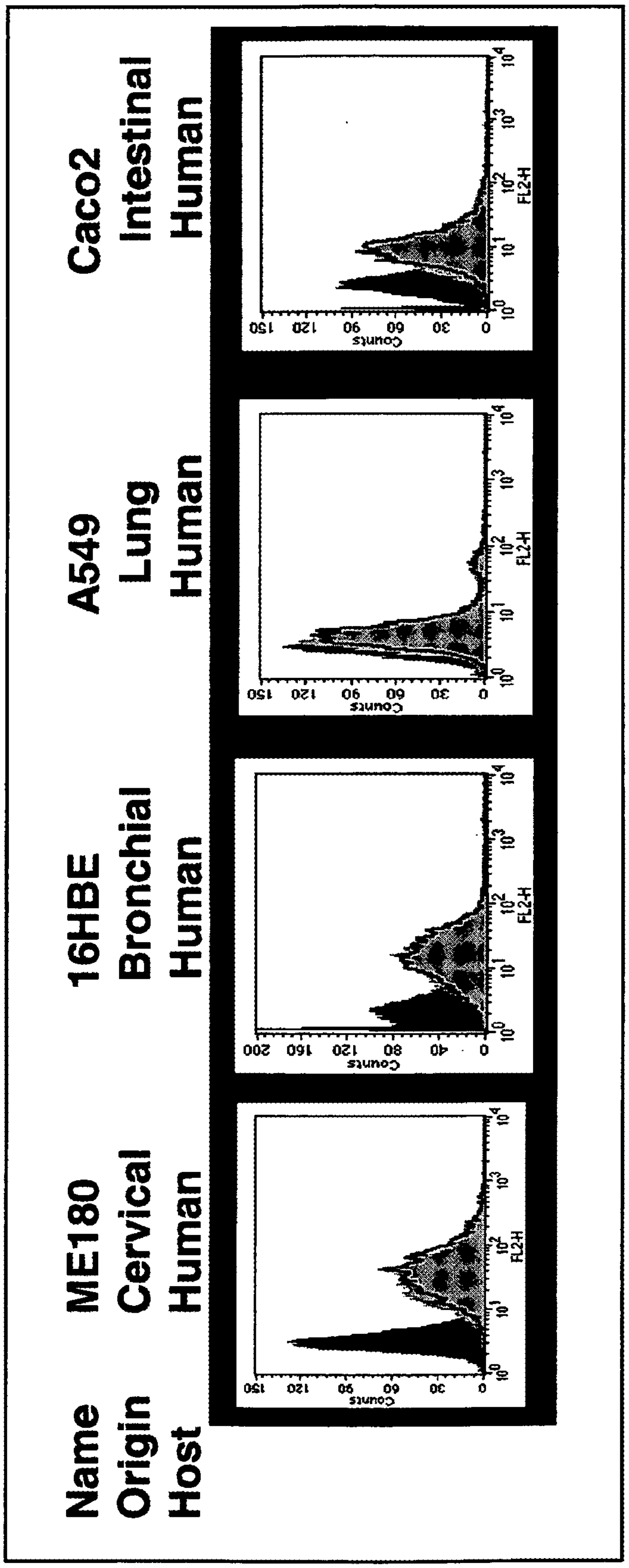
FIG. 27: Illustrates that GBS 80 recombinant protein does not bind to epithelial cells.

Preferably, one or more of the surface proteins may bind to one or more extracellular matrix (ECM) binding proteins, such as fibrinogen, fibronectin, or collagen. As shown in FIGS. 5 and 204, and Example 1, GBS 80, one of the AI-1 surface proteins, can bind to the extracellular matrix binding proteins fibronectin and fibrinogen. While GBS 80 protein apparently does not bind to certain epithelial cells or affect the capacity of a GBS bacteria to adhere to or invade cervical epithelial cells (See FIGS. 27 and 28), removal of GBS 80 from a wild type strain decreases the ability of that strain to translocate through an epithelial cell layer (see FIG. 31).

GBS 80 may also be involved in formation of biofilms. COH1 bacteria overexpressing GBS 80 protein have an impaired ability to translocate through an epithelial monolayer. See FIG. 212. These COH1 bacteria overexpressing GBS 80 form microcolonies on epithelial cells. See FIGS. 213 and 214. These microcolonies may be the initiation of biofilm development.

AI Surface proteins may also demonstrate functional homology to previously identified adhesion proteins or extracellular matrix (ECM) binding proteins. For example, GBS 80, a surface protein in AI-1, exhibits some functional homology to FimA, a major fimbrial subunit of a Gram positive bacteria *A. naeslundii*. FimA is thought to be involved in binding salivary proteins and may be a component in a fimbria on the surface of *A. naeslundii*. See Yeung et al. (1997) Infection & Immunity 65:2629-2639; Yeunge et al (1998) J. Bacteriol 66:1482-1491; Yeung et al. (1988) J. Bacteriol 170: 3803-3809; and Li et al. (2001) Infection & Immunity 69:7224-7233.

A similar functional homology has also been identified between GBS 80 and proteins involved in pili formation in the Gram positive bacteria *Corynebacterium diphtheriae* (SpaA, SpaD, and SpaH). See, Ton-That et al. (2003) Molecular Microbiology 50 (4):1429-1438 and Ton-That et al. (2004) Molecular Microbiology 53 (1):251-261. The *C. diphtheriae* proteins all included a pilin motif of WxxxVxVYPK (SEQ ID NO:151; where x indicates a varying amino acid residue). The lysine (K) residue is particularly conserved in the *C. diphthe-*

Figure 6:
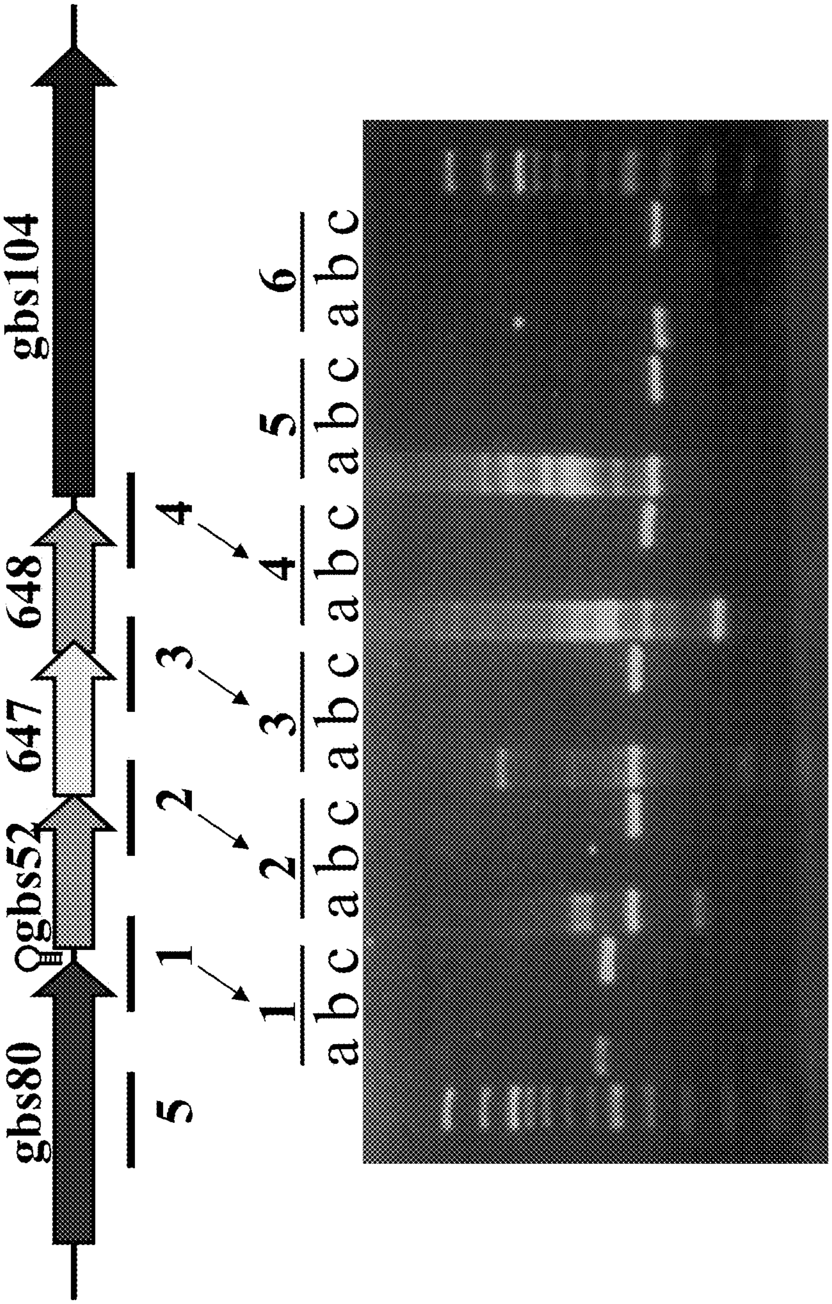
FIG. 6 illustrates that all genes in AI-1 are co-transcribed as an operon.

*riae* pilus proteins and is thought to be involved in sortase catalyzed oligomerization of the subunits involved in the *C. diphtheriae* pilus structure. (The *C. diphtheriae* pilin subunit SpaA is thought to occur by sortase-catalyzed amide bond cross-linking of adjacent pilin subunits. As the thioester-linked acyl intermediate of sortase requires nucleophilic attack for release, the conserved lysine within the SpaA pilin motif might function as an amino group acceptor of cleaved sorting signals, thereby providing for covalent linkages of the *C. diphtheria* pilin subunits. See FIG. 6(*d*) of Ton-That et al., Molecular Microbiology (2003) 50 (4): 1429-1438.)

In addition, an "E box" comprising a conserved glutamic acid residue has also been identified in the *C. diphtheria* pilin associated proteins as important in *C. diphtheria* pilin assembly. The E box motif generally comprises YxLxETxAPxGY (SEQ ID NO:152; where x indicates a varying amino acid residue). In particular, the conserved glutamic acid residue within the E box is thought necessary for *C. diphtheria* pilus formation.

Preferably, the AI-1 polypeptides of the immunogenic compositions comprise an E box motif. Some examples of E box motifs in the AI-1 polypeptides may include the amino acid sequences YxLxExxxxxGY (SEQ ID NO:153), YxLxExxxPxGY (SEQ ID NO:154), or YxLxETxAPxGY (SEQ ID NO:152). Specifically, the E box motif of the polypeptides may comprise the amino acid sequences YKLKETKAPEGY (SEQ ID NO:155), YVLKEIETQSGY (SEQ ID NO:156), or YKLYEISSPDGY (SEQ ID NO:157).

As discussed in more detail below, a pilin motif containing a conserved lysine residue and an E box motif containing a conserved glutamic acid residue have both been identified in GBS 80.

Figure 34:
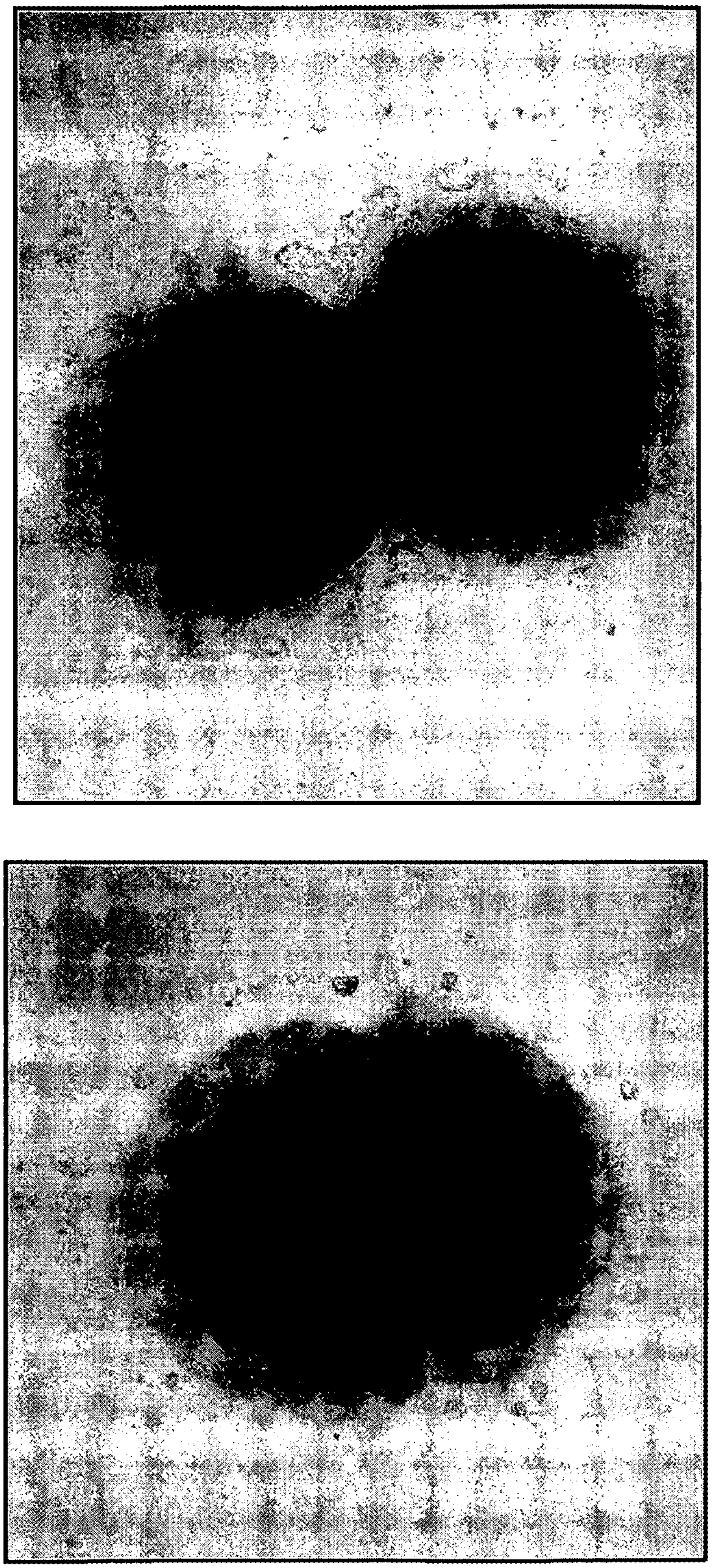
FIG. 34: Negative stained electron micrographs of GBS serotype III, strain isolate COH1, containing a plasmid insert to over-express GBS 80.
Figure 35:
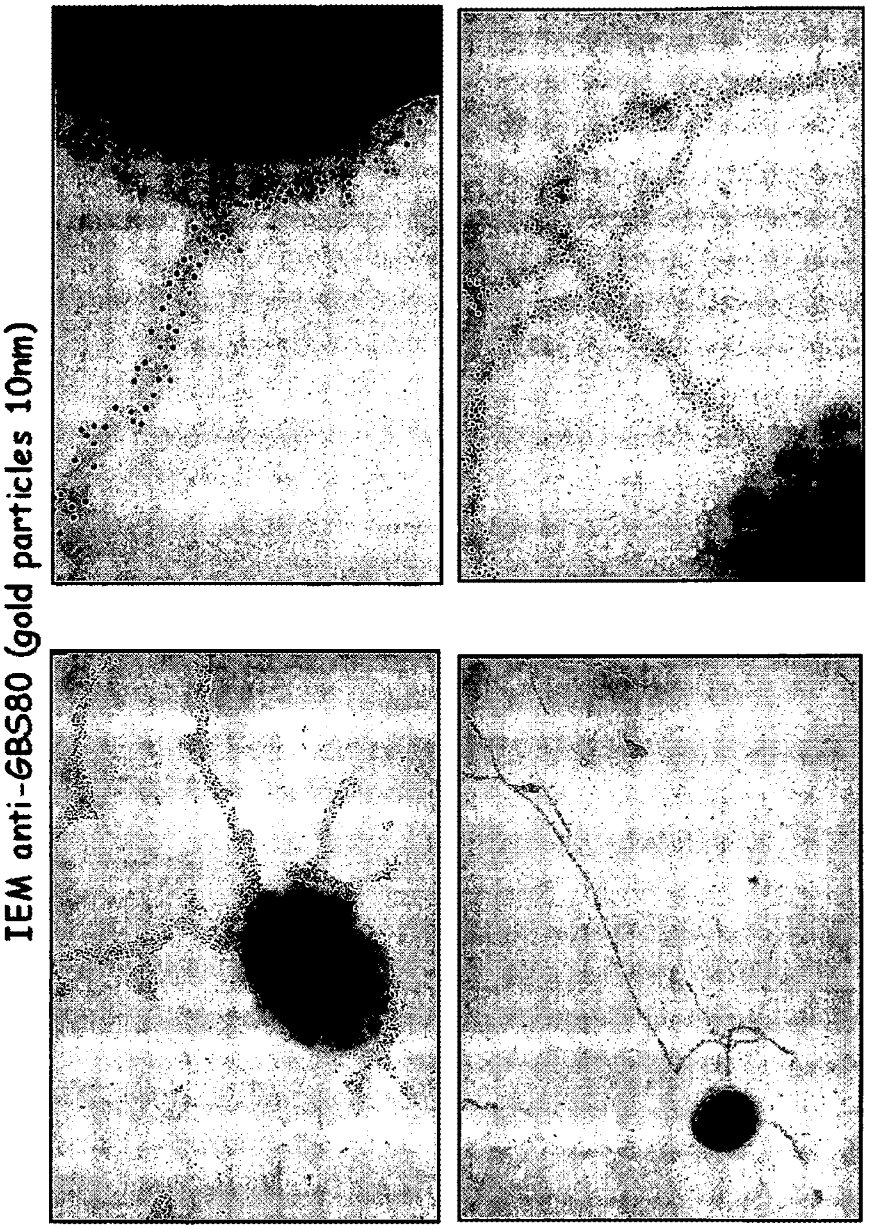
FIG. 35: Electron micrographs of surface exposed pili structures on GBS serotype III, strain isolate COH1, containing a plasmid insert to over-express GBS 80, stained with anti-GBS 80 antibodies (visualized with 10 nm gold particles).

While previous publications have speculated that pilus-like structures might be formed on the surface of streptococci, (see, e.g., Ton-That et al., Molecular Microbiology (2003) 50 (4): 1429-1438), these structures have not been previously visible in negative stain (non-specific) electron micrographs, throwing such speculations into doubt. For example, FIG. 34 presents electron micrographs of GBS serotype III, strain isolate COH1 with a plasmid insert to facilitate the overexpression of GBS 80. This EM photo was produced with a standard negative stain—no pilus structures are distinguishable. In addition, the use of such AI surface proteins in immunogenic compositions for the treatment or prevention of infection against a Gram positive bacteria has not been previously described.

Figure 16:
FIG. 16: Electron micrograph of surface exposed pili structure of wild type strain isolate COH1 of *Streptococcus agalactiae*.
Figure 17:
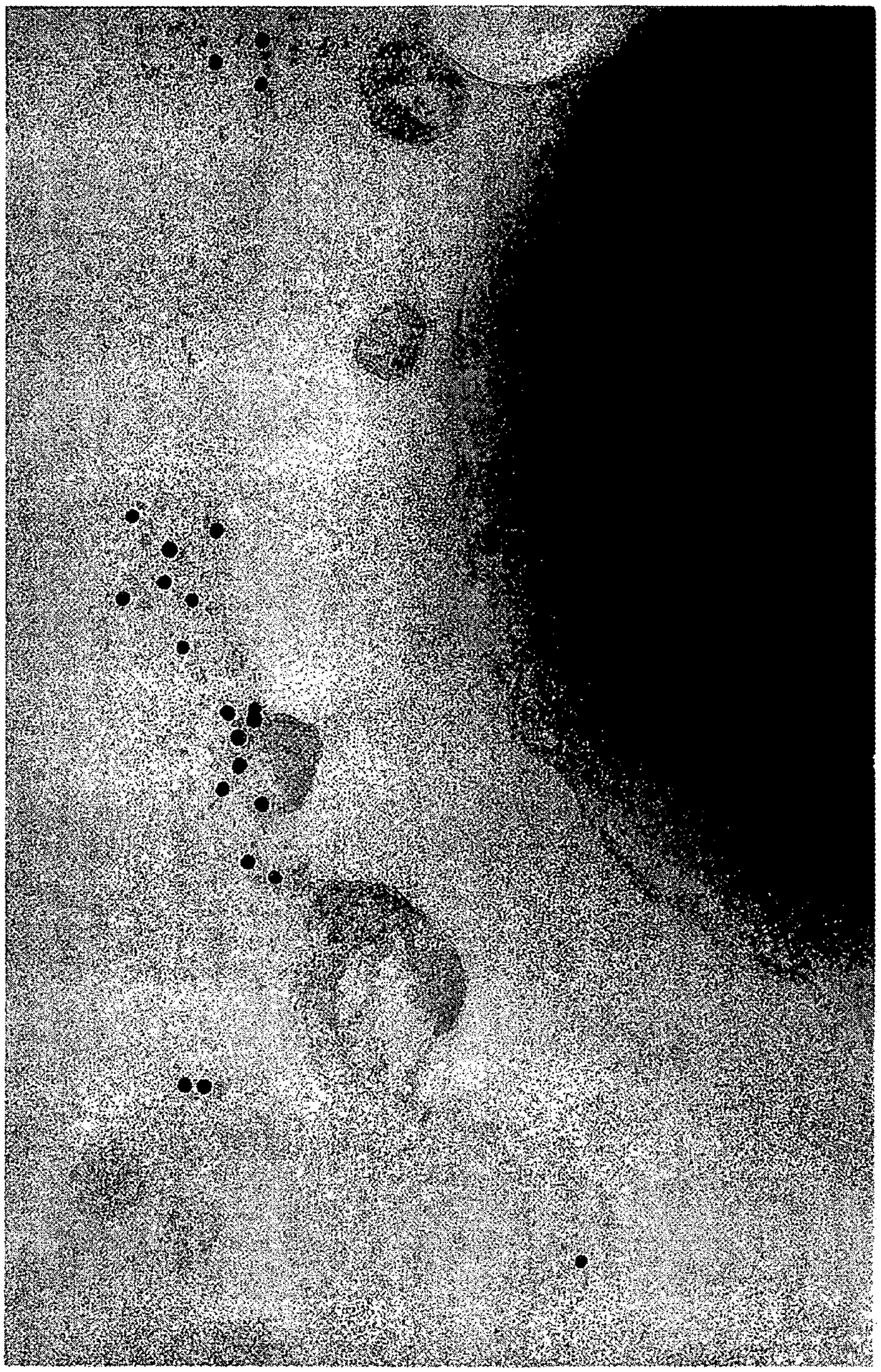
FIG. 17: Electron micrograph of surface exposed pili structure of wild type strain isolate COH1 of *Streptococcus agalactiae*.
Figure 19O:
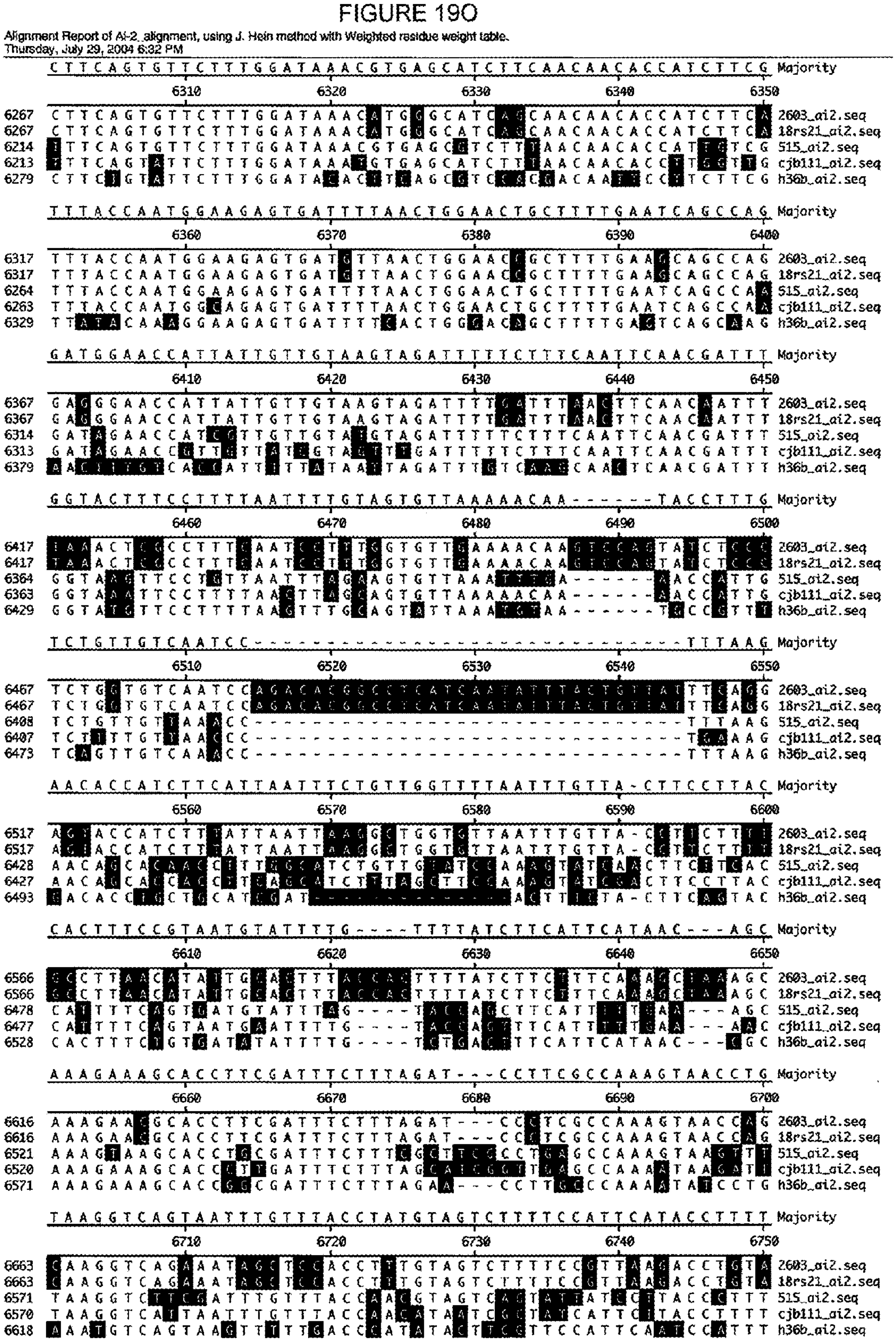
FIGS. 19A-AF: Alignment of polynucleotide sequences of AI-2 from serotype V, strain isolates 2603 (SEQ ID NO:304) and CJB111 (SEQ ID NO:307); serotype II, strain isolate 18RS21 (SEQ ID NO:305); serotype 1b, strain isolate H36B (SEQ ID NO:308); and serotype 1a, strain isolate 515 (SEQ ID NO:306). Majority sequence, SEQ ID NO:303.
Figure 49:
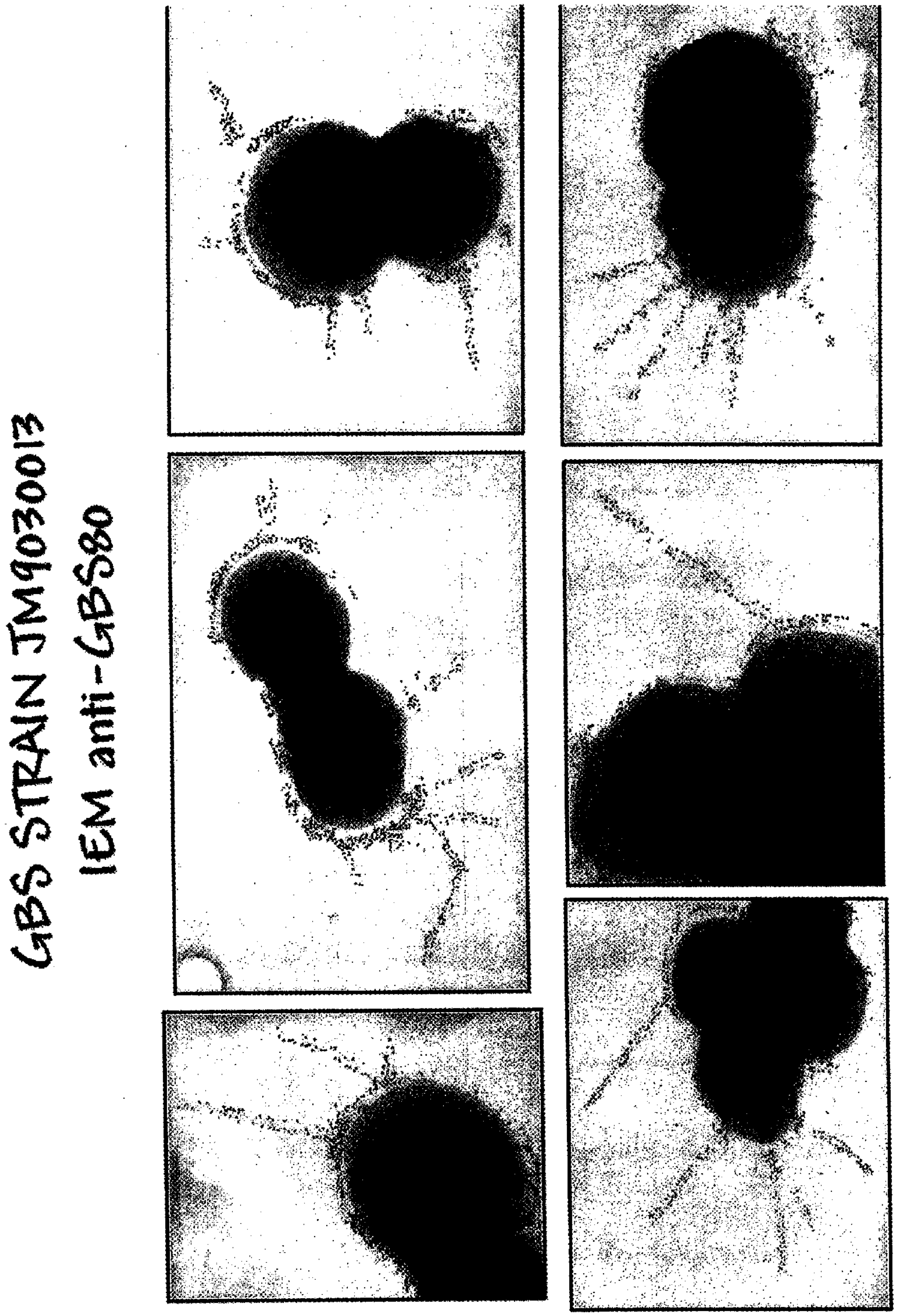
FIG. 49: IEM image of GBS 80 staining of a GBS serotype VIII strain JM9030013 that express pili.

Surprisingly, Applicants have now identified the presence of GBS 80 in surface exposed pilus formations visible in electron micrographs. These structures are only visible when the electron micrographs are specifically stained against an AI surface protein such as GBS 80. Examples of these electron micrographs are shown in FIGS. 11, 16 and 17, which reveal the presence of pilus structures in wild type COH1 *Streptococcus agalactiae*. Other examples of these electron micrographs are shown in FIG. 49, which reveals that GBS 80 is associated with pili in a wild type clinical isolate of *S. agalactiae*, JM9030013. (See FIG. 49.)

Figure 13:
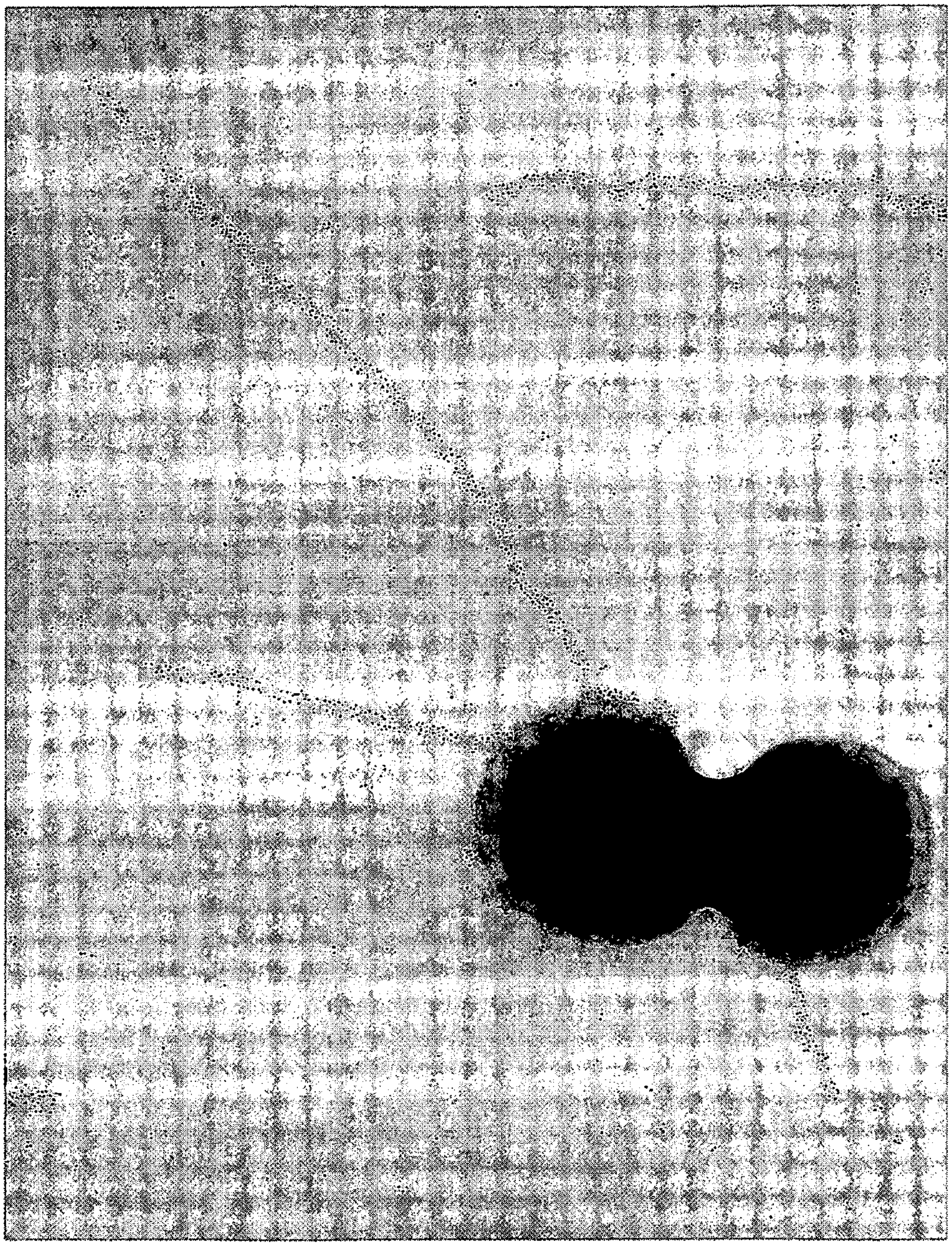
FIG. 13: Electron micrograph of surface exposed pili structures of strain isolate COH1 of *Streptococcus agalactiae* containing a plasmid insert encoding GBS 80.
Figure 14:
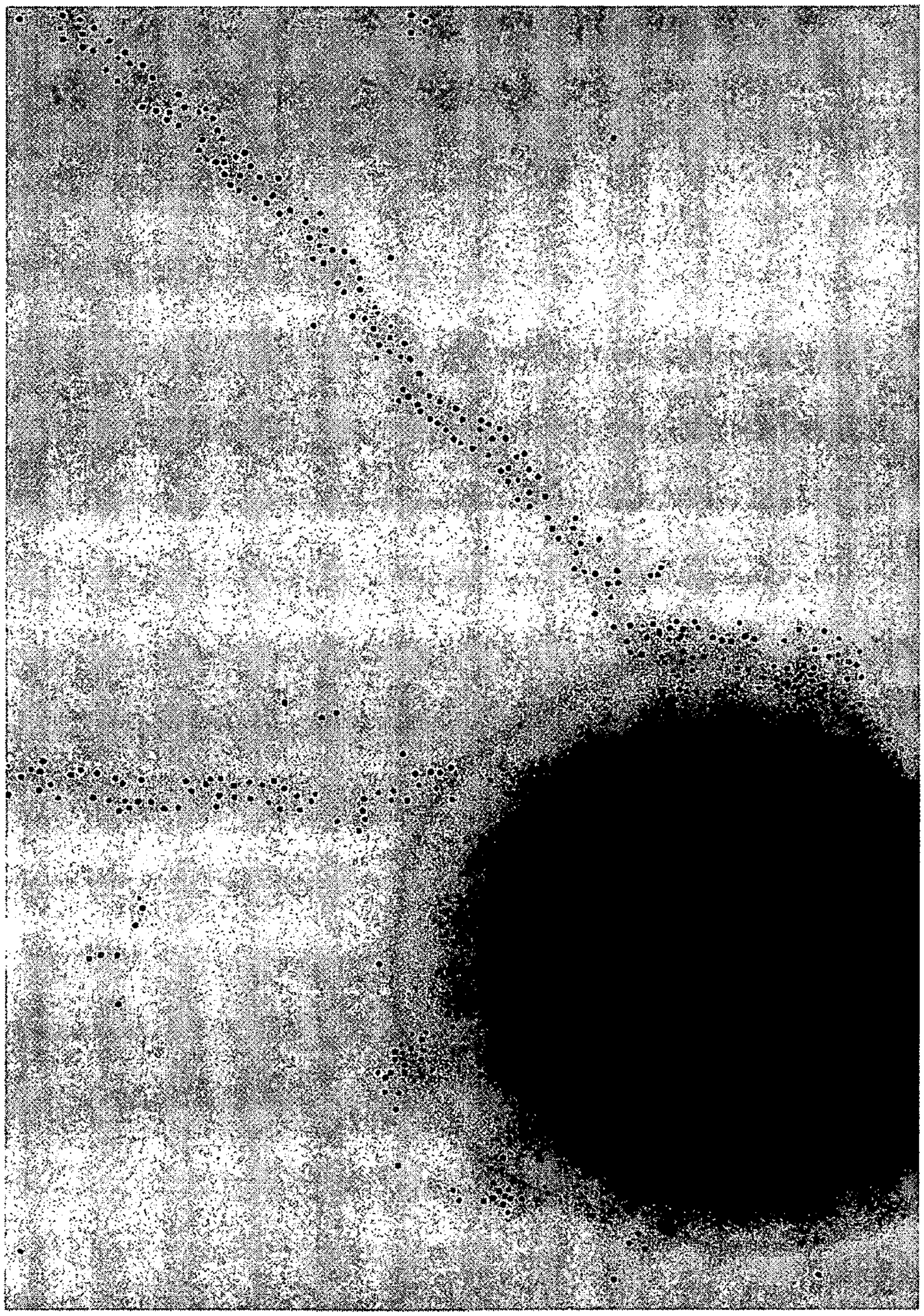
FIG. 14: Electron micrograph of surface exposed pili structures of strain isolate COH1 of *Streptococcus agalactiae* containing a plasmid insert encoding GBS 80.
Figure 15:
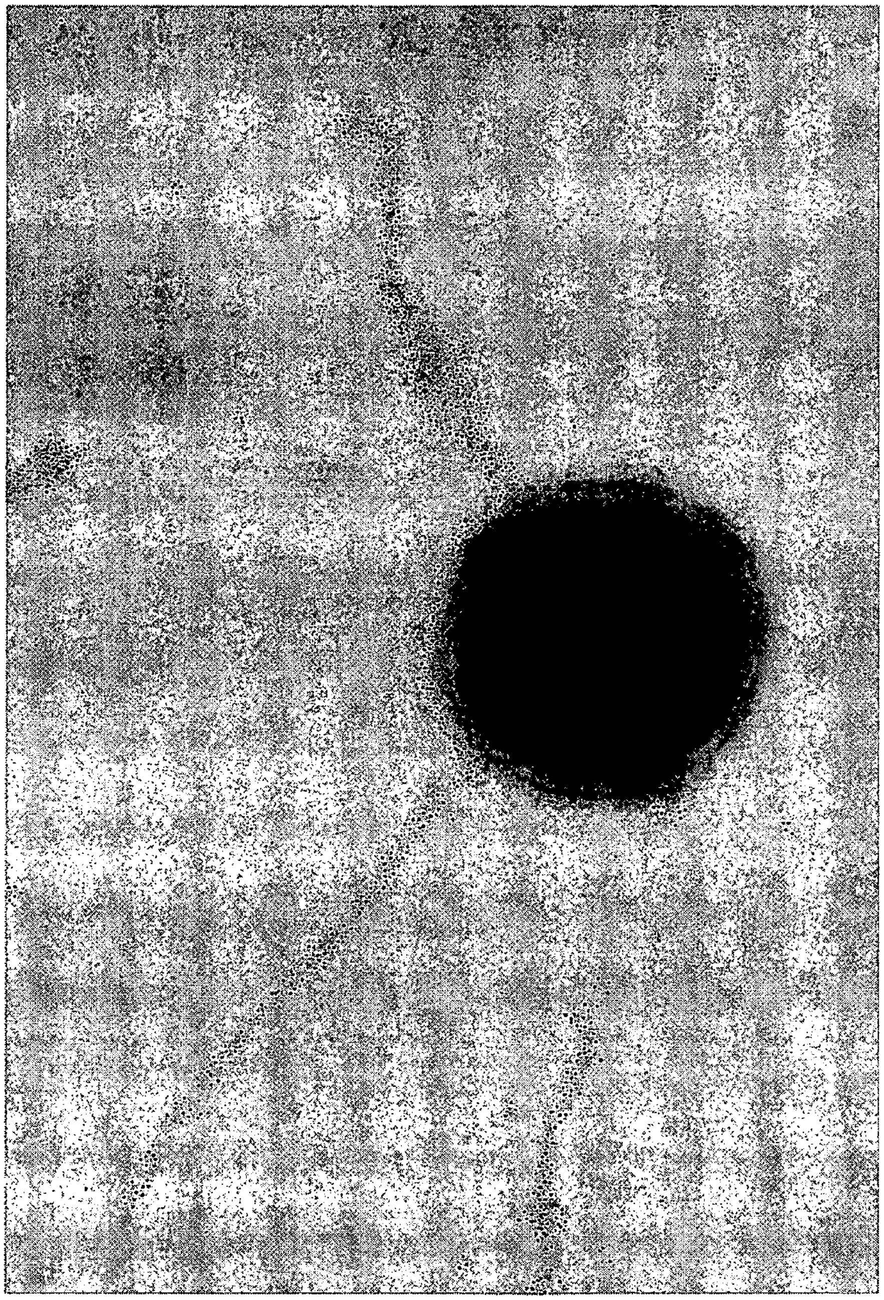
FIG. 15: Electron micrograph of surface exposed pili structures of strain isolate COH1 of *Streptococcus agalactiae* containing a plasmid insert encoding GBS 80.

Applicants have also constructed mutant GBS strains containing a plasmid comprising the GBS sequence resulting in the overexpression of GBS 80 within this mutant. The electron micrographs of FIGS. 13-15 are also stained against GBS 80 and reveal long, oligomeric structures containing GBS 80 which appear to cover portions of the surface of the bacteria and stretch far out into the supernatant.

Figure 61:
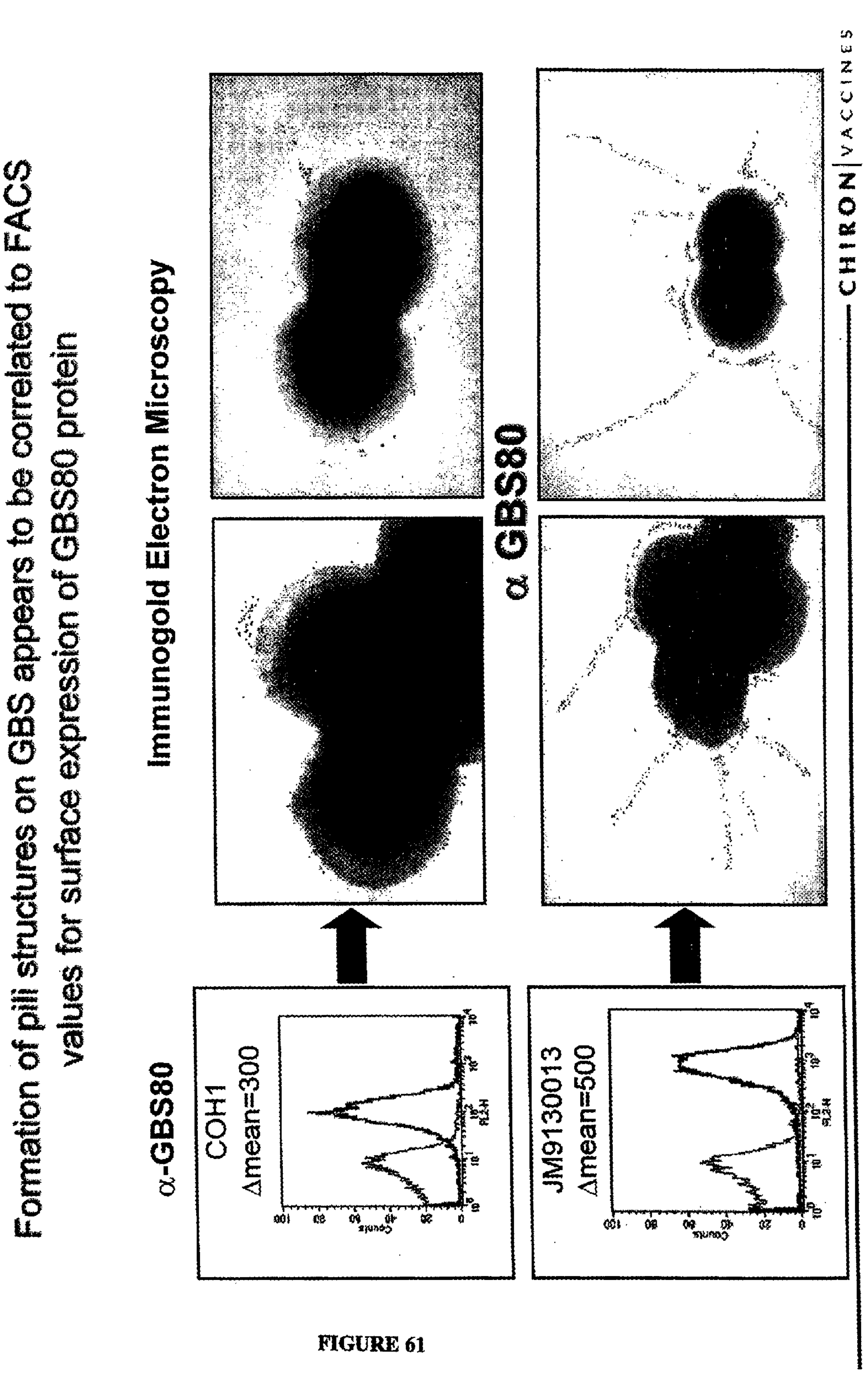
FIG. 61: Illustrates that surface expression of GBS 80 protein on GBS strains COH and JM9130013 correlates with formation of pili structures. Surface expression of GBS 80 was determined by FACS analysis using an antibody that cross-hybridizes with GBS 80. Formation of pili structures was determined by immunogold electron microscopy using gold-labeled anti-GBS 80 antibody.
Figure 62A:
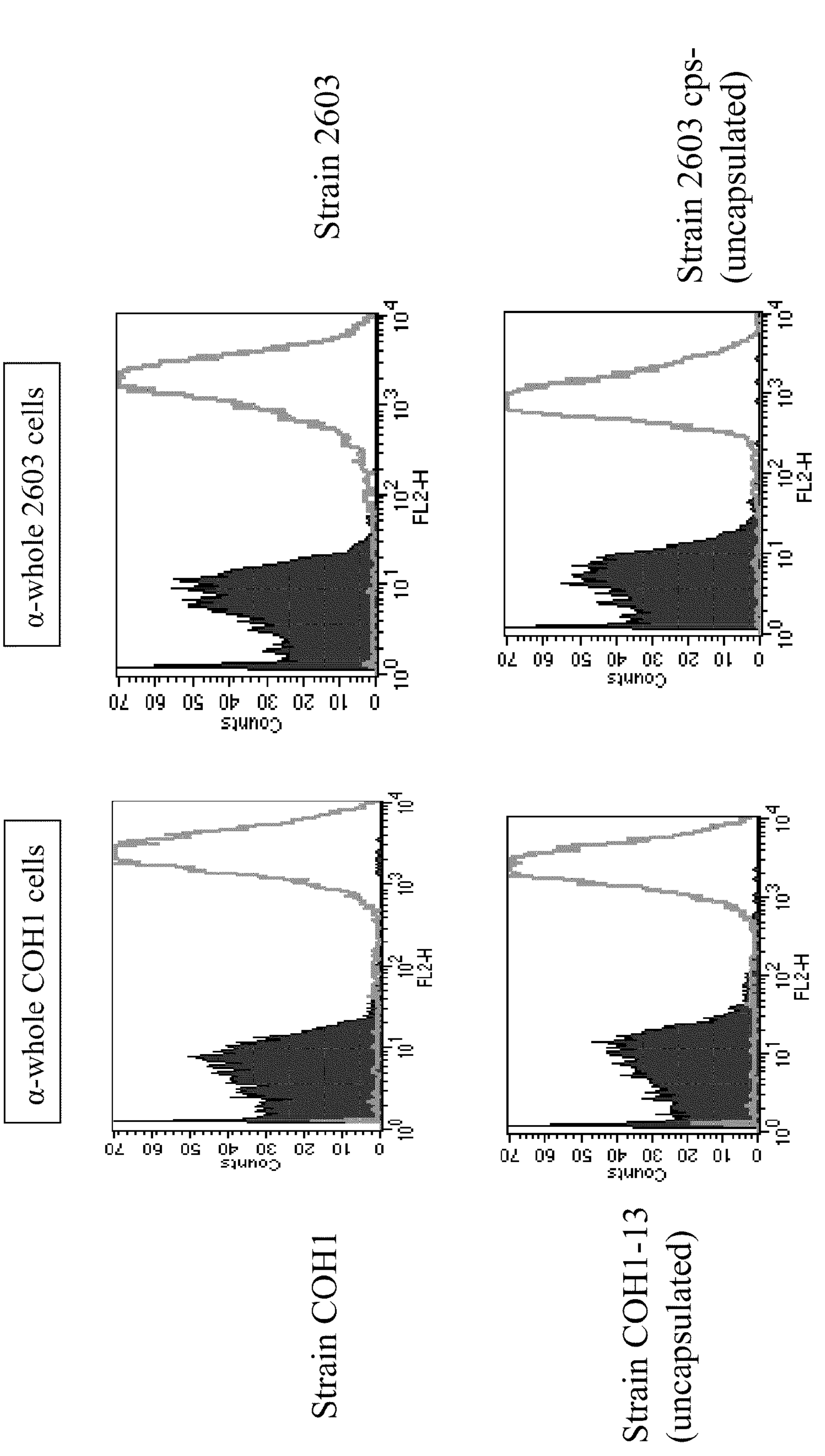
FIGS. 62A-D illustrate that surface exposure is capsule-dependent for GBS 322 but not for GBS 80.
Figure 62B:
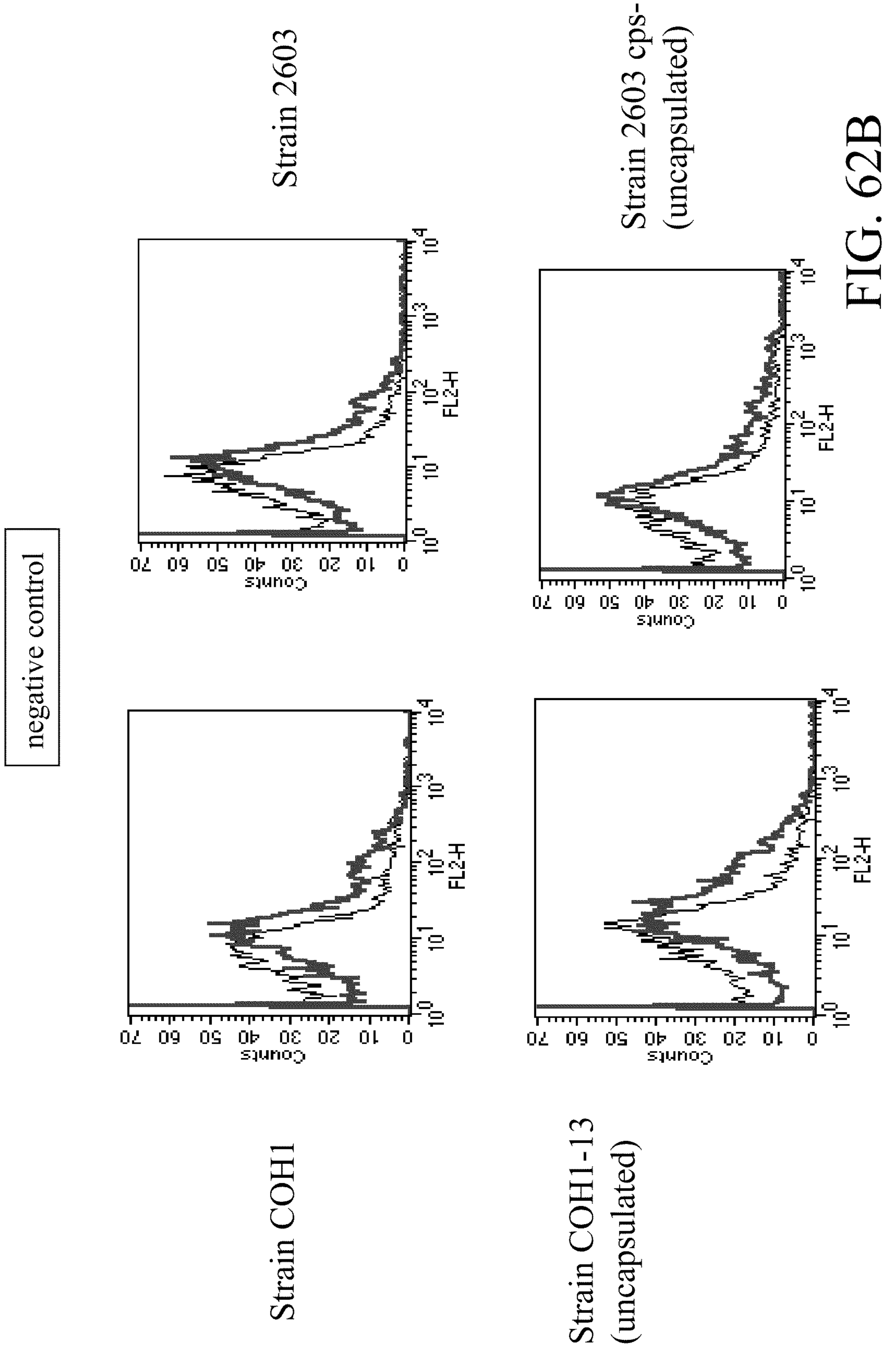
Figure 62C:
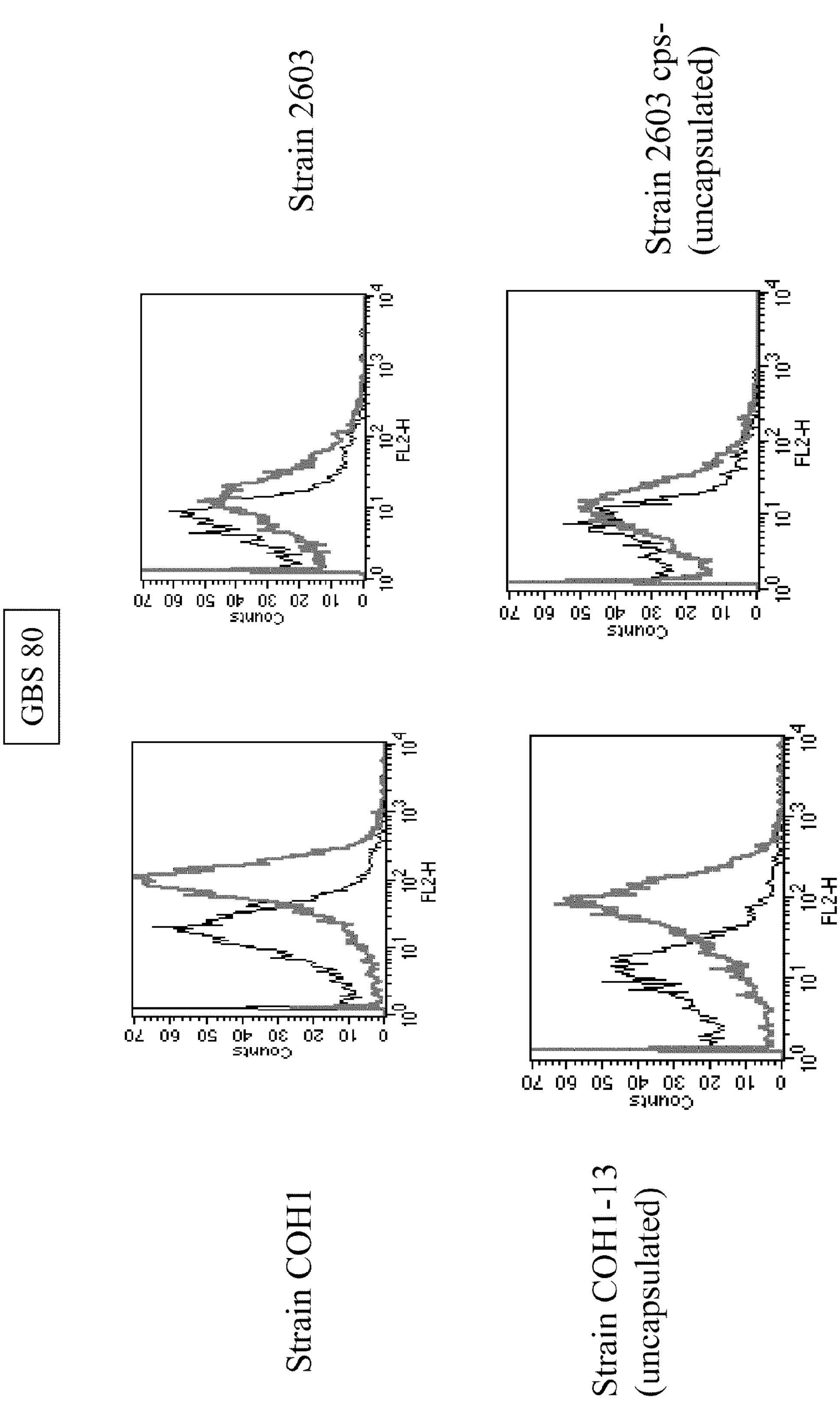
Figure 62D:
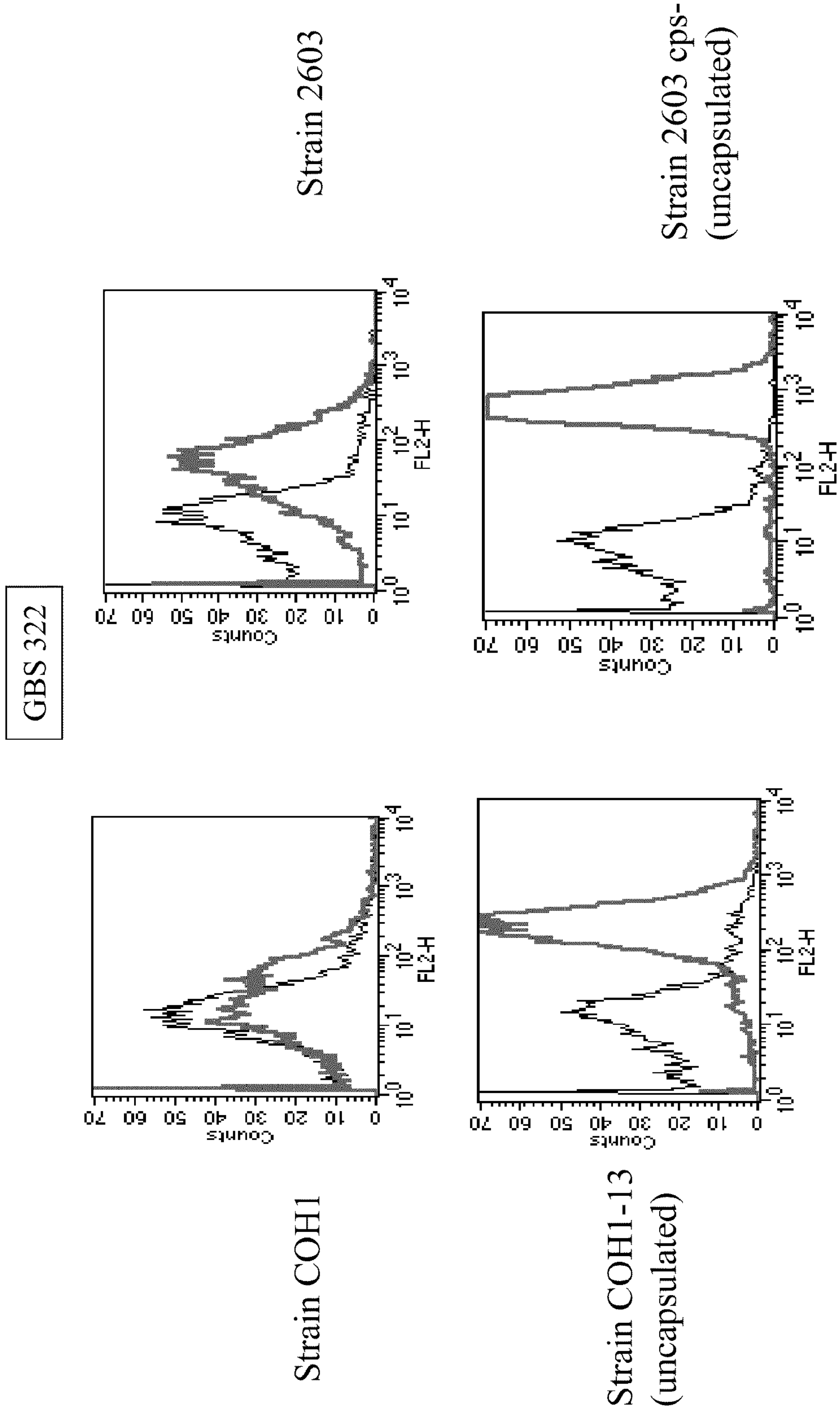

In some instances, the formation of pili structures on GBS appears to be correlated to surface expression of GBS 80. FIG. 61 provides FAC analysis of GBS 80 surface levels on bacterial strains COH1 and JM9130013 using an anti-GBS 80 antisera. Immunogold electron microscopy of the COH1 and JM9130013 bacteria using anti-GBS 80 antisera demonstrates that JM9130013 bacteria, which have higher values for GBS 80 surface expression, also form longer pili structures.

The surface exposure of GBS 80 on GBS is generally not capsule-dependent. FIG. 62 provides FACS analysis of capsulated and uncapsulated GBS analyzed with anti-GBS 80 and anti-GBS 322 antibodies. Surface exposure of GBS 80, unlike GBS 322, is not capsule dependent.

Figure 72:
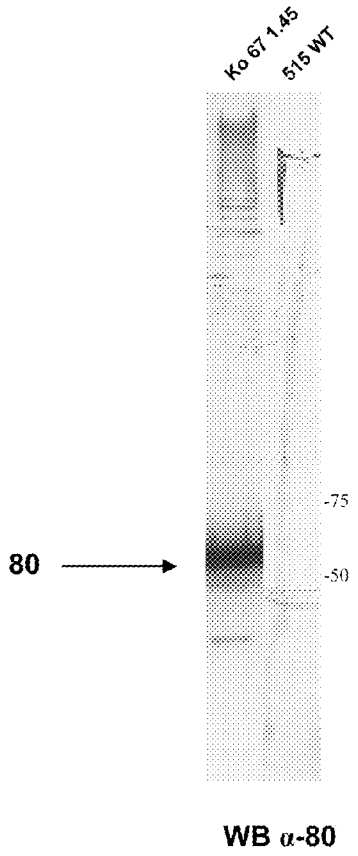
FIG. 72: Illustrates complementation of GBS 515 knocked out for GBS 67 expression with a construct overexpressing GBS 80.

An Adhesin Island surface protein, such as GBS 80 appears to be required for pili formation, as well as an Adhesin Island sortase. Pili are formed in Coh1 bacterial clones that overexpress GBS 80, but lack GBS 104, or one of the AI-1 sortases sag0647 or sag0648. However, pili are not formed in Coh1 bacterial clones that overexpress GBS 80 and lack both sag0647 and sag0648. Thus, for example, it appears that at least GBS 80 and a sortase, sag0647 or sag0648, may be necessary for pili formation. (See FIG. 48.) Overexpression of GBS 80 in GBS strain 515, which lacks an AI-1, also assembles GBS 80 into pili. GBS strain 515 contains an AI-2, and thus AI-2 sortases. The AI-2 sortases in GBS strain 515 apparently polymerize GBS 80 into pili. (See FIG. 42.) Overexpression of GBS 80 in GBS strain 515 cell knocked out for GBS 67 expression also apparently polymerizes GBS 80 into pili. (See FIG. 72.)

While GBS 80 appears to be required for GBS AI-1 pili formation, GBS 104 and sortase SAG0648 appears to be important for efficient AI-1 pili assembly. For example, high-molecular structures are not assembled in isogenic COH1 strains which lack expression of GBS 80 due to gene disruption and are less efficiently assembled in isogenic COH1 strains which lack the expression of GBS 104 (see FIG. 41). This GBS strain comprises high molecular weight pili structures composed of covalently linked GBS 80 and GBS 104 subunits. In addition, deleting SAG0648 in COH1 bacteria interferes with assembly of some of the high molecular weight pili structures. Thus, indicating that SAG0648 plays a role in assembly of these pilin species. (See FIG. 41).

Figure 50:
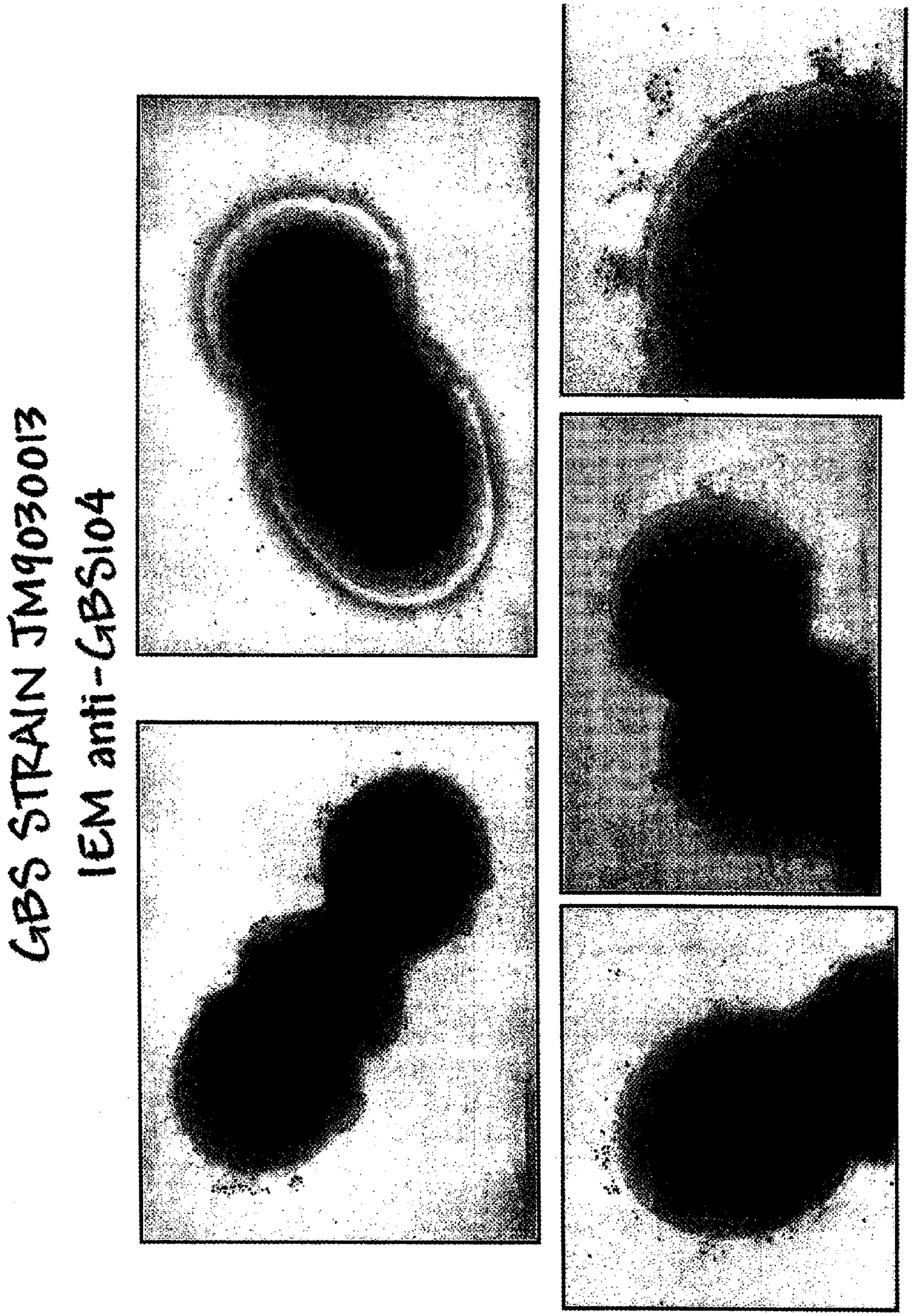
FIG. 50: IEM image of GBS 104 staining of a GBS serotype VIII strain JM9030013 that express pili.

EM photos confirm the involvement of AI surface protein GBS 104 within the hyperoligomeric structures of a GBS strain adapted for increased GBS 80 expression. (See FIGS. 34-41 and Example 6). In a wild type serotype VIII GBS strain, strain JM9030013, IEM identifies GBS 104 as forming clusters on the bacterial surface. (See FIG. 50.)

GBS 52 also appears to be a component of the GBS pili. Immunoblots using an anti-GBS 80 antisera on total cell extracts of Coh1 and a GBS 52 null mutant Coh1 reveal a shift in detected proteins in the Coh1 wild type strain relative to the GBS 52 null mutant Coh1 strain. The shifted proteins were also detected in the wild type Coh1 bacteria with an anti-GBS 52 antisera, indicating that the GBS 52 may be present in the pilus. (See FIG. 45.)

In one embodiment, the invention includes a composition comprising oligomeric, pilus-like structures comprising an AI surface protein such as GBS 80. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyper-oligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine amino acid residue.

AI surface proteins or fragments thereof to be incorporated into the oligomeric, pilus-like structures of the invention will preferably include one or both of a pilin motif comprising a conserved lysine residue and an E box motif comprising a conserved glutamic acid residue.

More than one AI surface protein may be present in the oligomeric, pilus-like structures of the invention. For example, GBS 80 and GBS 104 may be incorporated into an oligomeric structure. Alternatively, GBS 80 and GBS 52 may be incorporated into an oligomeric structure, or GBS 80, GBS 104 and GBS 52 may be incorporated into an oligomeric structure.

In another embodiment, the invention includes compositions comprising two or more AI surface proteins. The composition may include surface proteins from the same adhesin island. For example, the composition may include two or more GBS AI-1 surface proteins, such as GBS 80, GBS 104 and GBS 52. The surface proteins may be isolated from Gram positive bacteria or they may be produced recombinantly.

The oligomeric, pilus like structures may be used alone or in the combinations of the invention. In one embodiment, the invention comprises a GBS Adhesin Island protein in oligomeric form, preferably in a hyperoligomeric form. In one embodiment, the invention comprises a composition comprising one or more GBS Adhesin Island 1 ("AI-1") proteins and one or more GBS Adhesin Island 2 ("AI-2") proteins, wherein one or more of the Adhesin Island proteins is in the form of an oligomer, preferably in a hyperoligomeric form.

The oligomeric, pilus-like structures of the invention may be combined with one or more additional GBS proteins. In one embodiment, the oligomeric, pilus-like structures comprise one or more AI surface proteins in combination with a second GBS protein. The second GBS protein may be a known GBS antigen, such as GBS 322 (commonly referred to as "sip") or GBS 276. Nucleotide and amino acid sequences of GBS 322 sequenced from serotype V isolated strain 2603 V/R are set forth in WO 02/35771 as SEQ ID 8539 and SEQ ID 8540 and in the present specification as SEQ ID NOs: 38 and 39. A particularly preferred GBS 322 polypeptide lacks the N-terminal signal peptide, amino acid residues 1-24. An example of a preferred GBS 322 polypeptide is a 407 amino acid fragment and is shown in SEQ ID NO: 40. Examples of preferred GBS 322 polypeptides are further described in WO 2005/002619 hereby incorporated by reference.

Additional GBS proteins which may be combined with the GBS AI surface proteins of the invention are also described in WO 2005/002619. These GBS proteins include GBS 91, GBS 184, GBS 305, GBS 330, GBS 338, GBS 361, GBS 404, GBS 690, and GBS 691.

Additional GBS proteins which may be combined with the GBS AI surface proteins of the invention are described in WO 02/34771.

GBS polysaccharides which may be combined with the GBS AI surface proteins of the invention are described in WO 2004/041157. For example, the GBS AI surface proteins of the invention may be combined with a GBS polysaccharides selected from the group consisting of serotype Ia, Ib, Ia/c, II, III, IV, V, VI, VII and VIII.

The oligomeric, pilus-like structures may be isolated or purified from bacterial cultures in which the bacteria express an AI surface protein. The invention therefore includes a method for manufacturing an oligomeric AI surface antigen comprising culturing a GBS bacterium that expresses the oligomeric AI protein and isolating the expressed oligomeric AI protein from the GBS bacteria. The AI protein may be collected from secretions into the supernatant or it may be purified from the bacterial surface. The method may further comprise purification of the expressed AI protein. Preferably, the AI protein is in a hyperoligomeric form. Macromolecular structures associated with oligomeric pili are observed in the supernatant of cultured GBS strain Coh1. (See FIG. 46.) These pili are found in the supernatant at all growth phases of the cultured Coh1 bacteria. (See FIG. 47.)

The oligomeric, pilus-like structures may be isolated or purified from bacterial cultures overexpressing an AI surface protein. The invention therefore includes a method for manufacturing an oligomeric Adhesin Island surface antigen comprising culturing a GBS bacterium adapted for increased AI protein expression and isolation of the expressed oligomeric Adhesin Island protein from the GBS bacteria. The AI protein may be collected from secretions into the supernatant or it may be purified from the bacterial surface. The method may further comprise purification of the expressed Adhesin Island protein. Preferably, the Adhesin Island protein is in a hyperoligomeric form.

The GBS bacteria are preferably adapted to increase AI protein expression by at least two (e.g., 2, 3, 4, 5, 8, 10, 15, 20, 25, 30, 35, 40, 45, 50, 60, 70, 80, 90, 100, 125, 150 or 200) times wild type expression levels.

GBS bacteria may be adapted to increase AI protein expression by any means known in the art, including methods of increasing gene dosage and methods of gene upregulation. Such means include, for example, transformation of the GBS bacteria with a plasmid encoding the AI protein. The plasmid may include a strong promoter or it may include multiple copies of the sequence encoding the AI protein. Optionally, the sequence encoding the AI protein within the GBS bacterial genome may be deleted. Alternatively, or in addition, the promoter regulating the GBS Adhesin Island may be modified to increase expression.

GBS bacteria harbouring a GBS AI-1 may also be adapted to increase AI protein expression by altering the number adenosine nucleotides present at two sites in the intergenic region between AraC and GBS 80. See FIG. 197 A, which is a schematic showing the organization of GBS AI-1 and FIG. 197 B, which provides the sequence of the intergenic region between AraC and GBS 80 in the AI. The adenosine tracts which applicants have identified as influencing GBS 80 surface expression are at nucleotide positions 187 and 233 of the sequence shown in FIG. 197 B (SEQ ID NO:273). Applicants determined the influence of these adenosine tracts on GBS 80 surface expression in strains of GBS bacteria harboring four adenosines at position 187 and six adenosines at position 233, five adenosines at position 187 and six adenosines position 233, and five adenosines at position 187 and seven adenosines at position 233. FACS analysis of these strains using anti GBS 80 antiserum determined that an intergenic region with five adenosines at position 187 and six adenosines at position 233 had higher expression levels of GBS 80 on their surface than other stains. See FIG. 197 C for results obtained from the FACS analysis. Therefore, manipulating the number of adenosines present at positions 187 and 233 of the AraC and GBS 80 intergenic region may further be used to adapt GBS to increase AI protein expression.

The invention further includes GBS bacteria which have been adapted to produce increased levels of AI surface protein. In particular, the invention includes GBS bacteria which have been adapted to produce oligomeric or hyperoligomeric AI surface protein, such as GBS 80. In one embodiment, the Gram positive bacteria of the invention are inactivated or attenuated to permit in vivo delivery of the whole bacteria, with the AI surface protein exposed on its surface.

The invention further includes GBS bacteria which have been adapted to have increased levels of expressed AI protein incorporated in pili on their surface. The GBS bacteria may be adapted to have increased exposure of oligomeric or hyperoligomeric AI proteins on its surface by increasing expression levels of a signal peptidase polypeptide. Increased levels of a local signal peptidase expression in Gram positive bacteria (such us LepA in GAS) are expected to result in increased exposure of pili proteins on the surface of Gram positive bacteria. Increased expression of a leader peptidase in GBS may be achieved by any means known in the art, such as increasing gene dosage and methods of gene upregulation. The GBS bacteria adapted to have increased levels of leader peptidase may additionally be adapted to express increased levels of at least one pili protein.

Alternatively, the AI proteins of the invention may be expressed on the surface of a non-pathogenic Gram positive bacteria, such as *Streptococcus gordonii* (See, e.g., Byrd et al., "Biological consequences of antigen and cytokine co-expression by recombinant *Streptococcus gordonii* vaccine vectors", Vaccine (2002) 20:2197-2205) or *Lactococcus lactis* (See, e.g., Mannam et al., "Mucosal Vaccine Made from Live, Recombinant *Lactococcus lactis* Protects Mice against Pharyngeal Infection with *Streptococcus pyogenes*" Infection and Immunity (2004) 72 (6):3444-3450). As used herein, non-pathogenic Gram positive bacteria refer to Gram positive bacteria which are compatible with a human host subject and are not associated with human pathogenesis. Preferably, the non-pathogenic bacteria are modified to express the AI surface protein in oligomeric, or hyper-oligomeric form. Sequences encoding for an AI surface protein and, optionally, an AI sortase, may be integrated into the non-pathogenic Gram positive bacterial genome or inserted into a plasmid. The non-pathogenic Gram positive bacteria may be inactivated or attenuated to facilitate in vivo delivery of the whole bacteria, with the AI surface protein exposed on its surface. Alternatively, the AI surface protein may be isolated or purified from a bacterial culture of the non-pathogenic Gram positive bacteria. For example, the AI surface protein may be isolated from cell extracts or culture supernatants. Alternatively, the AI surface protein may be isolated or purified from the surface of the non-pathogenic Gram positive bacteria.

The non-pathogenic Gram positive bacteria may be used to express any of the Gram positive bacterial Adhesin Island proteins described herein, including proteins from a GBS Adhesin Island, a GAS Adhesin Island, or a S pneumo Adhesin Island. The non-pathogenic Gram positive bacteria are transformed to express an Adhesin Island surface protein. Preferably, the non-pathogenic Gram positive bacteria also express at least one Adhesin Island sortase. The AI transformed non-pathogenic Gram positive bacteria of the invention may be used to prevent or treat infection with a pathogenic Gram positive bacteria, such as GBS, GAS or *Streptococcus pneumoniae*. The non-pathogenic Gram positive bacteria may express the Gram positive bacterial Adhesin Island proteins in oligomeric forms that further comprise adhesin island proteins encoded within the genome of the non-pathogenic Gram positive bacteria.

Applicants modified *L. lactis* to demonstrate that it can express GBS AI polypeptides. *L. lactis* was transformed with a construct encoding GBS 80 under its own promoter and terminator sequences. The transformed *L. lactis* appeared to express GBS 80 as shown by Western blot analysis using anti-GBS 80 antiserum. See lanes 6 and 7 of the Western Blots provided in FIGS. 133A and 133B (133A and 133B are two different exposures of the same Western blot). See also Example 13.

Applicants also transformed *L. lactis* with a construct encoding GBS AI-1 polypeptides GBS 80, GBS 52, SAG0647, SAG0648, and GBS 104 under the GBS 80 promoter and terminator sequences. These *L. lactis* expressed high molecular weight structures that were immunoreactive with anti-GBS 80 in immunoblots. See FIG. 134, lane 2, which shows detection of a GBS 80 monomer and higher molecular weight polymers in total transformed *L. lactis* extracts. Thus, it appeared that *L. lactis* is capable of expressing GBS 80 in oligomeric form. The high molecular weight polymers were not only detected in *L. lactis* extracts, but also in the culture supernatants. See FIG. 135 at lane 4. See also Example 14. Thus, the GBS AI polypeptides in oligomeric form can be isolated and purified from either *L. lactis* cell extracts or culture supernatants. These oligomeric forms can, for instance, be isolated from cell extracts or culture supernatants by release by sonication. See FIGS. 136A and B. See also FIG. 171, which shows purification of GBS pili from whole extracts of *L. lactis* expressing the GBS AI-1 following sonication and gel filtration on a Sephacryl HR 400 column.

Furthermore, the *L. lactis* transformed with the construct encoding GBS AI-1 polypeptides GBS 80, GBS 52, SAG0647, SAG0648, and GBS 104 under the GBS 80 promoter and terminator sequences expressed the GBS AI-1 polypeptides on its surface. FACS analysis of these transformed *L. lactis* detected cell surface expression of both GBS 80 and GBS 104. The surface expression levels of GBS 80 and GBS 104 on the transformed *L. lactis* were similar to the surface expression levels of GBS 80 and GBS 104 on GBS strains COH1 and JM9130013, which naturally express GBS AI-1.

See FIG. 169 for FACS analysis data for *L. lactis* transformed with GBS AI-1 and wildtype JM9130013 bacteria using anti-GBS 80 and GBS 104 antisera. Table 40 provides the results of FACS analysis of transformed *L. lactis*, COH1, and JM9130013 bacteria using anti-GBS 80 and anti-GBS 104 antisera. The numbers provided represent the mean fluorescence value difference calculated for immune versus pre-immune sera obtained for each bacterial strain.

TABLE 40

FACS analysis of *L. lactis* and GBS bacteria strains expressing GBS AI-1

| | Anti-GBS 80 antiserum | Anti-GBS 104 antiserum |
|---|---|---|
| GBS AI-1 transformed *L. lactis* | 298 | 251 |
| GBS COH1 | 305 | 305 |
| GBS JM9130013 | 461 | 355 |

Immunogold-electronmicroscopy performed with anti-GBS 80 primary antibodies detected the presence of pilus structures on the surface of the *L. lactis* bacteria expressing GBS AI-1, confirming the results of the FACS analysis. See FIGS. 168 B and C. Interestingly, this expression of GBS pili on the surface of the *L. lactis* induced *L. lactis* aggregation. See FIG. 170. Thus, GBS AI polypeptides may also be isolated and purified from the surface of *L. lactis*. The ability of *L. lactis* to express GBS AI polypeptides on its surface also demonstrates that it may be useful as a host to deliver GBS AI antigens.

In fact, immunization of mice with *L. lactis* transformed with GBS AI-1 was protective in a subsequent challenge with GBs. Female mice were immunized with *L. lactis* transformed with GBS AI-1. The immunized female mice were bred and their pups were challenged with a dose of GBS sufficient to kill 90% of non-immunized pups. Detailed protocols for intranasal and subcutaneous immunization of mice with transformed *L. lactis* can be found in Examples 18 and 19, respectively. Table 43 provides data showing that immunization of the female mice with *L. lactis* expressing GBS AI-1 (LL-AI 1) greatly increased survival rate of challenged pups relative to both a negative PBS control (PBS) and a negative *L. lactis* control (LL 10 E9, which is wild type *L. lactis* not transformed to express GBS AI-1).

TABLE 43

Protection of Mice Immunized with *L. lactis* expressing GBS AI-1

| Immunization Route | Antigen | Alive/ Treated | Survival % | Survival % Range | p value |
|---|---|---|---|---|---|
| Intraperitoneum | Recombinant GBS 80 | 16/18 | 89 | 80-100 | <0.001 |
| Subcutaneous | LL-AI 1 10 E9 | 40/49 | 82 | 70-90 | <0.001 |
| | LL-AI 1 10 E10 | 50/60 | 83 | 60-100 | <0.001 |
| | PBS | 4/30 | 13 | 0-30 | |
| | LL 10 E9 | 3/57 | 5 | 0-20 | |
| Intranasal | LL-AI 1 10 E9 | 22/60 | 37 | 0-100 | 0.02 |
| | LL-AI 1 10 E10 | 31/49 | 63 | 30-90 | <0.001 |
| | LL 10 E9 | 2/27 | 7 | 0-20 | |

Table 51 provides further evidence that immunization of mice with *L. lactis* transformed with GBS AI-1 is protective against GBs.

TABLE 51

Further Protection of Mice Immunized with *L. lactis* expressing GBS AI-1

| Antigen | Immunization route | Alive/ Treated | Survival % (Pval < 0.0000001) |
|---|---|---|---|
| Recombinant GBS 80 | IP | 48/50 | 92 |
| Recombinant GBS 80 | SC | 21/30 | 70 |
| *L. lactis* + AI1 $10^6$ cfu | SC | 6/66 | 9 |
| *L. lactis* + AI1 $10^7$ cfu | SC | 47/70 | 73 |
| *L. lactis* + AI1 $10^8$ cfu | SC | 116/153 | 76 |
| *L. lactis* + AI1 $10^9$ cfu | SC | 98/118 | 83 |
| *L. lactis* + AI1 $10^{10}$ cfu | SC | 107/129 | 83 |
| *L. lactis* $10^{10}$ cfu | SC | 4/83 | 5 |
| PBS | SC | 6/110 | 5 |
| *L. lactis* + AI1 $10^{10}$ cfu | IN | 51/97 | 52 |
| *L. lactis* $10^{11}$ cfu | IN | 1/40 | 7 |
| PBS | IN | 0/37 | 0 |

Protection of immunized mice with *L. lactis* expressing the GBS AI-1 is at least partly due to a newly raised antibody response. Table 46 provides anti-GBS 80 antibody titers detected in serum of the mice immunized with *L. lactis* expressing the GBS AI-1 as described above. Mice immunized with *L. lactis* expressing the GBS AI-1 have anti-GBS 80 antibody titres, which are not observed in mice immunized with *L. lactis* not transformed to express the GBS AI-1. Further, as expected from the survival data, mice subcutaneously immunized with *L. lactis* transformed to express the GBS AI-1 have significantly higher serum anti-GBS 80 antibody titers than mice intranasally immunized with *L. lactis* transformed to express the GBS AI-1.

TABLE 46

Antibody Responses against GBS 80 in Serum of Mice Immunized with *L. lactis* Expressing GBS AI-1

| Antigen | Ab Titre Obtained Following: Subcutaneous Immunization | Intranasal Immunization | Intraperitoneal Immunization |
|---|---|---|---|
| LL 10 E9 | 0 | 0 | |
| LL-AI 1 10 E9 | 14000 | 50 | |
| LL-AI 1 10 E10 | 25000 | 406 | |
| Recombinant GBS 80 | | | 120000 |

Anti-GBS 80 antibodies of the IgA isotype were specifically detected in various body fluids of the mice subcutaneously or intranasally immunized with *L. lactis* expressing the GBS AI-1.

TABLE 47

Anti-GBS 80 IgA Antibodies Detected in Mouse Tissues Following Immunization with *L. lactis* Expressing GBS AI-1

| Antigen | Immunization route | Anti-GBS 80 IgA Antibodies Detected in: Serum | Vaginal Wash | Nasal Wash |
|---|---|---|---|---|
| LL 10 E9 | | 0 | 0 | 0 |
| LL-AI 1 | Subcutaneous | 0 | 25 | 20 |
| LL-AI 1 | Intranasal | 140 | 0 | 150 |
| GBS 80 | Intraperitoneal | 60 | 0 | |

Furthermore, opsonophagocytosis assays also demonstrated that at least some of the antiserum produced against the *L. lactis* expressing GBS AI 1 is opsonic for GBs. See FIG. 161.

Figure 231:
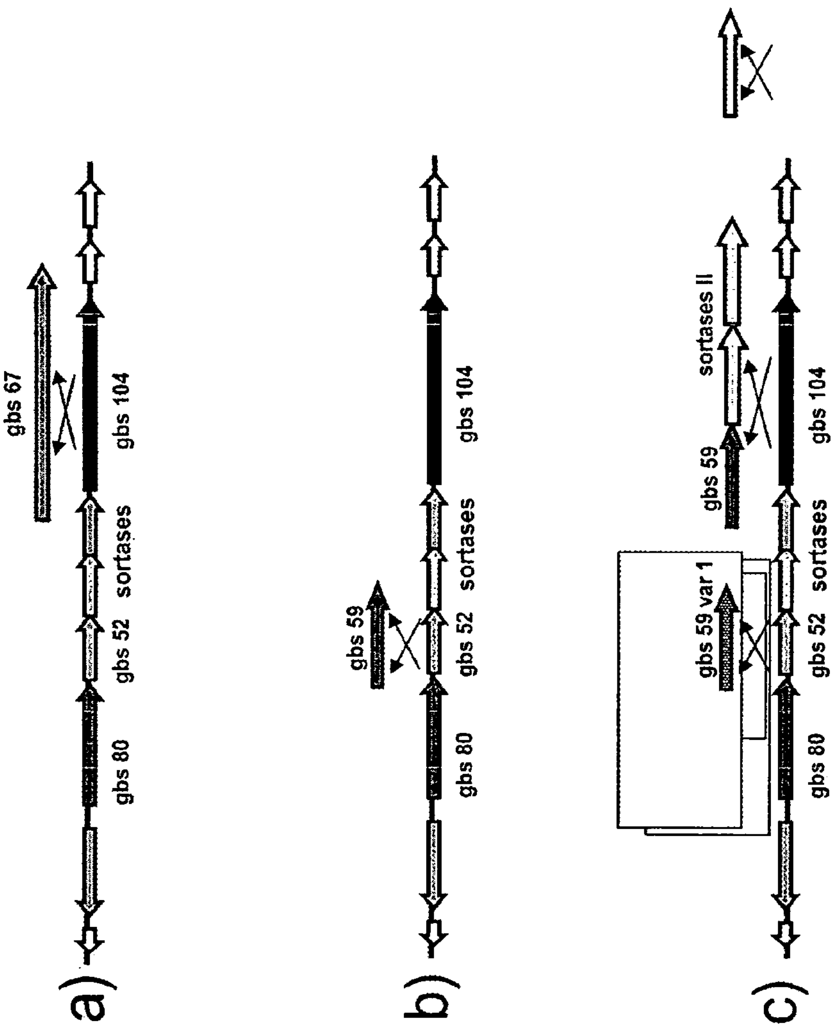

To obtain protection of against GBS across a greater number of strains and serotypes, it is possible to transform *L. lactis* with a recombinant GBS AI encoding both GBS AI-1 and AI-2, i.e., a hybrid GBS AI. By way of example, a hybrid GBS AI may be a GBS AI-1 with a replacement of the GBS 104 gene with a GBS 67 gene. A schematic of such a hybrid GBS AI is depicted in FIG. 231 A. A hybrid GBS AI may alternatively be a GBS AI-1 with a replacement of the GBS 52 gene with a GBS 59 gene. See the schematic at FIG. 231 B. Alternatively, a hybrid GBS AI may be a GBS AI-1 with a substitution of a GBS 59 polypeptide for the GBS 52 gene and a substitution of the GBS 104 gene for genes encoding GBS 59 and the two GBS AI-2 sortases. Another example of a hybrid GBS AI is a GBS AI-1 with the substitution of a GBS 59 gene for the GBS 52 gene and a GBS 67 for the GBS 104 gene. See the schematic at FIG. 232. A further example of a hybrid GBS AI is a GBS AI-1 having a GBS 59 gene and genes encoding the GBS AI-2 sortases in place of the GBS 52 gene. Yet another example of a hybrid GBS AI is a GBS AI-1 with a substitution of either GBS 52 or GBS 104 with a fusion protein comprising GBS 322 and one of GBS 59, GBS 67, or GBS 150. Some of these hybrid GBS AIs may be prepared as briefly outlined in FIG. 234 A-F.

Applicants have prepared a hybrid GBS AI having a GBS AI-sequence with a substitution of a GBS 67 coding sequence for the GBS 104 gene as depicted in FIG. 231 A. Transformation of *L. lactis* with the hybrid GBS AI-1 resulted in *L. lactis* expression of high molecular weight polymers containing the GBS 80 and GBS 67 proteins. See FIG. 233 A, which provides Western blot analysis of *L. lactis* transformed with the hybrid GBS AI depicted in FIG. 231 A. When *L. lactis* transformed with the hybrid GBS AI were probed with antibodies to GBS 80 or GBS 67, high molecular weight structures were detected. See lanes labelled LL+a) in both the α-80 and α-67 immunoblots. The GBS 80 and GBS 67 proteins were confirmed to be present on the surface of *L. lactis* by FACS analysis. See FIG. 233 B, which shows a shift in fluorescence when GBS 80 and GBS 67 antibodies are used to detect GBS 80 and GBS 67 surface expression. The same shifts in fluorescence were not observed in *L. lactis* control cells, cells not transformed with the hybrid GBS AI.

Alternatively, the oligomeric, pilus-like structures may be produced recombinantly. If produced in a recombinant host cell system, the AI surface protein will preferably be expressed in coordination with the expression of one or more of the AI sortases of the invention. Such AI sortases will facilitate oligomeric or hyperoligomeric formation of the AI surface protein subunits.

AI Sortases of the invention will typically have a signal peptide sequence within the first 70 amino acid residues. They may also include a transmembrane sequence within 50 amino acid residues of the C terminus. The sortases may also include at least one basic amino acid residue within the last 8 amino acids. Preferably, the sortases have one or more active site residues, such as a catalytic cysteine and histidine.

As shown in FIG. 1, AI-1 includes the surface exposed proteins of GBS 80, GBS 52 and GBS 104 and the sortases SAG0647 and SAG0648. AI-1 typically appears as an insertion into the 3' end of the trmA gene.

In addition to the open reading frames encoding the AI-1 proteins, AI-1 may also include a divergently transcribed transcriptional regulator such as araC (i.e., the transcriptional regulator is located near or adjacent to the AI protein open reading frames, but it transcribed in the opposite direction). It is believed that araC may regulate the expression of the AI operon. (See Korbel et al., Nature Biotechnology (2004) 22 (7): 911-917 for a discussion of divergently transcribed regulators in *E. coli*).

AI-1 may also include a sequence encoding a rho independent transcriptional terminator (see hairpin structure in FIG. 1). The presence of this structure within the adhesin island is thought to interrupt transcription after the GBS 80 open reading frame, leading to increased expression of this surface protein.

Figure 2:
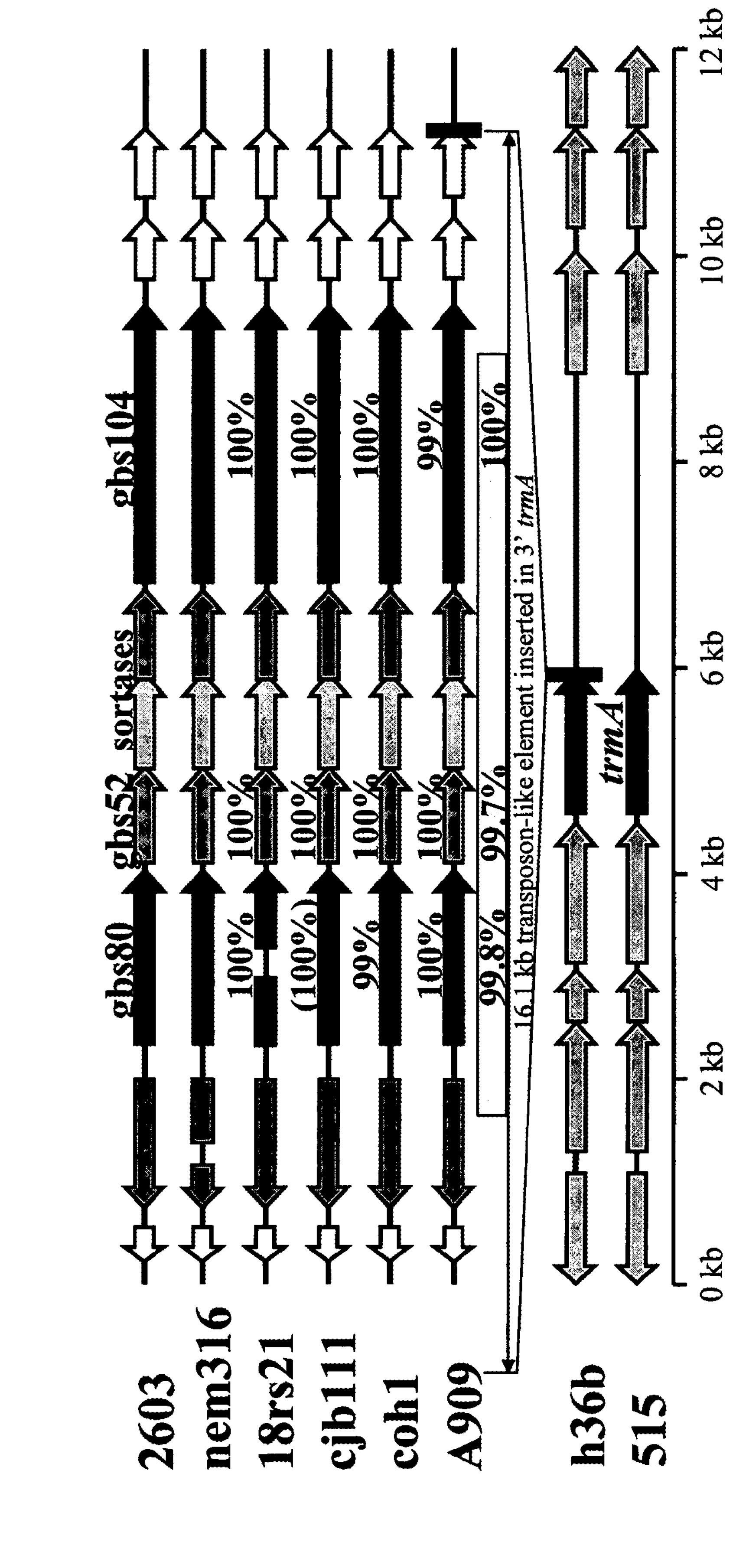
FIG. 2 illustrates the identification of AI-sequences in several GBS serotypes and strain isolates (GBS serotype V, strain isolate 2603; GBS serotype III, strain isolate nem316; GBS serotype II, strain isolate 18RS21; GBS serotype V, strain isolate CJB111; GBS serotype III, strain isolate COH1 and GBS serotype 1a, strain isolate A909). (An AI-1 was not identified in GBS serotype 1b, strain isolate H36B or GBS serotype 1a, strain isolate 515).

A schematic identifying AI-1 within several GBS serotypes is depicted in FIG. 2. AI-sequences were identified in GBS serotype V, strain isolate 2603; GBS serotype III, strain isolate NEM316; GBS serotype II, strain isolate 18RS21; GBS serotype V, strain isolate CJB111; GBS serotype III, strain isolate COH1 and GBS serotype 1a, strain isolate A909. (Percentages shown are amino acid identity to the 26 sequence). (An AI-1 was not identified in GBS serotype 1b, strain isolate H36B or GBS serotype 1a, strain isolate 515).

An alignment of AI-1 polynucleotide sequences from serotype V, strain isolates 2603 and CJB111; serotype II, strain isolate 18RS21; serotype III, strain isolates COH1 and NEM316; and serotype 1a, strain isolate A909 is presented in FIG. 18. An alignment of amino acid sequences of AI-1 surface protein GBS 80 from serotype V, strain isolates 2603 and CJB111; serotype 1a, strain isolate A909; serotype III, strain isolates COH1 and NEM316 is presented in FIG. 22. An alignment of amino acid sequences of AI-1 surface protein GBS 104 from serotype V, strain isolates 2603 and CJB111; serotype III, strain isolates COH1 and NEM316; and serotype II, strain isolate 18RS21 is presented in FIG. 23. Preferred AI-1 polynucleotide and amino acid sequences are conserved among two or more GBS serotypes or strain isolates.

As shown in this FIG., the full length of surface protein GBS 80 is particularly conserved among GBS serotypes V (strain isolates 2603 and CJBIII), III (strain isolates NEM316 and COH1), and Ia (strain isolate A909). The GBS 80 surface protein is missing or fragmented in serotypes II (strain isolate 18RS21), Ib (strain isolate H36B) and Ia (strain isolate 515).

Figure 30:
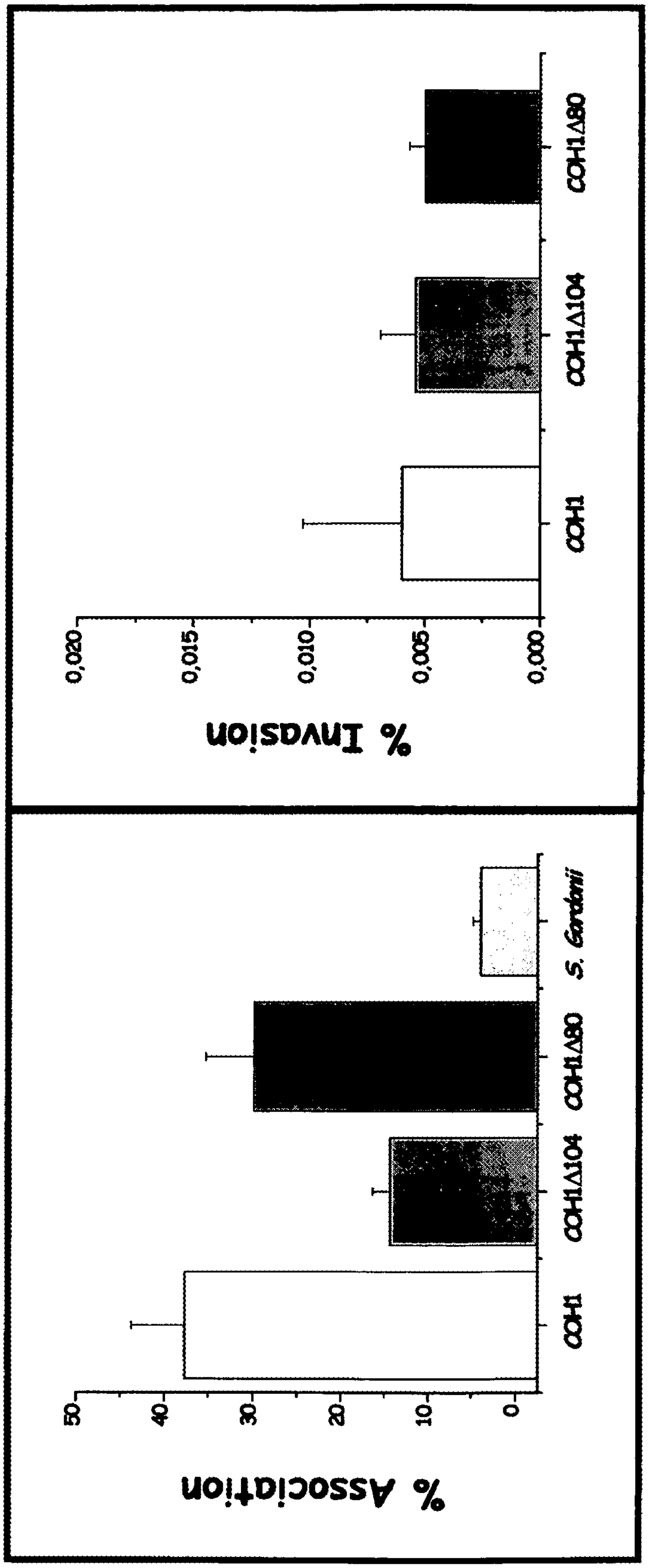
FIG. 30: Illustrates that deletion of GBS 104 in the GBS strain COH1, reduces the capacity of GBS to adhere to ME180 cervical epithelial cells.

Polynucleotide and amino acid sequences for AraC are set forth in FIG. 30.

GBS Adhesin Island 2

Figure 3:
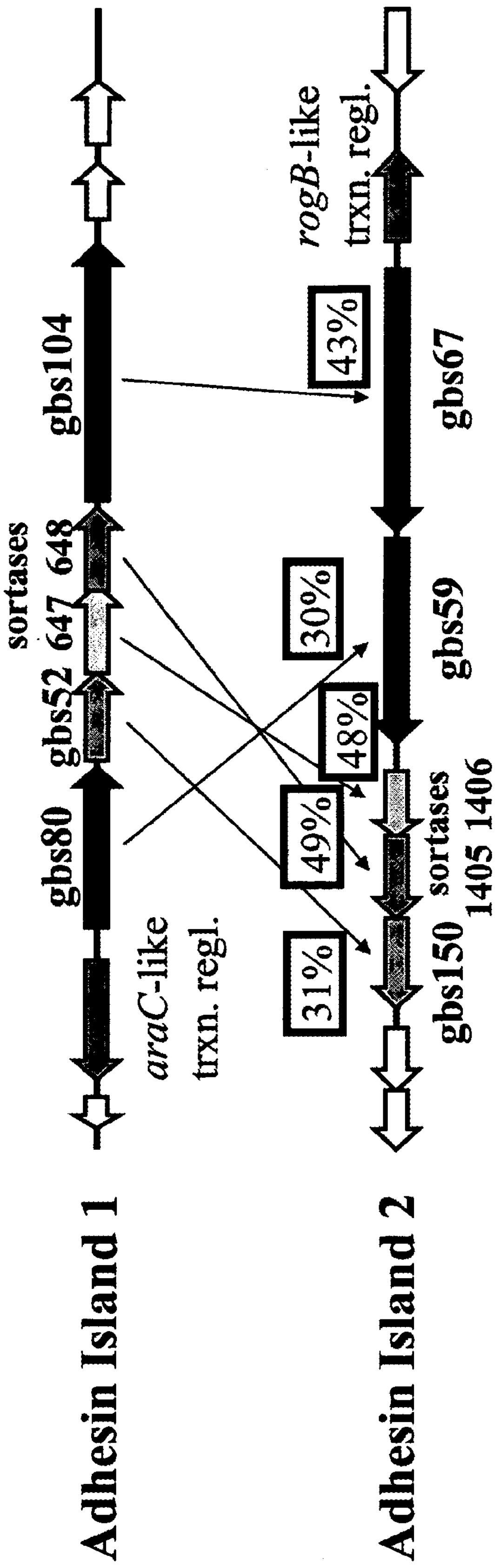
FIG. 3 presents a schematic depiction of the correlation between AI-1 and the Adhesin Island 2 ("AI-2") within the GBS serotype V, strain isolate 2603 genome. (This AI-2 comprises open reading frames for GBS 67, GBS 59, SAG1406, SAG1405 and GBS 150).

A second adhesin island, "Adhesin Island 2" or "AI-2" or GBS AI-2" has also been identified in numerous GBS serotypes. A schematic depicting the correlation between AI-1 and AI-2 within the GBS serotype V, strain isolate 2603 is shown in FIG. 3. (Homology percentages in FIG. 3 represent amino acid identity of the AI-2 proteins to the AI-1 proteins). Alignments of AI-2 polynucleotide sequences are presented in FIGS. 20 and 21 (FIG. 20 includes sequences from serotype V, strain isolate 2603 and serotype III, strain isolate NEM316. FIG. 21 includes sequences from serotype III, strain isolate COH1 and serotype Ia, strain isolate A909). An alignment of amino acid sequences of AI-2 surface protein GBS 067 from serotype V, strain isolates 2603 and CJB111; serotype 1a, strain isolate 515; serotype II, strain isolate 18RS21; serotype Ib, strain isolate H36B; and serotype III, strain isolate NEM316 is presented in FIG. 24. Preferred AI-2 polynucleotide and amino acid sequences are conserved among two or more GBS serotypes or strain isolates.

AI-2 comprises a series of approximately five open reading frames encoding for a collection of amino acid sequences comprising surface proteins and sortases. Specifically, AI-2 includes open reading frames encoding for two or more (i.e., 2, 3, 4, 5 or more) of GBS 67, GBS 59, GBS 150, SAG1405, SAG1406, 01520, 01521, 01522, 01523, 01523, 01524 and 01525. In one embodiment, AI-2 includes open reading frames encoding for two or more of GBS 67, GBS 59, GBS 150, SAG1405, and SAG1406. Alternatively, AI-2 may include open reading frames encoding for two or more of 01520, 01521, 01522, 01523, 01523, 01524 and 01525.

One or more of the surface proteins typically include an LPXTG motif (such as LPXTG (SEQ ID NO:122)) or other sortase substrate motif. The GBS AI-2 sortase proteins are thought to be involved in the secretion and anchoring of the LPXTG containing surface proteins. GBS AI-2 may encode for at least one surface protein. Alternatively, AI-2 may encode for at least two surface proteins and at least one sortase. Preferably, GBS AI-2 encodes for at least three surface proteins and at least two sortases. One or more of the AI-2 surface proteins may include an LPXTG or other sortase substrate motif.

One or more of the surface proteins may also typically include pilin motif. The pilin motif may be involved in pili formation. Cleavage of AI surface proteins by sortase between the threonine and glycine residue of an LPXTG motif yields a thioester-linked acyl intermediate of sortase. The first lysine residue in a pilin motif can serve as an amino group acceptor of the cleaved LPXTG motif and thereby provide a covalent linkage between AI subunits to form pili. For example, the pilin motif can make a nucleophilic attack on the acyl enzyme providing a covalent linkage between AI subunits to form pili and regenerate the sortase enzyme. Some examples of pilin motifs that may be present in the GBS AI-2 proteins include ((YPKN($X_8$)K; SEQ ID NO:158), (PK($X_8$)K; SEQ ID NO:159), (YPK($X_9$)K; SEQ ID NO:160), (PKN($X_8$)K; SEQ ID NO:161), or (PK($X_{10}$)K; SEQ ID NO:162)).

One or more of the surface protein may also include an E box motif. The E box motif contains a conserved glutamic acid residue that is believed to be necessary for pilus formation. Some examples of E box motifs may include the amino acid sequences YxLxETxAPxG (SEQ ID NO:163), YxxxExxAxxGY (SEQ ID NO:164), YxLxExxxPxDY (SEQ ID NO:165), or YxLxETxAPxGY (SEQ ID NO:152).

As shown in FIG. 3, GBS AI-2 may include the surface exposed proteins of GBS 67, GBS 59 and GBS 150 and the sortases of SAG1406 and SAG1405. Alternatively, GBS AI-2 may include the proteins 01521, 01524 and 01525 and sortases 01520 and 01522. GBS 067 and 01524 are preferred AI-2 surface proteins.

AI-2 may also include a divergently transcribed transcriptional regulator such as a RofA like protein (for example rogB). As in AI-1, rogB is thought to regulate the expression of the AI-2 operon.

Figure 4:
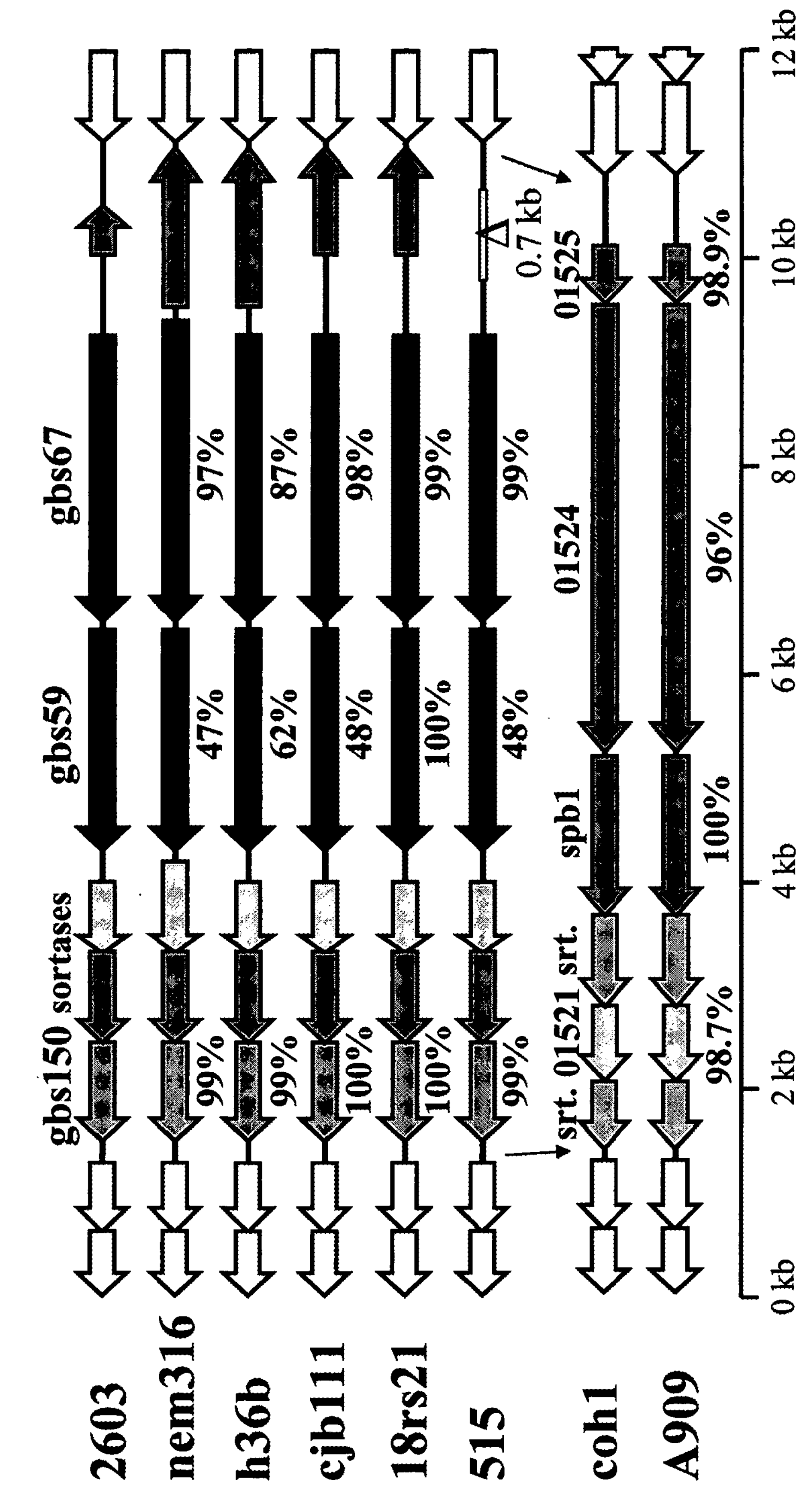
FIG. 4 illustrates the identification of AI-2 comprising open reading frames encoding for GBS 67, GBS 59, SAG1406, SAG1404 and GBS 150 (or sequences having sequence homology thereto) in several GBS serotypes and strain isolates (GBS serotype V, strain isolate 2603; GBS serotype III, strain isolate NEM316; GBS serotype 1b, strain isolate H36B; GBS serotype V, strain isolate CJB111; GBS serotype II, strain isolate 18RS21; and GBS serotype 1a, strain isolate 515).

A schematic depiction of AI-2 within several GBS serotypes is depicted in FIG. 4. (Percentages shown are amino acid identity to the 26 sequence). While the AI-2 surface proteins GBS 59 and GBS 67 are more variable across GBS serotypes than the corresponding AI-1 surface proteins, AI-2 surface protein GBS 67 appears to be conserved in GBS serotypes where the AI-1 surface proteins are disrupted or missing.

For example, as discussed above and in FIG. 2, the AI-1 GBS 80 surface protein is fragmented in GBS serotype II, strain isolate 18RS21. Within AI-2 for this same sequence, as shown in FIG. 4, the GBS 67 surface protein has 99% amino acid sequence homology with the corresponding sequence in strain isolate 2603. Similarly, the AI-1 GBS 80 surface protein appears to be missing in GBS serotype Ib, strain isolate H36B and GBS serotype Ia, strain isolate 515. Within AI-2 for these sequences, however, the GBS 67 surface protein has 97-99% amino acid sequence homology with the corresponding sequence in strain isolate 2603. GBS 67 appears to have two allelic variants, which can be divided according to percent homology with strains 2603 and H36B. See FIGS. 237-239.

Unlike for GBS 67, amino acid sequence identity of GBS 59 is variable across different GBS strains. As shown in FIGS. 63 and 224, GBS 59 of GBS strain isolate 2603 shares 100% amino acid residue homology with GBS strain 18RS21, 62% amino acid sequence homology with GBS strain H36B, 48% amino acid residue homology with GBS strain 515 and GBS strain CJB111, and 47% amino acid residue homology with GBS strain NEM316. The amino acid sequence homologies of the different GBS strains suggest that there are two isoforms of GBS 59. The first isoform appears to include the GBS 59 protein of GBS strains CJB111, NEM316, and 515. The second isoform appears to include the GBS 59 protein of GBS strains 18RS21, 2603, and H36B. (See FIGS. 63 and 224.) As expected from the variability in GBS 59 isoforms, antibodies specific for the first GBS 59 isoform detect the first but not the second GBS 59 isoform and antibodies specific for the second GBS 59 isoform detect the second but not the first GBS 59 isoform. See FIG. 226A, which shows FACS analysis of 28 GBS strains having a GBS 59 gene detected using PCR for GBS 59 surface expression. For each of the 28 GBS strains, FACS analysis was performed using either an antibody for GBS 59 isoform 1 (α-Cjb111) or GBS 59 isoform 2 (α-2603). Only one of the two antibodies detected GBS 59 surface expression on each GBS strain. As a negative control, GBS strains in which a GBS 59 gene was not detectable by PCR did not have significant GBS 59 surface expression levels. FIG. 226B.

Also, GBS 59 is opsonic only against GBS strains expressing a homologous GBS 59 protein. See FIG. 225.

In one embodiment, the immunogenic composition of the invention comprises a first and a second isoform of the GBS 59 protein to provide protection across a wide range of GBS serotypes that express polypeptides from a GBS AI-2. The first isoform may be the GBS 59 protein of GBS strain CJB111, NEM316, or 515. The second isoform may be the GBS 59 protein of GBS strain 18RS21, 2603, or H36B.

Figure 64:
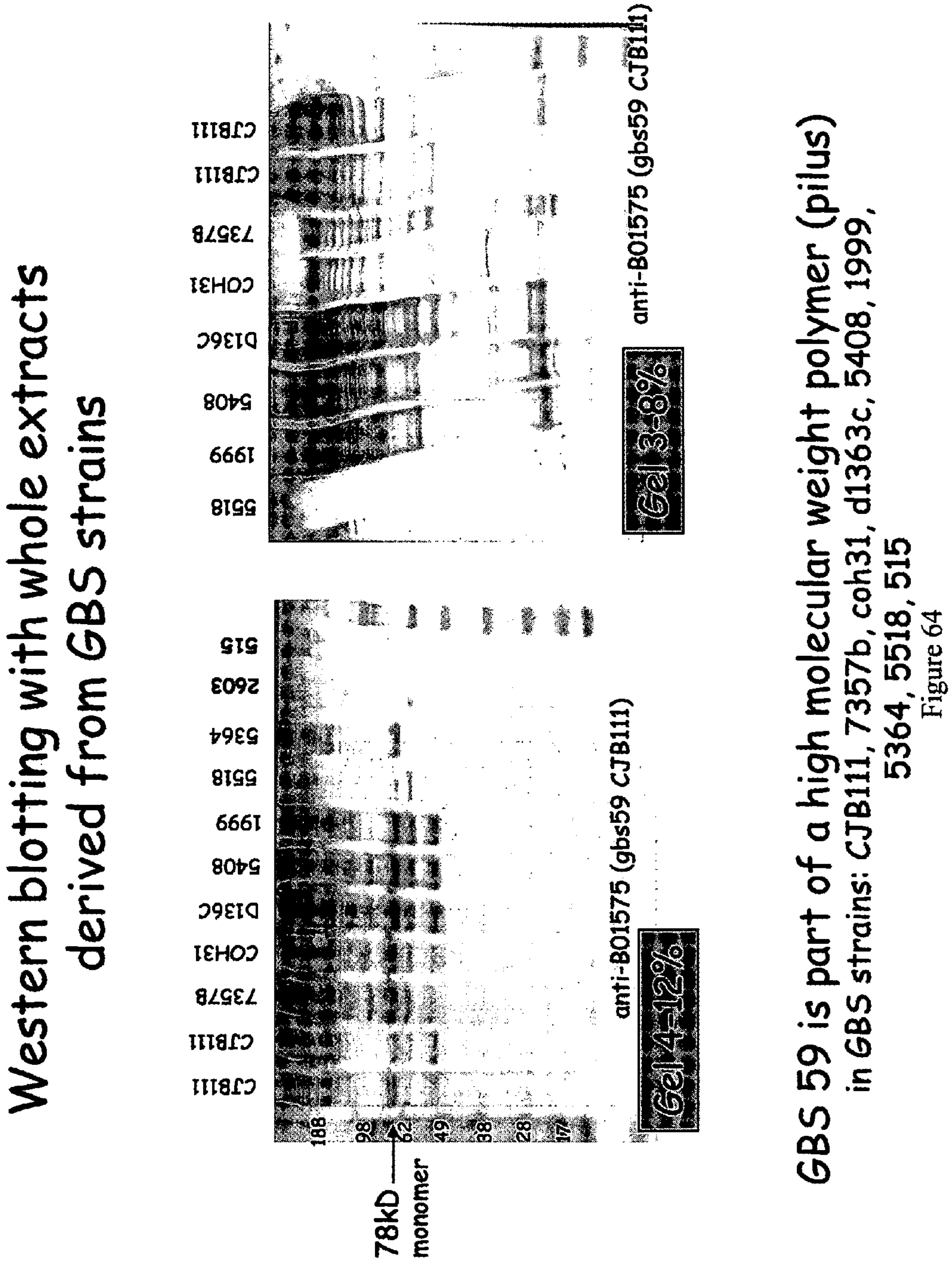
FIG. 64: Western blotting of whole GBS cell extracts with anti-GBS 59 antibodies.
Figure 65:
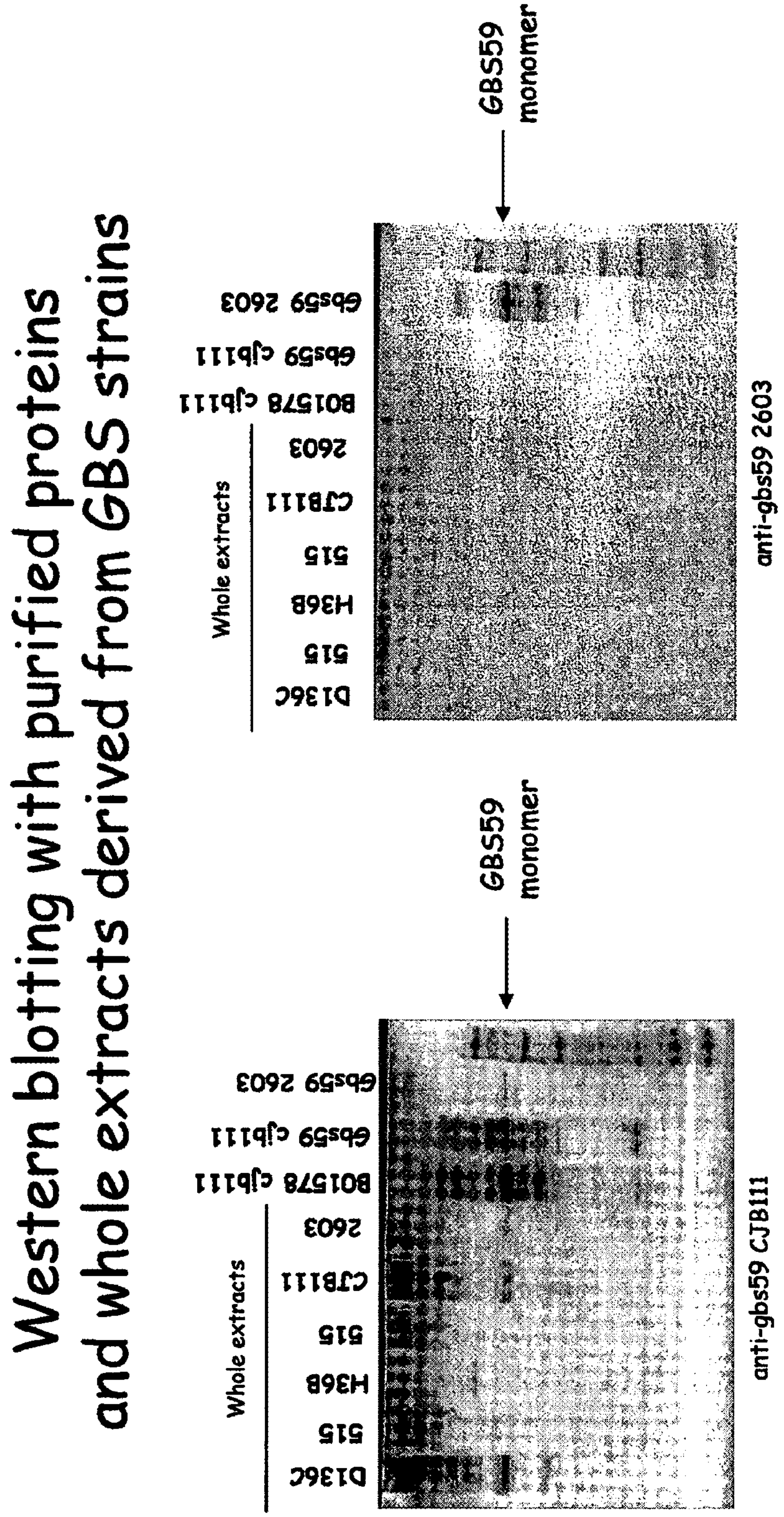
FIG. 65: Western blotting of purified GBS 59 and whole GBS cell extracts with anti-GBS 59 antibodies.

The gene encoding GBS 59 has been identified in a high number of GBS isolates; the GBS 59 gene was detected in 31 of 40 GBS isolates tested (77.5%). The GBS 59 protein also appears to be present as part of a pilus in whole extracts derived from GBS strains. FIG. 64 shows detection of high molecular weight GBS 59 polymers in whole extracts of GBS strains CJB111, 7357B, COH31, D1363C, 5408, 1999, 5364, 5518, and 515 using antiserum raised against GBS 59 of GBS strain CJB111. FIG. 65 also shows detection of these high molecular weight GBS 59 polymers in whole extracts of GBS strains D136C, 515, and CJB111 with anti-GBS 59 antiserum. (See also FIG. 220 A for detection of GBS 59 high molecular weight polymers in strain 515.) FIG. 65 confirms the presence of different isoforms of GBS 59. Antisera raised against two different GBS 59 isoforms results in different patterns of immunoreactivity depending on the GBS strain origin of the whole extract. FIG. 65 further shows detection of GBS 59 monomers in purified GBS 59 preparations.

GBS 59 is also highly expressed on the surface of GBS strains. GBS 59 was detected on the surface of GBS strains CJB111, DK1, DK8, Davis, 515, 2986, 5551, 1169, and 7357B by FACS analysis using mouse antiserum raised against GBS 59 of GBS CJB111. FACS analysis did not detect surface expression of GBS 59 in GBS strains SMU071, JM9130013, and COH1, which do not contain a GBS 59 gene. (See FIG. 66.) Further confirmation that GBS 59 is expressed on the surface of GBS is detection of GBS 59 by immuno-electron microscopy on the surface of GBS strain 515 bacteria. See FIG. 215.

Figure 69:
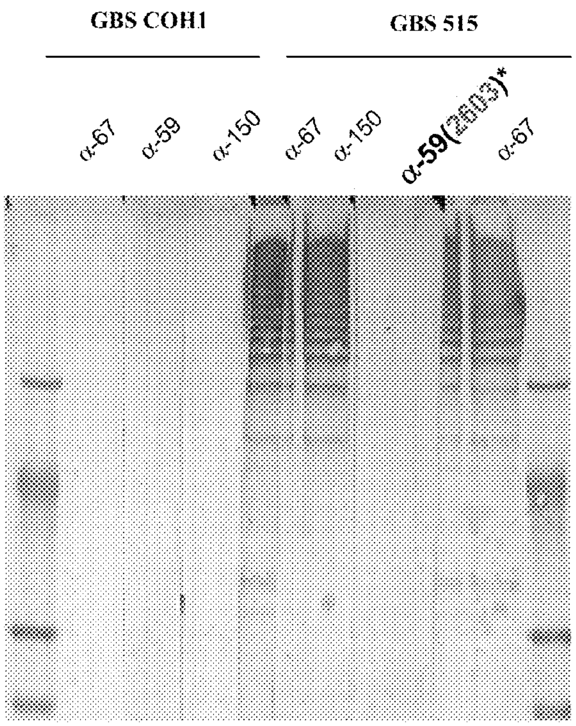
FIG. 69: Western blotting of GBS stain 515 total extracts shows that GBS 67 and GBS 150 are parts of a pilus.

GBS 67 and GBS 150 also appear to be included in high molecular weight structures, or pili. FIG. 69 shows that anti-GBS 67 and anti-GBS 150 immunoreact with high molecular weight structures in whole GBS strain 515 extracts. (See also FIGS. 220 B and C.) It is also notable in FIG. 69 that the anti-GBS 59 antisera, raised in a mouse following immunization with GBS 59 of GBS strain 2603, does not cross-hybridize with GBS 59 in GBS strain 515. GBS 59 of GBS stain 515 is of a different isotype than GBS 59 of GBS stain 2603. See FIG. 63, which illustrates that the homology of these two GBS 59 polypeptides is 48%, and FIG. 65, which confirms that GBS 59 antisera raised against GBS strain 2603 does not cross-hybridize with GBS 59 of GBS strain 515.

Figure 70:
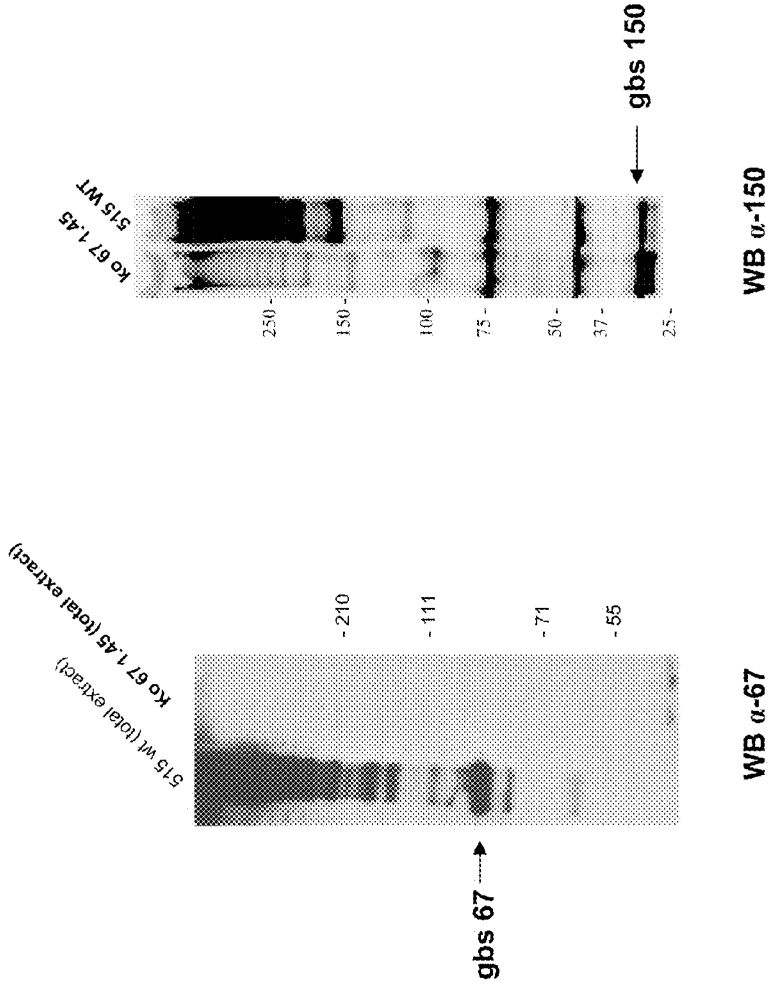
FIG. 70: Western blotting of GBS strain 515 knocked out for GBS 67 expression
Figure 71:
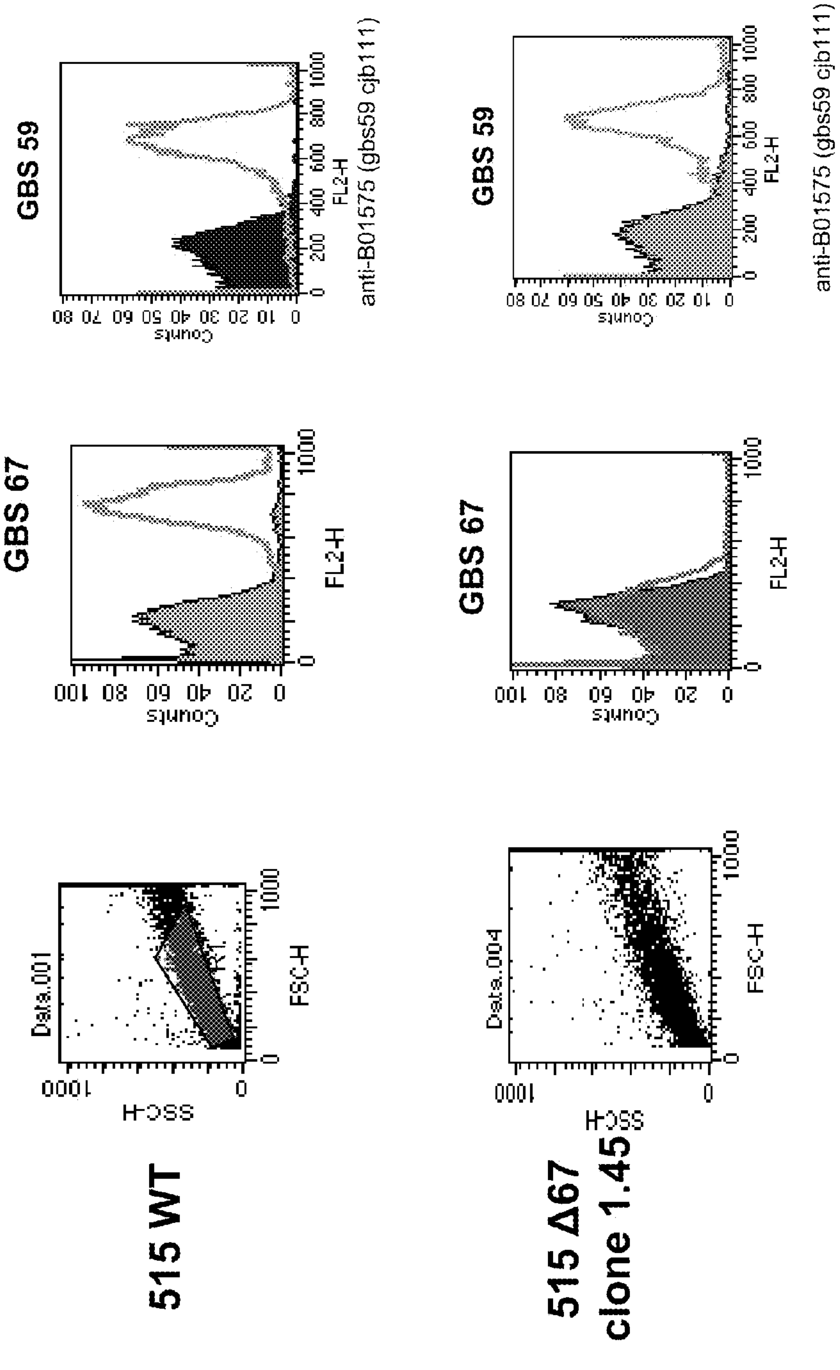
FIG. 71: FACS analysis of GBS strain 515 and GBS strain 515 knocked out for GBS 67 expression using GBS 67 and GBS 59 antiserum.

Formation of pili containing GBS 150 does not appear to require GBS 67 expression. FIG. 70 provides Western blots showing that higher molecular weight structures in GBS strain 515 total extracts immunoreact with anti-GBS 67 and anti-GBS 150 antiserum. In a GBS strain 515 lacking GBS 67 expression, anti-GBS 67 antiserum no longer immunoreacts with polypeptides in total extracts, while anti-GBS 150 antiserum is still able to cross-hybridize with high molecular weight structures.

Likewise, formation of pili containing GBS 59 does not appear to require GBS 67 expression. As expected, FACS detects GBS 67 cell surface expression on wildtype GBS strain 515, but not GBS strain 515 cells knocked out for GBS 67. FACS analysis using anti-GBS 59 antisera, however, detects GBS 59 expression on both the wildtype GBS strain 515 cells and the GBS strain 515 cells knocked out for GBS 67. Thus, GBS 59 cell surface expression is detected on GBS stain 515 cells regardless of GBS 67 expression.

GBS 67, while present in pili, appears to be localized around the surface of GBS strain 515 cells. See the immuno-electron micrographs presented in FIG. 216. GBS 67 binds to fibronectin. See FIG. 217.

Formation of pili encoded by GBS AI-2 does require expression of GBS 59. Deletion of GBS 59 from strain 515 bacteria eliminates detection of high molecular weight structures by antibodies that bind to GBS 59 (FIG. 221 A, lane 3), GBS 67 (FIG. 221 B, lane 3), and GBS 150 (FIG. 221 C, lane 3). By contrast, Western blot analysis of 515 bacteria with a deletion of the GBS 67 gene detects high molecular weight structures using GBS 59 (FIG. 221 A, lane 2) and GBS 150 (FIG. 221 C, lane 2) antisera. Similarly, Western blot analysis of 515 bacteria with a deletion of the GBS 150 gene detects high molecular weight structures using GBS 59 (FIG. 221 A, lane 4) and GBS 67 (FIG. 221 B, lane 4). See also FIG. 223, which provides Western blots of each of the 515 strains interrogated with antibodies for GBS 59, GBS 67, and GBS 150. FACS analysis of strain 515 bacteria deleted for either GBS 59 or GBS 67 confirms these results. See FIG. 222, which shows that only deletion of GBS 59 abolishes surface expression of both GBS 59 and GBS 67.

Formation of pili encoded by GBS AI-2 also requires expression of both GBS adhesin island-2 encoded sortases. See FIG. 218, which provides Western blot analysis of strain 515 bacteria lacking Srt1, Srt2, or both Srt1 and Srt2. Only deletion of both Srt1 and Srt2 abolishes pilus assembly as detected by antibodies that cross-hybridize with each of GBS 59, GBS 67 and GBS 150. The results of the Western blot analysis were verified by FACS, which provided similar results. See FIG. 219.

As shown in FIG. 4, two of the GBS strain isolates (COH1 and A909) do not appear to contain homologues to the surface proteins GBS 59 and GBS 67. For these two strains, the percentages shown in FIG. 4 are amino acid identity to the COH1 protein). Notwithstanding the difference in the surface protein lengths for these two strains, AI-2 within these sequences still contains two sortase proteins and three LPXTG containing surface proteins, as well as a signal peptidase sequence leading into the first surface protein. One of the surface proteins in this variant of AI-2, spb1, has previously been identified as a potential adhesion protein. (See Adderson et al., Infection and Immunity (2003) 71 (12):6857-6863). Alternatively, because of the lack of GBS 59 and GBS sequences, this variant of AI-2 may be a third type of AI (Adhesin Island-3, AI-3, or GBS AI-3).

More than one AI surface protein may be present in the oligomeric, pilus-like structures of the invention. For example, GBS 59 and GBS 67 may be incorporated into an oligomeric structure. Alternatively, GBS 59 and GBS 150 may be incorporated into an oligomeric structure, or GBS 59, GBS 150 and GBS 67 may be incorporated into an oligomeric structure.

In another embodiment, the invention includes compositions comprising two or more AI surface proteins. The composition may include surface proteins from the same adhesin island. For example, the composition may include two or more GBS AI-2 surface proteins, such as GBS 59, GBS 67 and GBS 150. The surface proteins may be isolated from Gram positive bacteria or they may be produced recombinantly.

GAS Adhesin Islands

As discussed above, Applicants have identified at least four different GAS Adhesin Islands. These adhesion islands are thought to encode surface proteins which are important in the bacteria's virulence, and Applicants have obtained the first electron micrographs revealing the presence of these adhesin island proteins in hyperoligomeric pilus structures on the surface of Group A *Streptococcus*.

Group A *Streptococcus* is a human specific pathogen which causes a wide variety of diseases ranging from pharyngitis and impetigo through life threatening invasive disease and necrotizing fascilitis. In addition, post-streptococcal autoimmune responses are still a major cause of cardiac pathology in children.

Group A Streptococcal infection of its human host can generally occur in three phases. The first phase involves attachment and/or invasion of the bacteria into host tissue and multiplication of the bacteria within the extracellular spaces. Generally this attachment phase begins in the throat or the skin. The deeper the tissue level infected, the more severe the damage that can be caused. In the second stage of infection, the bacteria secretes a soluble toxin that diffuses into the surrounding tissue or even systemically through the vasculature. This toxin binds to susceptible host cell receptors and triggers inappropriate immune responses by these host cells, resulting in pathology. Because the toxin can diffuse throughout the host, the necrosis directly caused by the GAS toxins may be physically located in sites distant from the bacterial infection. The final phase of GAS infection can occur long after the original bacteria have been cleared from the host system. At this stage, the host's previous immune response to the GAS bacteria due to cross reactivity between epitopes of a GAS surface protein, M, and host tissues, such as the heart. A general review of GAS infection can be found in Principles of Bacterial Pathogeneis, Groisman ed., Chapter 15 (2001).

In order to prevent the pathogenic effects associated with the later stages of GAS infection, an effective vaccine against GAS will preferably facilitate host elimination of the bacteria during the initial attachment and invasion stage.

Isolates of Group A *Streptococcus* are historically classified according to the M surface protein described above. The M protein is surface exposed trypsin-sensitive protein generally comprising two polypeptide chains complexed in an alpha helical formation. The carboxyl terminus is anchored in the cytoplasmic membrane and is highly conserved among all group A streptococci. The amino terminus, which extend through the cell wall to the cell surface, is responsible for the antigenic variability observed among the 80 or more serotypes of M proteins.

A second layer of classification is based on a variable, trypsin-resistant surface antigen, commonly referred to as the T-antigen. Decades of epidemiology based on M and T serological typing have been central to studies on the biological diversity and disease causing potential of Group A Streptococci. While the M-protein component and its inherent variability have been extensively characterized, even after five decades of study, there is still very little known about the structure and variability of T-antigens. Antisera to define T types is commercially available from several sources, including Sevapharma (http://www.sevapharma.cz/en).

The gene coding for one form of T-antigen, T-type 6, from an M6 strain of GAS (D741) has been cloned and characterized and maps to an approximately 11 kb highly variable pathogenicity island. Schneewind et al., J. Bacteriol. (1990) 172 (6):3310-3317. This island is known as the Fibronectin-binding, Collagen-binding T-antigen (FCT) region because it contains, in addition to the T6 coding gene (tee6), members of a family of genes coding for Extra Cellular Matrix (ECM) binding proteins. Bessen et al., Infection & Immunity (2002) 70 (3):1159-1167. Several of the protein products of this gene family have been shown to directly bind either fibronectin and/or collagen. See Hanski et al., Infection & Immunity (1992) 60 (12):5119-5125; Talay et al., Infection & Immunity (1992 (60 (9):3837-3844; Jaffe et al. (1996) 21 (2):373-384; Rocha et al., Adv Exp Med. Biol. (1997) 418:737-739; Kreikemeyer et al., J Biol Chem (2004) 279 (16):15850-15859; Podbielski et al., Mol. Microbiol. (1999) 31 (4):1051-64; and Kreikemeyer et al., Int. J. Med Microbiol (2004) 294 (2-3):177-88. In some cases direct evidence for a role of these proteins in adhesion and invasion has been obtained.

Applicants raised antiserum against a recombinant product of the tee6 gene and used it to explore the expression of T6 in M6 strain 2724. In immunoblot of mutanolysin extracts of this strain, the antiserum recognized, in addition to a band corresponding to the predicted molecular mass of the product, very high molecular weight ladders ranging in mobility from about 100 kDa to beyond the resolution of the 3-8% gradient gels used.

This pattern of high molecular weight products is similar to that observed in immunoblots of the protein components of the pili identified in *Streptococcus agalactiae* (described above) and previously in *Corynebacterium diphtheriae*. Electron microscopy of strain M6__2724 with antisera specific for the product of tee6 revealed abundant surface staining and long pilus like structures extending up to 700 nanometers from the bacterial surface, revealing that the T6 protein, one of the antigens recognized in the original Lancefiled serotyping system, is located within a GAS Adhesin Island (GAS AI-1) and forms long covalently linked pilus structures.

Applicants have identified at least four different Group A *Streptococcus* Adhesin Islands. While these GAS AI sequences can be identified in numerous M types, Applicants have surprisingly discovered a correlation between the four main pilus subunits from the four different GAS AI types and specific T classifications. While other trypsin-resistant surface exposed proteins are likely also implicated in the T classification designations, the discovery of the role of the GAS adhesin islands (and the associated hyper-oligomeric pilus like structures) in T classification and GAS serotype variance has important implications for prevention and treatment of GAS infections. Applicants have identified protein components within each of the GAS adhesin islands which are associated with the pilus formation. These proteins are believed to be involved in the bacteria's initial adherence mechanisms. Immunological recognition of these proteins may allow the host immune response to slow or prevent the bacteria's transition into the more pathogenic later stages of infection.

In addition, Applicants have discovered that the GBS pili structures appear to be implicated in the formation of biofilms (populations of bacteria growing on a surface, often enclosed in an exopolysaccharide matrix). Biofilms are generally associated with bacterial resistance, as antibiotic treatments and host immune response are frequently unable to eradicate all of the bacteria components of the biofilm. Direction of a host immune response against surface proteins exposed during the first steps of bacterial attachment (i.e., before complete biofilm formation) is preferable.

The invention therefore provides for improved immunogenic compositions against GAS infection which may target GAS bacteria during their initial attachment efforts to the host epithelial cells and may provide protection against a wide range of GAS serotypes. The immunogenic compositions of the invention include GAS AI surface proteins which may be formulated in an oligomeric, or hyperoligomeric (pilus) form. The invention also includes combinations of GAS AI surface proteins. Combinations of GAS AI surface proteins may be selected from the same adhesin island or they may be selected from different GAS adhesin islands.

While there is surprising variability in the number and sequence of the GAS AI components across isolates, GAS AI sequences may be generally characterized as Type 1, Type 2, Type 3, and Type 4, depending on the number and type of sortase sequence within the island and the percentage identity of other proteins within the island. Schematics of the GAS adhesin islands are set forth in FIG. 51A and FIG. 162. In all strains identified so far, the adhesin island region is flanked by highly conserved open reading frames M1__123 and M1__136. Between three and five genes in each GAS adhesin island code for ECM binding adhesin proteins containing LPXTG motifs.

GAS Adhesin Island 1

As discussed above, Applicants have identified adhesin islands, "GAS Adhesin Island 1" or "GAS AI-1", within the genome Group A *Streptococcus* serotypes and isolates. GAS AI-1 comprises a series of approximately five open reading frames encoding for a collection of amino acid sequences comprising surface proteins and sortases ("GAS AI-1 proteins"). GAS AI-1 preferably comprises surface proteins, a srtB sortase, and a rofA divergently transcribed transcriptional regulator. GAS AI-1 surface proteins may include a fibronectin binding protein, a collagen adhesion protein and a fimbrial structural subunit. Preferably, each of these GAS AI-1 surface proteins includes an LPXTG sortase substrate motif, such as LPXTG (SEQ ID NO:122) or LPXSG (SEQ ID NO:134) (conservative replacement of threonine with serine). Specifically, GAS AI-1 includes open reading frames encoding for two or more (i.e., 2, 3, 4 or 5) of M6_Spy0157, M6_Spy0158, M6_Spy0159, M6_Spy0160, M6_Spy0161.

Applicants have also identified open reading frames encoding fimbrial structural subunits in other GAS bacteria harbouring an AI-1. These open reading frames encode fimbrial structural subunits CDC SS 410_fimbrial, ISS3650_fimbrial, and DSM2071_fimbrial. A GAS AI-1 may comprise a polynucleotide encoding any one of CDC SS 410_fimbrial, ISS3650_fimbrial, and DSM2071_fimbrial.

As discussed above, the hyper-oligomeric pilus structure of GAS AI-1 appears to be responsible for the T-antigen type 6 classification, and GAS AI-1 corresponds to the FCT region previously identified for tee6. As in GAS AI-1, the tee6 FCT region includes open reading frames encoding for a collagen adhesion protein (cpa, capsular polysaccharide adhesion) and a fibronectin binding protein (prtF1) Immunoblots of tee6, a GAS AI-1 fimbrial structural subunit corresponding to M6_Spy160, reveal high molecular weight structures indicative of the hyper-oligomeric pilus structures. Immunoblots with antiserum specific for Cpa also recognize a high molecular weight ladder structure, indicating Cpa involvement in the GAS AI-1 pilus structure or formation. In EM photos of GAS bacteria, Cpa antiserum reveals abundant staining on the surface of the bacteria and occasional gold particles extended from the surface of the bacteria. In contrast, immunoblots with antiserum specific for PrtF1 recognize only a single molecular species with electrophoretic mobility corresponding to its predicted molecular mass, indicating that PrtF1 may not be associated with the oligomeric pilus structure. A preferred immunogenic composition of the invention comprises a GAS AI-1 surface protein which may be formulated or purified in an oligomeric (pilis) form. In a preferred embodiment, the oligomeric form is a hyperoligomer. Another preferred immunogenic composition of the invention comprises a GAS AI-1 surface protein which has been isolated in an oligomeric (pilis) form. The oligomer or hyperoligomeric pilus structures comprising the GAS AI-1 surface proteins may be purified or otherwise formulate for use in immunogenic compositions.

One or more of the GAS AI-1 open reading frame polynucleotide sequences may be replaced by a polynucleotide sequence coding for a fragment of the replaced ORF. Alternatively, one or more of the GAS AI-1 open reading frames may be replaced by a sequence having sequence homology to the replaced ORF.

One or more of the GAS AI-1 surface protein sequences typically include an LPXTG motif (such as LPXTG (SEQ ID NO:122)) or other sortase substrate motif.

The LPXTG sortase substrate motif of a GAS AI surface protein may be generally represented by the formula XXXXG, wherein X at amino acid position 1 is an L, a V, an E, or a Q, wherein X at amino acid position 2 is a P if X at amino acid position 1 is an L, wherein X at amino acid position 2 is a V if X at amino acid position 1 is a E or a Q, wherein X at amino acid position 2 is a V or a P if X at amino acid position 1 is a V, wherein X at amino acid position 3 is any amino acid residue, wherein X at amino acid position 4 is a T if X at amino acid position 1 is a V, E, or Q, and wherein X at amino acid position 4 is a T, S, or A if X at amino acid position 1 is an L. Some examples of LPXTG motifs present in GAS AI surface proteins include LPSXG (SEQ ID NO:134), VVXTG (SEQ ID NO:135), EVXTG (SEQ ID NO:136), VPXTG (SEQ ID NO:137), QVXTG (SEQ ID NO:138), LPXAG (SEQ ID NO:139), QVPTG (SEQ ID NO:140), and FPXTG (SEQ ID NO:141).

The GAS AI surface proteins of the invention may affect the ability of the GAS bacteria to adhere to and invade epithelial cells. AI surface proteins may also affect the ability of GAS to translocate through an epithelial cell layer. Preferably, one or more GAS AI surface proteins are capable of binding to or otherwise associating with an epithelial cell surface. GAS AI surface proteins may also be able to bind to or associate with fibrinogen, fibronectin, or collagen.

The GAS AI-1 sortase proteins are predicted to be involved in the secretion and anchoring of the LPXTG containing surface proteins. GAS AI-1 may encode for at least one surface protein. Alternatively, GAS AI-1 may encode for at least two surface exposed proteins and at least one sortase. Preferably, GAS AI-1 encodes for at least three surface exposed proteins and at least two sortases.

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

GAS AI-1 preferably includes a srtB sortase. GAS srtB sortases may preferably anchor surface proteins with an LPSTG motif (SEQ ID NO:166), particularly where the motif is followed by a serine.

In one embodiment, the invention includes a composition comprising oligomeric, pilus-like structures comprising a GAS AI-1 surface protein such as M6_Spy0157, M6_Spy0159, M6_Spy0160, CDC SS 410_fimbrial, ISS3650_fimbrial, or DSM2071_fimbrial. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyperoligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine or serine amino acid residue, respectively:

AI surface proteins or fragments thereof to be incorporated into the oligomeric, pilus-like structures of the invention will preferably include a pilin motif.

The oligomeric, pilus like structures may be used alone or in the combinations of the invention. In one embodiment, the invention comprises a GAS Adhesin Island protein in oligomeric form, preferably in a hyperoligomeric form. In one embodiment, the invention comprises a composition comprising one or more GAS Adhesin Island 1 ("GAS AI-1") proteins and one or more GAS Adhesin Island 2 ("GAS AI-2"), GAS Adhesin Island 3 ("GAS AI-3"), or GAS Adhesin Island 4 ("GAS AI-4") proteins, wherein one or more of the GAS Adhesin Island proteins is in the form of an oligomer, preferably in a hyperoligomeric form.

In addition to the open reading frames encoding the GAS AI-1 proteins, GAS AI-1 may also include a divergently transcribed transcriptional regulator such as RofA (i.e., the transcriptional regulator is located near or adjacent to the AI protein open reading frames, but it transcribed in the opposite direction).

GAS Adhesin Island 2

A second adhesin island, "GAS Adhesin Island 2" or "GAS AI-2" has also been identified in Group A *Streptococcus* serotypes and isolates. GAS AI-2 comprises a series of approximately eight open reading frames encoding for a collection of amino acid sequences comprising surface proteins and sortases ("GAS AI-2 proteins"). Specifically, GAS AI-2 includes open reading frames encoding for two or more (i.e., 2, 3, 4, 5, 6, 7, or 8) of GAS15, Spy0127, GAS16, GAS17, GAS18, Spy0131, Spy0133, and GAS20.

A preferred immunogenic composition of the invention comprises a GAS AI-2 surface protein which may be formulated or purified in an oligomeric (pilis) form. In a preferred embodiment, the oligomeric form is a hyperoligomer. Another preferred immunogenic composition of the invention comprises a GAS AI-2 surface protein which has been isolated in an oligomeric (pilis) form. The oligomer or hyperoligomeric pilus structures comprising the GAS AI-2 surface proteins may be purified or otherwise formulate for use in immunogenic compositions.

One or more of the GAS AI-2 open reading frame polynucleotide sequences may be replaced by a polynucleotide sequence coding for a fragment of the replaced ORF. Alternatively, one or more of the GAS AI-2 open reading frames may be replaced by a sequence having sequence homology to the replaced ORF.

One or more of the GAS AI-2 surface protein sequences typically include an LPXTG motif (such as LPXTG (SEQ ID NO:122)) or other sortase substrate motif. The AI surface proteins of the invention may affect the ability of the GAS bacteria to adhere to and invade epithelial cells. AI surface proteins may also affect the ability of GAS to translocate through an epithelial cell layer. Preferably, one or more AI surface proteins are capable of binding to or otherwise associating with an epithelial cell surface. AI surface proteins may also be able to bind to or associate with fibrinogen, fibronectin, or collagen.

The GAS AI-2 sortase proteins are predicted to be involved in the secretion and anchoring of the LPXTG containing surface proteins. GAS AI-2 may encode for at least one surface protein. Alternatively, GAS AI-2 may encode for at least two surface exposed proteins and at least one sortase. Preferably, GAS AI-2 encodes for at least three surface exposed proteins and at least two sortases.

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

In one embodiment, the invention includes a composition comprising oligomeric, pilus-like structures comprising an AI surface protein such as GAS 15, GAS 16, or GAS 18. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyper-oligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine amino acid residue.

AI surface proteins or fragments thereof to be incorporated into the oligomeric, pilus-like structures of the invention will preferably include a pilin motif.

The oligomeric, pilus like structures may be used alone or in the combinations of the invention. In one embodiment, the invention comprises a GAS Adhesin Island protein in oligomeric form, preferably in a hyperoligomeric form. In one embodiment, the invention comprises a composition comprising one or more GAS Adhesin Island 2 ("GAS AI-2") proteins and one or more GAS Adhesin Island 1 ("GAS AI-1"), GAS Adhesin Island 3 ("GAS AI-3"), or GAS Adhesin Island 4 ("GAS AI-4") proteins, wherein one or more of the Adhesin Island proteins is in the form of an oligomer, preferably in a hyperoligomeric form.

In addition to the open reading frames encoding the GAS AI-2 proteins, GAS AI-2 may also include a divergently transcribed transcriptional regulator such as rofA (i.e., the transcriptional regulator is located near or adjacent to the AI protein open reading frames, but it transcribed in the opposite direction).

GAS Adhesin Island 3

A third adhesin island, "GAS Adhesin Island 3" or "GAS AI-3" has also been identified in several Group A *Streptococcus* serotypes and isolates. GAS AI-3 comprises a series of approximately seven open reading frames encoding for a collection of amino acid sequences comprising surface proteins and sortases ("GAS AI-3 proteins"). Specifically, GAS AI-3 includes open reading frames encoding for two or more (i.e., 2, 3, 4, 5, 6, or 7) of SpyM3_0098, SpyM3_0099, SpyM3_0100, SpyM3_0101, SpyM3_0102, SpyM3_0103, SpyM3_0104, SPs0100, SPs0101, SPs0102, SPs0103, SPs0104, SPs0105, SPs0106, orf78, orf79, orf80, orf81, orf82, orf83, orf84, spyM18_0126, spyM18_0127, spyM18_0128, spyM18_0129, spyM18_0130, spyM18_0131, spyM18_0132, SpyoM01000156, SpyoM01000155, SpyoM01000154, SpyoM01000153, SpyoM01000152, SpyoM01000151, SpyoM01000150, and SpyoM01000149. In one embodiment, GAS AI-3 includes open reading frames encoding for two or more (i.e., 2, 3, 4, 5, 6, or 7) of SpyM3_0098, SpyM3_0099, SpyM3_0100, SpyM3_0101, SpyM3_0102, SpyM3_0103, and SpyM3_0104. In another embodiment, GAS AI-3 includes open reading frames encoding for two or more (i.e., 2, 3, 4, 5, 6, or 7) of SPs0100, SPs0101, SPs0102, SPs0103, SPs0104, SPs0105, and SPs0106. In a further embodiment, GAS AI-3 includes open reading frames encoding for two or more (i.e., 2, 3, 4, 5, 6, or 7) of orf78, orf79, orf80, orf81, orf82, orf83, and orf84. In yet another embodiment, GAS AI-3 includes open reading frames encoding for two or more (i.e., 2, 3, 4, 5, 6, or 7) of spyM18_0126, spyM18_0127, spyM18_0128, spyM18_0129, spyM18_0130, spyM18_0131, and spyM18_0132. In yet another embodiment, GAS AI-3 includes open reading frames encoding for two or more (i.e., 2, 3, 4, 5, 6, or 7) of SpyoM01000156, SpyoM01000155, SpyoM01000154, SpyoM01000153, SpyoM01000152, SpyoM01000151, SpyoM01000150, and SpyoM01000149.

Applicants have also identified open reading frames encoding fimbrial structural subunits in other GAS bacteria harbouring an AI-3. These open reading frames encode fimbrial structural subunits ISS3040_fimbrial, ISS3776_fimbrial, and ISS4959_fimbrial. A GAS AI-3 may comprise a polynucleotide encoding any one of ISS3040_fimbrial, ISS3776_fimbrial, and ISS4959_fimbrial.

One or more of the GAS AI-3 open reading frame polynucleotide sequences may be replaced by a polynucleotide sequence coding for a fragment of the replaced ORF. Alternatively, one or more of the GAS AI-3 open reading frames may be replaced by a sequence having sequence homology to the replaced ORF.

A preferred immunogenic composition of the invention comprises a GAS AI-3 surface protein which may be formulated or purified in an oligomeric (pilis) form. In a preferred embodiment, the oligomeric form is a hyperoligomer. Another preferred immunogenic composition of the invention comprises a GAS AI-3 surface protein which has been isolated in an oligomeric (pilis) form. The oligomer or hyperoligomeric pilus structures comprising the GAS AI-3 surface proteins may be purified or otherwise formulate for use in immunogenic compositions.

One or more of the GAS AI-3 surface protein sequences typically include an LPXTG motif (such as LPXTG (SEQ ID NO:122)) or other sortase substrate motif. The AI surface proteins of the invention may affect the ability of the GAS bacteria to adhere to and invade epithelial cells. AI surface proteins may also affect the ability of GAS to translocate through an epithelial cell layer. Preferably, one or more AI surface proteins are capable of binding to or otherwise associating with an epithelial cell surface. AI surface proteins may also be able to bind to or associate with fibrinogen, fibronectin, or collagen.

The GAS AI-3 sortase proteins are predicted to be involved in the secretion and anchoring of the LPXTG containing surface proteins. GAS AI-3 may encode for at least one surface protein. Alternatively, GAS AI-3 may encode for at least two surface exposed proteins and at least one sortase. Preferably, GAS AI-3 encodes for at least three surface exposed proteins and at least two sortases.

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine or alanine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

The invention includes a composition comprising oligomeric, pilus-like structures comprising an AI surface protein such as SpyM3_0098, SpyM3_0100, SpyM3_0102, SpyM3_0104, SPs0100, SPs0102, SPs0104, SPs0106, orf78, orf80, orf82, orf84, spyM18_0126, spyM18_0128, spyM18_0130, spyM18_0132, SpyoM01000155, SpyoM01000153, SpyoM01000151, SpyoM01000149, ISS3040_fimbrial, ISS3776_fimbrial, and ISS4959_fimbrial. In one embodiment, the invention includes a composition comprising oligomeric, pilus-like structures comprising an AI surface protein such as SpyM3_0098, SpyM3_0100, SpyM3_0102, and SpyM3_0104. In another embodiment, the invention includes a composition comprising oligomeric, pilus-like structures comprising an AI surface protein such as SPs0100, SPs0102, SPs0104, and SPs0106. In another embodiment, the invention includes a composition comprising oligomeric, pilus-like structures comprising an AI surface protein such as orf78, orf80, orf82, and orf84. In yet another embodiment, the invention includes a composition comprising oligomeric, pilus-like structures comprising an AI surface protein such as spyM18_0126, spyM18_0128, spyM18_0130, and spyM18_0132. In a further embodiment, the invention includes a composition comprising oligomeric, pilus-like structures comprising an AI surface protein such as SpyoM01000155, SpyoM01000153, SpyoM0000151, and SpyoM1000149. In yet a further embodiment, the invention includes a composition comprising oligomeric, pilus-like structures comprising an AI surface protein such as ISS3040_fimbrial, ISS3776_fimbrial, and ISS4959_fimbrial. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyper-oligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine amino acid residue.

AI surface proteins or fragments thereof to be incorporated into the oligomeric, pilus-like structures of the invention will preferably include a pilin motif.

The oligomeric, pilus like structures may be used alone or in the combinations of the invention. In one embodiment, the invention comprises a GAS Adhesin Island protein in oligomeric form, preferably in a hyperoligomeric form. In one embodiment, the invention comprises a composition comprising one or more GAS Adhesin Island 3 ("GAS AI-3") proteins and one or more GAS Adhesin Island 1 ("GAS AI-1"), GAS Adhesin Island 2 ("GAS AI-2"), or GAS Adhesin Island 4 ("GAS AI-4") proteins, wherein one or more of the Adhesin Island proteins is in the form of an oligomer, preferably in a hyperoligomeric form.

In addition to the open reading frames encoding the GAS AI-3 proteins, GAS AI-3 may also include a transcriptional regulator such as Nra.

GAS Adhesin Island 4

A fourth adhesin island, "GAS Adhesin Island 4" or "GAS AI-4" has also been identified in Group A *Streptococcus* serotypes and isolates. GAS AI-4 comprises a series of approximately eight open reading frames encoding for a collection of amino acid sequences comprising surface proteins and sortases ("GAS AI-4 proteins"). Specifically, GAS AI-4 includes open reading frames encoding for two or more (i.e., 2, 3, 4, 5, 6, 7, or 8) of 19224134, 19224135, 19223136, 19223137, 19224138, 19224139, 19224140, and 19224141.

Applicants have also identified open reading frames encoding fimbrial structural subunits in other GAS bacteria harbouring an AI-4. These open reading frames encode fimbrial structural subunits 20010296_fimbrial, 20020069_fimbrial, CDC SS 635_fimbrial, ISS4883_fimbrial, and ISS4538_fimbrial. A GAS AI-4 may comprise a polynucleotide encoding any one of 20010296_fimbrial, 20020069_fimbrial, CDC SS 635_fimbrial, ISS4883_fimbrial, and ISS4538_fimbrial.

One or more of the GAS AI-4 open reading frame polynucleotide sequences may be replaced by a polynucleotide sequence coding for a fragment of the replaced ORF. Alternatively, one or more of the GAS AI-4 open reading frames may be replaced by a sequence having sequence homology to the replaced ORF.

A preferred immunogenic composition of the invention comprises a GAS AI-4 surface protein which may be formulated or purified in an oligomeric (pilis) form. In a preferred embodiment, the oligomeric form is a hyperoligomer. Another preferred immunogenic composition of the invention comprises a GAS AI-4 surface protein which has been isolated in an oligomeric (pilis) form. The oligomer or hyperoligomeric pilus structures comprising the GAS AI-4 surface proteins may be purified or otherwise formulate for use in immunogenic compositions.

One or more of the GAS AI-4 surface protein sequences typically include an LPXTG motif (such as LPXTG (SEQ ID NO:122)) or other sortase substrate motif. The AI surface proteins of the invention may effect the ability of the GAS bacteria to adhere to and invade epithelial cells. AI surface proteins may also affect the ability of GAS to translocate through an epithelial cell layer. Preferably, one or more AI surface proteins are capable of binding to or otherwise associating with an epithelial cell surface. AI surface proteins may also be able to bind to or associate with fibrinogen, fibronectin, or collagen.

The GAS AI-4 sortase proteins are predicted to be involved in the secretion and anchoring of the LPXTG containing surface proteins. GAS AI-4 may encode for at least one surface protein. Alternatively, GAS AI-4 may encode for at least two surface exposed proteins and at least one sortase. Preferably, GAS AI-4 encodes for at least three surface exposed proteins and at least two sortases.

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

In one embodiment, the invention includes a composition comprising oligomeric, pilus-like structures comprising an AI surface protein such as 19224134, 19224135, 19224137, 19224139, 19224141, 20010296_fimbrial, 20020069_fimbrial, CDC SS 635_fimbrial, ISS4883_fimbrial, and ISS4538_fimbrial. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyper-oligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine amino acid residue.

AI surface proteins or fragments thereof to be incorporated into the oligomeric, pilus-like structures of the invention will preferably include a pilin motif.

The oligomeric, pilus like structures may be used alone or in the combinations of the invention. In one embodiment, the invention comprises a GAS Adhesin Island protein in oligomeric form, preferably in a hyperoligomeric form. In one embodiment, the invention comprises a composition comprising one or more GAS Adhesin Island 4 ("GAS AI-4") proteins and one or more GAS Adhesin Island 1 ("GAS AI-1"), GAS Adhesin Island 2 ("GAS AI-2"), or GAS Adhesin Island 3 ("GAS AI-3") proteins, wherein one or more of the Adhesin Island proteins is in the form of an oligomer, preferably in a hyperoligomeric form.

In addition to the open reading frames encoding the GAS AI-4 proteins, GAS AI-4 may also include a divergently transcribed transcriptional regulator such as rofA (i.e., the transcriptional regulator is located near or adjacent to the AI protein open reading frames, but it transcribed in the opposite direction).

The oligomeric, pilus-like structures of the invention may be combined with one or more additional GAS proteins. In one embodiment, the oligomeric, pilus-like structures comprise one or more AI surface proteins in combination with a second GAS protein.

The oligomeric, pilus-like structures may be isolated or purified from bacterial cultures in which the bacteria express an AI surface protein. The invention therefore includes a method for manufacturing an oligomeric AI surface antigen comprising culturing a GAS bacterium that expresses the oligomeric AI protein and isolating the expressed oligomeric AI protein from the GAS bacteria. The AI protein may be collected from secretions into the supernatant or it may be purified from the bacterial surface. The method may further comprise purification of the expressed AI protein. Preferably, the AI protein is in a hyperoligomeric form.

The oligomeric, pilus-like structures may be isolated or purified from bacterial cultures overexpressing an AI surface protein. The invention therefore includes a method for manufacturing an oligomeric Adhesin Island surface antigen comprising culturing a GAS bacterium adapted for increased AI protein expression and isolation of the expressed oligomeric Adhesin Island protein from the GAS bacteria. The AI protein may be collected from secretions into the supernatant or it may be purified from the bacterial surface. The method may further comprise purification of the expressed Adhesin Island protein. Preferably, the Adhesin Island protein is in a hyperoligomeric form.

The GAS bacteria are preferably adapted to increase AI protein expression by at least two (e.g., 2, 3, 4, 5, 8, 10, 15, 20, 25, 30, 35, 40, 45, 50, 60, 70, 80, 90, 100, 125, 150 or 200) times wild type expression levels.

GAS bacteria may be adapted to increase AI protein expression by any means known in the art, including methods of increasing gene dosage and methods of gene upregulation. Such means include, for example, transformation of the GAS bacteria with a plasmid encoding the AI protein. The plasmid may include a strong promoter or it may include multiple copies of the sequence encoding the AI protein. Optionally, the sequence encoding the AI protein within the GAS bacterial genome may be deleted. Alternatively, or in addition, the promoter regulating the GAS Adhesin Island may be modified to increase expression.

The invention further includes GAS bacteria which have been adapted to produce increased levels of AI surface protein. In particular, the invention includes GAS bacteria which have been adapted to produce oligomeric or hyperoligomeric AI surface protein. In one embodiment, the Gram positive bacteria of the invention are inactivated or attenuated to permit in vivo delivery of the whole bacteria, with the AI surface protein exposed on its surface.

The invention further includes GAS bacteria which have been adapted to have increased levels of expressed AI protein incorporated in pili on their surface. The GAS bacteria may be adapted to have increased exposure of oligomeric or hyperoligomeric AI proteins on its surface by increasing expression levels of LepA polypeptide, or an equivalent signal peptidase, in the GAS bacteria. Applicants have shown that deletion of LepA in strain SF370 bacteria, which harbour a GAS AI-2, abolishes surface exposure of M and pili proteins on the GAs. Increased levels of LepA expression in GAS are expected to result in increased exposure of M and pili proteins on the surface of GAs. Increased expression of LepA in GAS may be achieved by any means known in the art, such as increasing gene dosage and methods of gene upregulation. The GAS bacteria adapted to have increased levels of LepA expression may additionally be adapted to express increased levels of at least one pili protein.

Alternatively, the AI proteins of the invention may be expressed on the surface of a non-pathogenic Gram positive bacteria, such as *Streptococcus gordonii* (See, e.g., Byrd et al., "Biological consequences of antigen and cytokine co-expression by recombinant *Streptococcus gordonii* vaccine vectors", Vaccine (2002) 20:2197-2205) or *Lactococcus lactis* (See, e.g., Mannam et al., "Mucosal Vaccine Made from Live, Recombinant *Lactococcus lactis* Protects Mice against Pharangeal Infection with *Streptococcus pyogenes*" Infection and Immunity (2004) 72 (6):3444-3450). As used herein, non-pathogenic Gram positive bacteria refer to Gram positive bacteria which are compatible with a human host subject and are not associated with human pathogenisis. Preferably, the non-pathogenic bacteria are modified to express the AI surface protein in oligomeric, or hyper-oligomeric form. Sequences encoding for an AI surface protein and, optionally, an AI sortase, may be integrated into the non-pathogenic Gram positive bacterial genome or inserted into a plasmid. The non-pathogenic Gram positive bacteria may be inactivated or attenuated to facilitate in vivo delivery of the whole bacteria, with the AI surface protein exposed on its surface. Alternatively, the AI surface protein may be isolated or purified from a bacterial culture of the non-pathogenic Gram positive bacteria. For example, the AI surface protein may be isolated from cell extracts or culture supernatants. Alternatively, the AI surface protein may be isolated or purified from the surface of the non-pathogenic Gram positive bacteria.

The non-pathogenic Gram positive bacteria may be used to express any of the GAS Adhesin Island proteins described herein. The non-pathogenic Gram positive bacteria are transformed to express an Adhesin Island surface protein. Preferably, the non-pathogenic Gram positive bacteria also express at least one Adhesin Island sortase. The AI transformed non-pathogenic Gram positive bacteria of the invention may be used to prevent or treat infection with pathogenic GAs.

Applicants modified *L. lactis* to demonstrate that, like GBS polypeptides, it can express GAS AI polypeptides. *L. lactis* was transformed with pAM401 constructs encoding entire pili gene clusters of AI-1, AI-2, and AI-4 adhesin islands. Briefly, the pAM401 is a promoterless high-copy plasmid. The entire pili gene clusters of an M6 (AI-1), M1 (AI-2), and M12 (AI-4) bacteria were inserted into the pAM401 construct. The gene clusters were transcribed under the control their own (M6, M1, or M12) promoter or the GBS promoter that successfully initiated expression of the GBS AI-1 adhesin islands in *L. lactis*, described above. FIG. 172 provides a schematic depiction of GAS M6 (AI-1), M1 (AI-2), and M12 (AI-4) adhesin islands and indicates the portions of the adhesin island sequences inserted in the pAM401 construct.

Each of the *L. lactis* transformed with one of the M6, M1, or M12 adhesin island gene clusters expressed high molecular weight structures that were immunoreactive with antibodies that bind to polypeptides present in their respective pili. FIGS. 173 A-C provide results of Western blot analysis of surface protein-enriched extracts of *L. lactis* transformed with M6 (FIG. 173 A), M1 (FIG. 173 B), or M12 (FIG. 173 C) adhesin island gene clusters using antibodies that bind to the fimbrial structural subunit encoded by each cluster. FIG. 173A at lanes 3 and 4 shows detection of high molecular structures in *L. lactis* transformed with an adhesin island pilus gene cluster from an M1 AI-2 using an antibody that binds to fimbrial structural subunit Spy0128. FIG. 173B at lanes 3 and 4 shows detection of high molecular weight structures in *L. lactis* transformed with an adhesin island pilus gene cluster from an M12 AI-4 using an antibody that binds to fimbrial structural subunit EftLSL.A. FIG. 173C at lane 3 shows detection of high molecular weight structures in *L. lactis* transformed with an adhesin island pilus gene cluster from an M6 AI-1 using an antibody that binds to fimbrial structural subunit M6_Spy0160. In FIGS. 173 A-C, "p1" immediately following the notation of AI subtype indicates that the promoter present in the Adhesin Island is used to drive transcription of the adhesin island gene cluster and "p2" indicates that the promoter was the GBS promoter described above. Thus, it appears that *L. lactis* is capable of expressing the fimbrial structural subunits encoded by GAS adhesin islands in an oligomeric form.

Alternatively, the oligomeric, pilus-like structures may be produced recombinantly. If produced in a recombinant host cell system, the AI surface protein will preferably be expressed in coordination with the expression of one or more of the AI sortases of the invention. Such AI sortases will facilitate oligomeric or hyperoligomeric formation of the AI surface protein subunits.

*S. pneumoniae* from TIGR4 Adhesin Island

As discussed above, Applicants have identified adhesin islands within the genome of *S. pneumoniae* from TIGR4. The *S. pneumoniae* from TIGR4 Adhesin Island comprises a series of approximately seven open reading frames encoding for a collection of amino acid sequences comprising surface proteins and sortases. Specifically, the *S. pneumoniae* from TIGR4 AI proteins includes open reading frames encoding for two or more (i.e., 2, 3, 4, 5, 6, or 7) of SP0462, SP0463, SP0464, SP0465, SP0466, SP0467, and SP0468.

A preferred immunogenic composition of the invention comprises a *S. pneumoniae* from TIGR4 AI surface protein which may be formulated or purified in an oligomeric (pilis) form. In a preferred embodiment, the oligomeric form is a hyperoligomer. Another preferred immunogenic composition of the invention comprises a *S. pneumoniae* from TIGR4 AI surface protein which has been isolated in an oligomeric (pilis) form. The oligomer or hyperoligomer pilus structures comprising *S. pneumoniae* surface proteins may be purified or otherwise formulated for use in immunogenic compositions.

One or more of the *S. pneumoniae* from TIGR4 AI open reading frame polynucleotide sequences may be replaced by a polynucleotide sequence coding for a fragment of the replaced ORF. Alternatively, one or more of the *S. pneumoniae* from TIGR4 AI open reading frames may be replaced by a sequence having sequence homology to the replaced ORF.

One or more of the *S. pneumoniae* from TIGR4 AI surface protein sequences typically include an LPXTG motif (such as LPXTG (SEQ ID NO:122)) or other sortase substrate motif.

The *S. pneumoniae* from TIGR4 AI surface proteins of the invention may affect the ability of the *S. pneumoniae* bacteria to adhere to and invade epithelial cells. AI surface proteins may also affect the ability of *S. pneumoniae* to translocate through an epithelial cell layer. Preferably, one or more *S. pneumoniae* from TIGR4 AI surface proteins are capable of binding to or otherwise associating with an epithelial cell surface. *S. pneumoniae* from TIGR4 AI surface proteins may also be able to bind to or associate with fibrinogen, fibronectin, or collagen.

The *S. pneumoniae* from TIGR4 AI sortase proteins are predicted to be involved in the secretion and anchoring of the LPXTG containing surface proteins. *S. pneumoniae* from TIGR4 AI may encode for at least one surface protein. Alternatively, *S. pneumoniae* from TIGR4 AI may encode for at least two surface exposed proteins and at least one sortase. Preferably, *S. pneumoniae* from TIGR4 AI encodes for at least three surface exposed proteins and at least two sortases.

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

In one embodiment, the invention includes a composition comprising oligomeric, pilus-like structures comprising a *S. pneumoniae* from TIGR4 AI surface protein such as SP0462, SP0463, SP0464, or SP0465. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyper-oligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine or serine amino acid residue, respectively.

AI surface proteins or fragments thereof to be incorporated into the oligomeric, pilus-like structures of the invention will preferably include a pilin motif.

The oligomeric, pilus like structures may be used alone or in the combinations of the invention. In one embodiment, the invention comprises a *S. pneumoniae* from TIGR4 AI protein in oligomeric form, preferably in a hyperoligomeric form. In one embodiment, the invention comprises a composition comprising one or more *S. pneumoniae* from TIGR4 AI proteins and one or more *S. pneumoniae* strain 670 AI proteins, wherein one or more of the *S. pneumoniae* AI proteins is in the form of an oligomer, preferably in a hyperoligomeric form.

In addition to the open reading frames encoding the *S. pneumoniae* from TIGR4 AI proteins, *S. pneumoniae* from TIGR4 AI may also include a transcriptional regulator.

*S. pneumoniae* Strain 670 Adhesin Island

As discussed above, Applicants have identified adhesin islands within the genome of *S. pneumoniae* strain 670. The *S. pneumoniae* strain 670 Adhesin Island comprises a series of approximately seven open reading frames encoding for a collection of amino acid sequences comprising surface proteins and sortases. Specifically, the *S. pneumoniae* strain 670 AI proteins includes open reading frames encoding for two or more (i.e., 2, 3, 4, 5, 6, or 7) of orf1_670, orf3_670, orf4_670, orf5_670, orf6_670, orf7_670, orf8_670.

A preferred immunogenic composition of the invention comprises a *S. pneumoniae* strain 670 AI surface protein which may be formulated or purified in an oligomeric (pilis) form. Another preferred immunogenic composition of the invention comprises a *S. pneumoniae* strain 670 AI surface protein which has been isolated in an oligomeric (pilis) form.

One or more of the *S. pneumoniae* strain 670 AI open reading frame polynucleotide sequences may be replaced by a polynucleotide sequence coding for a fragment of the replaced ORF. Alternatively, one or more of the *S. pneumoniae* strain 670 AI open reading frames may be replaced by a sequence having sequence homology to the replaced ORF.

One or more of the *S. pneumoniae* strain 670 AI surface protein sequences typically include an LPXTG motif (such as LPXTG (SEQ ID NO:122)) or other sortase substrate motif.

The *S. pneumoniae* strain 670 AI surface proteins of the invention may affect the ability of the *S. pneumoniae* bacteria to adhere to and invade epithelial cells. AI surface proteins may also affect the ability of *S. pneumoniae* to translocate through an epithelial cell layer. Preferably, one or more *S. pneumoniae* strain 670 AI surface proteins are capable of binding to or otherwise associating with an epithelial cell surface. *S. pneumoniae* strain 670 AI surface proteins may also be able to bind to or associate with fibrinogen, fibronectin, or collagen.

The *S. pneumoniae* strain 670 AI sortase proteins are predicted to be involved in the secretion and anchoring of the LPXTG containing surface proteins. *S. pneumoniae* strain 670 AI may encode for at least one surface protein. Alternatively, *S. pneumoniae* strain 670 AI may encode for at least two surface exposed proteins and at least one sortase. Preferably, *S. pneumoniae* strain 670 AI encodes for at least three surface exposed proteins and at least two sortases.

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

In one embodiment, the invention includes a composition comprising oligomeric, pilus-like structures comprising a *S. pneumoniae* strain 670 AI surface protein such as orf3_670, orf4_670, or orf5_670. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyper-oligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine or serine amino acid residue, respectively.

AI surface proteins or fragments thereof to be incorporated into the oligomeric, pilus-like structures of the invention will preferably include a pilin motif.

The oligomeric, pilus like structures may be used alone or in the combinations of the invention. In one embodiment, the invention comprises a *S. pneumoniae* strain 670 AI protein in oligomeric form, preferably in a hyperoligomeric form. In one embodiment, the invention comprises a composition comprising one or more *S. pneumoniae* strain 670 AI proteins and one or more *S. pneumoniae* from TIGR4 AI proteins, wherein one or more of the *S. pneumoniae* AI proteins is in the form of an oligomer, preferably in a hyperoligomeric form.

In addition to the open reading frames encoding the *S. pneumoniae* strain 670 AI proteins, *S. pneumoniae* strain 670 AI may also include a transcriptional regulator.

*S. pneumoniae* Strain 14 CSR 10 Adhesin Island

As discussed above, Applicants have identified adhesin islands within the genome of *S. pneumoniae* strain 14 CSR 10. The *S. pneumoniae* strain 14 CSR 10 Adhesin Island comprises a series of approximately seven open reading frames encoding for a collection of amino acid sequences comprising surface proteins and sortases. Specifically, the *S. pneumoniae* strain 14 CSR 10 AI proteins includes open reading frames encoding for two or more (i.e., 2, 3, 4, 5, 6, or 7) of ORF2_14CSR, ORF3_14CSR, ORF4_14CSR, ORF5_14CSR, ORF6_14CSR, ORF7_14CSR, ORF8_14CSR.

A preferred immunogenic composition of the invention comprises a *S. pneumoniae* strain 14 CSR 10 AI surface protein which may be formulated or purified in an oligomeric (pilis) form. Another preferred immunogenic composition of the invention comprises a *S. pneumoniae* strain 14 CSR 10 AI surface protein which has been isolated in an oligomeric (pilis) form.

One or more of the *S. pneumoniae* strain 14 CSR 10 AI open reading frame polynucleotide sequences may be replaced by a polynucleotide sequence coding for a fragment of the replaced ORF. Alternatively, one or more of the *S. pneumoniae* strain 14 CSR 10 AI open reading frames may be replaced by a sequence having sequence homology to the replaced ORF.

One or more of the *S. pneumoniae* strain 14 CSR 10 AI surface protein sequences typically include an LPXTG motif (such as LPXTG (SEQ ID NO:122)) or other sortase substrate motif.

The *S. pneumoniae* strain 14 CSR 10 AI surface proteins of the invention may affect the ability of the *S. pneumoniae* bacteria to adhere to and invade epithelial cells. AI surface proteins may also affect the ability of *S. pneumoniae* to translocate through an epithelial cell layer. Preferably, one or more *S. pneumoniae* strain 14 CSR 10 AI surface proteins are capable of binding to or otherwise associating with an epithelial cell surface. *S. pneumoniae* strain 14 CSR 10 AI surface proteins may also be able to bind to or associate with fibrinogen, fibronectin, or collagen.

The *S. pneumoniae* strain 14 CSR 10 AI sortase proteins are predicted to be involved in the secretion and anchoring of the LPXTG containing surface proteins. *S. pneumoniae* strain 14 CSR 10 AI may encode for at least one surface protein. Alternatively, *S. pneumoniae* strain 14 CSR 10 AI may encode for at least two surface exposed proteins and at least one sortase. Preferably, *S. pneumoniae* strain 14 CSR 10 AI encodes for at least three surface exposed proteins and at least two sortases.

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

In one embodiment, the invention includes a composition comprising oligomeric, pilus-like structures comprising a *S. pneumoniae* strain 14 CSR 10 AI surface protein such as orf3_CSR, orf4_CSR, or orf5_CSR. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyper-oligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine or serine amino acid residue, respectively.

AI surface proteins or fragments thereof to be incorporated into the oligomeric, pilus-like structures of the invention will preferably include a pilin motif.

The oligomeric, pilus like structures may be used alone or in the combinations of the invention. In one embodiment, the invention comprises a *S. pneumoniae* strain 14 CSR 10 AI protein in oligomeric form, preferably in a hyperoligomeric form. In one embodiment, the invention comprises a composition comprising one or more *S. pneumoniae* strain 14 CSR 10 AI proteins, and one or more AI proteins of any of *S. pneumoniae* from TIGR4, 670, 19A Hungary 6, 6B Finland 12, 6B Spain 2, 9V Spain 3, 19F Taiwan 14, 23F Taiwan 15, or 23F Poland 16, wherein one or more of the *S. pneumoniae* AI proteins is in the form of an oligomer, preferably in a hyperoligomeric form.

In addition to the open reading frames encoding the *S. pneumoniae* strain 14 CSR 10 AI proteins, *S. pneumoniae* strain 14 CSR 10 AI may also include a transcriptional regulator.

*S. pneumoniae* Strain 19A Hungary 6 Adhesin Island

As discussed above, Applicants have identified adhesin islands within the genome of *S. pneumoniae* strain 19A Hungary 6. The *S. pneumoniae* strain 19A Hungary 6 Adhesin Island comprises a series of approximately seven open reading frames encoding for a collection of amino acid sequences comprising surface proteins and sortases. Specifically, the *S. pneumoniae* strain 19A Hungary 6 AI proteins includes open reading frames encoding for two or more (i.e., 2, 3, 4, 5, 6, or 7) of ORF2__19AH, ORF3__19AH, ORF4__19AH, ORF5__1 gAH, ORF6__1 gAH, ORF7__19AH, ORF8__19AH.

A preferred immunogenic composition of the invention comprises a *S. pneumoniae* strain 19A Hungary 6 AI surface protein which may be formulated or purified in an oligomeric (pilis) form. Another preferred immunogenic composition of the invention comprises a *S. pneumoniae* strain 19A Hungary 6 AI surface protein which has been isolated in an oligomeric (pilis) form.

One or more of the *S. pneumoniae* strain 19A Hungary 6 AI open reading frame polynucleotide sequences may be replaced by a polynucleotide sequence coding for a fragment of the replaced ORF. Alternatively, one or more of the *S. pneumoniae* strain 19A Hungary 6 AI open reading frames may be replaced by a sequence having sequence homology to the replaced ORF.

One or more of the *S. pneumoniae* strain 19A Hungary 6 AI surface protein sequences typically include an LPXTG motif (such as LPXTG (SEQ ID NO:122)) or other sortase substrate motif.

The *S. pneumoniae* strain 19A Hungary 6 AI surface proteins of the invention may affect the ability of the *S. pneumoniae* bacteria to adhere to and invade epithelial cells. AI surface proteins may also affect the ability of *S. pneumoniae* to translocate through an epithelial cell layer. Preferably, one or more *S. pneumoniae* strain 19A Hungary 6 AI surface proteins are capable of binding to or otherwise associating with an epithelial cell surface. *S. pneumoniae* strain 19A Hungary 6 AI surface proteins may also be able to bind to or associate with fibrinogen, fibronectin, or collagen.

The *S. pneumoniae* strain 19A Hungary 6 AI sortase proteins are predicted to be involved in the secretion and anchoring of the LPXTG containing surface proteins. *S. pneumoniae* strain 19A Hungary 6 AI may encode for at least one surface protein. Alternatively, *S. pneumoniae* strain 19A Hungary 6 AI may encode for at least two surface exposed proteins and at least one sortase. Preferably, *S. pneumoniae* strain 19A Hungary 6 AI encodes for at least three surface exposed proteins and at least two sortases.

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

In one embodiment, the invention includes a composition comprising oligomeric, pilus-like structures comprising a *S. pneumoniae* strain 19A Hungary 6 AI surface protein such as orf3_19AH, orf4_19AH, or orf5_19AH. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyper-oligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine or serine amino acid residue, respectively.

AI surface proteins or fragments thereof to be incorporated into the oligomeric, pilus-like structures of the invention will preferably include a pilin motif.

The oligomeric, pilus like structures may be used alone or in the combinations of the invention. In one embodiment, the invention comprises a *S. pneumoniae* strain 19A Hungary 6 AI protein in oligomeric form, preferably in a hyperoligomeric form. In one embodiment, the invention comprises a composition comprising one or more *S. pneumoniae* strain 19A Hungary 6 AI proteins and one or more AI proteins from one of any one of *S. pneumoniae* from TIGR4, 670, 14 CSR 10, 6B Finland 12, 6B Spain 2, 9V Spain 3, 19F Taiwan 14, 23F Taiwan 15, or 23F Poland 16 AI GR4 AI proteins, wherein one or more of the *S. pneumoniae* AI proteins is in the form of an oligomer, preferably in a hyperoligomeric form.

In addition to the open reading frames encoding the *S. pneumoniae* strain 19A Hungary 6 AI proteins, *S. pneumoniae* strain 19A Hungary 6 AI may also include a transcriptional regulator.

*S. pneumoniae* Strain 19F Taiwan 14 Adhesin Island

As discussed above, Applicants have identified adhesin islands within the genome of *S. pneumoniae* strain 19F Taiwan 14. The *S. pneumoniae* strain 19F Taiwan 14 Adhesin Island comprises a series of approximately seven open reading frames encoding for a collection of amino acid sequences comprising surface proteins and sortases. Specifically, the *S. pneumoniae* strain 19F Taiwan 14 AI proteins includes open reading frames encoding for two or more (i.e., 2, 3, 4, 5, 6, or 7) of ORF2_19FTW, ORF3_19FTW, ORF4_19FTW, ORF5_19FTW, ORF6_19FTW, ORF7_19FTW, ORF8_19FTW.

A preferred immunogenic composition of the invention comprises a *S. pneumoniae* strain 19F Taiwan 14 AI surface protein which may be formulated or purified in an oligomeric (pilis) form. Another preferred immunogenic composition of the invention comprises a *S. pneumoniae* strain 19F Taiwan 14 AI surface protein which has been isolated in an oligomeric (pilis) form.

One or more of the *S. pneumoniae* strain 19F Taiwan 14 AI open reading frame polynucleotide sequences may be replaced by a polynucleotide sequence coding for a fragment of the replaced ORF. Alternatively, one or more of the *S. pneumoniae* strain 19F Taiwan 14 AI open reading frames may be replaced by a sequence having sequence homology to the replaced ORF.

One or more of the *S. pneumoniae* strain 19F Taiwan 14 AI surface protein sequences typically include an LPXTG motif (such as LPXTG (SEQ ID NO:122)) or other sortase substrate motif.

The *S. pneumoniae* strain 19F Taiwan 14 AI surface proteins of the invention may affect the ability of the *S. pneumoniae* bacteria to adhere to and invade epithelial cells. AI surface proteins may also affect the ability of *S. pneumoniae* to translocate through an epithelial cell layer. Preferably, one or more *S. pneumoniae* strain 19F Taiwan 14 AI surface proteins are capable of binding to or otherwise associating with an epithelial cell surface. *S. pneumoniae* strain 19F Taiwan 14 AI surface proteins may also be able to bind to or associate with fibrinogen, fibronectin, or collagen.

The *S. pneumoniae* strain 19F Taiwan 14 AI sortase proteins are predicted to be involved in the secretion and anchoring of the LPXTG containing surface proteins. *S. pneumoniae* strain 19F Taiwan 14 μl may encode for at least one surface protein. Alternatively, *S. pneumoniae* strain 19F Taiwan 14 AI may encode for at least two surface exposed proteins and at least one sortase. Preferably, *S. pneumoniae* strain 19F Taiwan 14 AI encodes for at least three surface exposed proteins and at least two sortases.

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

In one embodiment, the invention includes a composition comprising oligomeric, pilus-like structures comprising a *S. pneumoniae* strain 19F Taiwan 14 AI surface protein such as orf3_19FTW, orf4_19FTW, or orf5_19FTW. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyper-oligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine or serine amino acid residue, respectively.

AI surface proteins or fragments thereof to be incorporated into the oligomeric, pilus-like structures of the invention will preferably include a pilin motif.

The oligomeric, pilus like structures may be used alone or in the combinations of the invention. In one embodiment, the invention comprises a *S. pneumoniae* strain 19F Taiwan 14 AI protein in oligomeric form, preferably in a hyperoligomeric form. In one embodiment, the invention comprises a composition comprising one or more *S. pneumoniae* strain 19F Taiwan 14 AI proteins and one or more AI proteins of any one or more of *S. pneumoniae* from TIGR4, 670, 19A Hungary 6, 6B Finland 12, 6B Spain 2, 9V Spain 3, 14 CSR 10, 23F Taiwan 15, or 23F Poland 16, wherein one or more of the *S. pneumoniae* AI proteins is in the form of an oligomer, preferably in a hyperoligomeric form.

In addition to the open reading frames encoding the *S. pneumoniae* strain 19F Taiwan 14 AI proteins, *S. pneumoniae* strain 19F Taiwan 14 AI may also include a transcriptional regulator.

*S. pneumoniae* Strain 23F Poland 16 Adhesin Island

As discussed above, Applicants have identified adhesin islands within the genome of *S. pneumoniae* strain 23F Poland 16. The *S. pneumoniae* strain 23F Poland 16 Adhesin Island comprises a series of approximately seven open reading frames encoding for a collection of amino acid sequences comprising surface proteins and sortases. Specifically, the *S. pneumoniae* strain 23F Poland 16 AI proteins includes open reading frames encoding for two or more (i.e., 2, 3, 4, 5, 6, or 7) of ORF2__23FP, ORF3__23FP, ORF4__23FP, ORF5__23FP, ORF6__23FP, ORF7__23FP, and ORF8__23FP.

A preferred immunogenic composition of the invention comprises a *S. pneumoniae* strain 23F Poland 16 AI surface protein which may be formulated or purified in an oligomeric (pilis) form. Another preferred immunogenic composition of the invention comprises a *S. pneumoniae* strain 23F Poland 16 AI surface protein which has been isolated in an oligomeric (pilis) form.

One or more of the *S. pneumoniae* strain 23F Poland 16 AI open reading frame polynucleotide sequences may be replaced by a polynucleotide sequence coding for a fragment of the replaced ORF. Alternatively, one or more of the *S. pneumoniae* strain 23F Poland 16 AI open reading frames may be replaced by a sequence having sequence homology to the replaced ORF.

One or more of the *S. pneumoniae* strain 23F Poland 16 AI surface protein sequences typically include an LPXTG motif (such as LPXTG (SEQ ID NO:122)) or other sortase substrate motif.

The *S. pneumoniae* strain 23F Poland 16 AI surface proteins of the invention may affect the ability of the *S. pneumoniae* bacteria to adhere to and invade epithelial cells. AI surface proteins may also affect the ability of *S. pneumoniae* to translocate through an epithelial cell layer. Preferably, one or more *S. pneumoniae* strain 23F Poland 16 AI surface proteins are capable of binding to or otherwise associating with an epithelial cell surface. *S. pneumoniae* strain 23F Poland 16 AI surface proteins may also be able to bind to or associate with fibrinogen, fibronectin, or collagen.

The *S. pneumoniae* strain 23F Poland 16 AI sortase proteins are predicted to be involved in the secretion and anchoring of the LPXTG containing surface proteins. *S. pneumoniae* strain 23F Poland 16 AI may encode for at least one surface protein. Alternatively, *S. pneumoniae* strain 23F Poland 16 AI may encode for at least two surface exposed proteins and at least one sortase. Preferably, *S. pneumoniae* strain 23F Poland 16 AI encodes for at least three surface exposed proteins and at least two sortases.

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

In one embodiment, the invention includes a composition comprising oligomeric, pilus-like structures comprising a *S. pneumoniae* strain 23F Poland 16 AI surface protein such as orf3__23FP, orf4__23FP, or orf5__23FP. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyper-oligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine or serine amino acid residue, respectively.

AI surface proteins or fragments thereof to be incorporated into the oligomeric, pilus-like structures of the invention will preferably include a pilin motif.

The oligomeric, pilus like structures may be used alone or in the combinations of the invention. In one embodiment, the invention comprises a *S. pneumoniae* strain 23F Poland 16 AI protein in oligomeric form, preferably in a hyperoligomeric form. In one embodiment, the invention comprises a composition comprising one or more *S. pneumoniae* strain 23F Poland 16 AI proteins and one or more AI proteins from any one or more *S. pneumoniae* strains of TIGR4, 670, 19A Hungary 6, 6B Finland 12, 6B Spain 2, 9V Spain 3, 19F Taiwan 14, 23F Taiwan 15, or 14 CSR 10, wherein one or more of the *S. pneumoniae* AI proteins is in the form of an oligomer, preferably in a hyperoligomeric form.

In addition to the open reading frames encoding the *S. pneumoniae* strain 23F Poland 16 AI proteins, *S. pneumoniae* strain 23F Poland 16 AI may also include a transcriptional regulator.

*S. pneumoniae* Strain 23F Taiwan 15 Adhesin Island

As discussed above, Applicants have identified adhesin islands within the genome of *S. pneumoniae* strain 23F Taiwan 15. The *S. pneumoniae* strain 23F Taiwan 15 Adhesin Island comprises a series of approximately seven open reading frames encoding for a collection of amino acid sequences comprising surface proteins and sortases. Specifically, the *S. pneumoniae* strain 23F Taiwan 15 AI proteins includes open reading frames encoding for two or more (i.e., 2, 3, 4, 5, 6, or 7) of ORF2__23FTW, ORF3__23FTW, ORF4__23FTW, ORF5__23FTW, ORF6__23FTW, ORF7__23FW, ORF8__23FTW.

A preferred immunogenic composition of the invention comprises a *S. pneumoniae* strain 23F Taiwan 15 AI surface protein which may be formulated or purified in an oligomeric (pilis) form. Another preferred immunogenic composition of the invention comprises a *S. pneumoniae* strain 23F Taiwan 15 AI surface protein which has been isolated in an oligomeric (pilis) form.

One or more of the *S. pneumoniae* strain 23F Taiwan 15 AI open reading frame polynucleotide sequences may be replaced by a polynucleotide sequence coding for a fragment of the replaced ORF. Alternatively, one or more of the *S. pneumoniae* strain 23F Taiwan 15 AI open reading frames may be replaced by a sequence having sequence homology to the replaced ORF.

One or more of the *S. pneumoniae* strain 23F Taiwan 15 AI surface protein sequences typically include an LPXTG motif (such as LPXTG (SEQ ID NO:122)) or other sortase substrate motif.

The *S. pneumoniae* strain 23F Taiwan 15 AI surface proteins of the invention may affect the ability of the *S. pneumoniae* bacteria to adhere to and invade epithelial cells. AI surface proteins may also affect the ability of *S. pneumoniae* to translocate through an epithelial cell layer. Preferably, one or more *S. pneumoniae* strain 23F Taiwan 15 AI surface proteins are capable of binding to or otherwise associating with an epithelial cell surface. *S. pneumoniae* strain 23F Taiwan 15 AI surface proteins may also be able to bind to or associate with fibrinogen, fibronectin, or collagen.

The *S. pneumoniae* strain 23F Taiwan 15 AI sortase proteins are predicted to be involved in the secretion and anchoring of the LPXTG containing surface proteins. *S. pneumoniae* strain 23F Taiwan 15 AI may encode for at least one surface protein. Alternatively, *S. pneumoniae* strain 23F Taiwan 15 AI may encode for at least two surface exposed proteins and at least one sortase. Preferably, *S. pneumoniae* strain 23F Taiwan 15 AI encodes for at least three surface exposed proteins and at least two sortases.

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

In one embodiment, the invention includes a composition comprising oligomeric, pilus-like structures comprising a *S. pneumoniae* strain 23F Taiwan 15 AI surface protein such as orf3_23FTW, orf4_23FTW, or orf5_23FTW. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyper-oligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine or serine amino acid residue, respectively.

AI surface proteins or fragments thereof to be incorporated into the oligomeric, pilus-like structures of the invention will preferably include a pilin motif.

The oligomeric, pilus like structures may be used alone or in the combinations of the invention. In one embodiment, the invention comprises a *S. pneumoniae* strain 23F Taiwan 15 AI protein in oligomeric form, preferably in a hyperoligomeric form. In one embodiment, the invention comprises a composition comprising one or more *S. pneumoniae* strain 23F Taiwan 15 AI proteins and one or more AI proteins from any one or more of *S. pneumoniae* from TIGR4, 670, 19A Hungary 6, 6B Finland 12, 6B Spain 2, 9V Spain 3, 19F Taiwan 14, 14 CSR 10, or 23F Poland 16 AI, wherein one or more of the *S. pneumoniae* AI proteins is in the form of an oligomer, preferably in a hyperoligomeric form.

In addition to the open reading frames encoding the *S. pneumoniae* strain 23F Taiwan 15 AI proteins, *S. pneumoniae* strain 23F Taiwan 15 AI may also include a transcriptional regulator.

*S. pneumoniae* Strain 6B Finland 12 Adhesin Island

As discussed above, Applicants have identified adhesin islands within the genome of *S. pneumoniae* strain 6B Finland 12. The *S. pneumoniae* strain 6B Finland 12 Adhesin Island comprises a series of approximately seven open reading frames encoding for a collection of amino acid sequences comprising surface proteins and sortases. Specifically, the *S. pneumoniae* strain 6B Finland 12 AI proteins includes open reading frames encoding for two or more (i.e., 2, 3, 4, 5, 6, or 7) of ORF2_6BF, ORF3_6BF, ORF4_6BF, ORF5_6BF, ORF6_6BF, ORF7_6BF, ORF8_6BF.

A preferred immunogenic composition of the invention comprises a *S. pneumoniae* strain 6B Finland 12 AI surface protein which may be formulated or purified in an oligomeric (pilis) form. Another preferred immunogenic composition of the invention comprises a *S. pneumoniae* strain 6B Finland 12 AI surface protein which has been isolated in an oligomeric (pilis) form.

One or more of the *S. pneumoniae* strain 6B Finland 12 AI open reading frame polynucleotide sequences may be replaced by a polynucleotide sequence coding for a fragment of the replaced ORF. Alternatively, one or more of the *S. pneumoniae* strain 6B Finland 12 AI open reading frames may be replaced by a sequence having sequence homology to the replaced ORF.

One or more of the *S. pneumoniae* strain 6B Finland 12 AI surface protein sequences typically include an LPXTG motif (such as LPXTG (SEQ ID NO:122)) or other sortase substrate motif.

The *S. pneumoniae* strain 6B Finland 12 AI surface proteins of the invention may affect the ability of the *S. pneumoniae* bacteria to adhere to and invade epithelial cells. AI surface proteins may also affect the ability of *S. pneumoniae* to translocate through an epithelial cell layer. Preferably, one or more *S. pneumoniae* strain 6B Finland 12 AI surface proteins are capable of binding to or otherwise associating with an epithelial cell surface. *S. pneumoniae* strain 6B Finland 12 AI surface proteins may also be able to bind to or associate with fibrinogen, fibronectin, or collagen.

The *S. pneumoniae* strain 6B Finland 12 AI sortase proteins are predicted to be involved in the secretion and anchoring of the LPXTG containing surface proteins. *S. pneumoniae* strain 6B Finland 12 AI may encode for at least one surface protein. Alternatively, *S. pneumoniae* strain 6B Finland 12 AI may encode for at least two surface exposed proteins and at least one sortase. Preferably, *S. pneumoniae* strain 6B Finland 12 AI encodes for at least three surface exposed proteins and at least two sortases.

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

In one embodiment, the invention includes a composition comprising oligomeric, pilus-like structures comprising a *S. pneumoniae* strain 6B Finland 12 AI surface protein such as orf3_6BF, orf4_6BF, or orf5_6BF. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyper-oligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine or serine amino acid residue, respectively.

AI surface proteins or fragments thereof to be incorporated into the oligomeric, pilus-like structures of the invention will preferably include a pilin motif.

The oligomeric, pilus like structures may be used alone or in the combinations of the invention. In one embodiment, the invention comprises a *S. pneumoniae* strain 6B Finland 12 AI protein in oligomeric form, preferably in a hyperoligomeric form. In one embodiment, the invention comprises a composition comprising one or more *S. pneumoniae* strain 6B Finland 12 AI proteins and one or more AI proteins of any one or more of *S. pneumoniae* from TIGR4, 670, 19A Hungary 6, 6B Finland 12, 6B Spain 2, 9V Spain 3, 19F Taiwan 14, 23F Taiwan 15, or 23F Poland 16 AI, wherein one or more of the *S. pneumoniae* AI proteins is in the form of an oligomer, preferably in a hyperoligomeric form.

In addition to the open reading frames encoding the *S. pneumoniae* strain 6B Finland 12 AI proteins, *S. pneumoniae* strain 6B Finland 12 AI may also include a transcriptional regulator.

*S. pneumoniae* Strain 6B Spain 2 Adhesin Island

As discussed above, Applicants have identified adhesin islands within the genome of *S. pneumoniae* strain 6B Spain 2. The *S. pneumoniae* strain 6B Spain 2 Adhesin Island comprises a series of approximately seven open reading frames encoding for a collection of amino acid sequences comprising surface proteins and sortases. Specifically, the *S. pneumoniae* strain 6B Spain 2 AI proteins includes open reading frames encoding for two or more (i.e., 2, 3, 4, 5, 6, or 7) of ORF2_6BSP, ORF3_6BSP, ORF4_6BSP, ORF5_6BSP, ORF6_6BSP, ORF7_6BSP, and ORF8_6BSP.

A preferred immunogenic composition of the invention comprises a *S. pneumoniae* strain 6B Spain 2 AI surface protein which may be formulated or purified in an oligomeric (pilis) form. Another preferred immunogenic composition of the invention comprises a *S. pneumoniae* strain 6B Spain 2 AI surface protein which has been isolated in an oligomeric (pilis) form.

One or more of the *S. pneumoniae* strain 6B Spain 2 AI open reading frame polynucleotide sequences may be replaced by a polynucleotide sequence coding for a fragment of the replaced ORF. Alternatively, one or more of the *S. pneumoniae* strain 6B Spain 2 AI open reading frames may be replaced by a sequence having sequence homology to the replaced ORF.

One or more of the *S. pneumoniae* strain 6B Spain 2 AI surface protein sequences typically include an LPXTG motif (such as LPXTG (SEQ ID NO:122)) or other sortase substrate motif.

The *S. pneumoniae* strain 6B Spain 2 AI surface proteins of the invention may affect the ability of the *S. pneumoniae* bacteria to adhere to and invade epithelial cells. AI surface proteins may also affect the ability of *S. pneumoniae* to translocate through an epithelial cell layer. Preferably, one or more *S. pneumoniae* strain 6B Spain 2 AI surface proteins are capable of binding to or otherwise associating with an epithelial cell surface. *S. pneumoniae* strain 6B Spain 2 AI surface proteins may also be able to bind to or associate with fibrinogen, fibronectin, or collagen.

The *S. pneumoniae* strain 6B Spain 2 AI sortase proteins are predicted to be involved in the secretion and anchoring of the LPXTG containing surface proteins. *S. pneumoniae* strain 6B Spain 2 AI may encode for at least one surface protein. Alternatively, *S. pneumoniae* strain 6B Spain 2 AI may encode for at least two surface exposed proteins and at least one sortase. Preferably, *S. pneumoniae* strain 6B Spain 2 AI encodes for at least three surface exposed proteins and at least two sortases.

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

In one embodiment, the invention includes a composition comprising oligomeric, pilus-like structures comprising a *S. pneumoniae* strain 6B Spain 2 AI surface protein such as orf3_6BSP, orf4_6BSP, or orf5_6BSP. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyper-oligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine or serine amino acid residue, respectively.

AI surface proteins or fragments thereof to be incorporated into the oligomeric, pilus-like structures of the invention will preferably include a pilin motif.

The oligomeric, pilus like structures may be used alone or in the combinations of the invention. In one embodiment, the invention comprises a *S. pneumoniae* strain 6B Spain 2 AI protein in oligomeric form, preferably in a hyperoligomeric form. In one embodiment, the invention comprises a composition comprising one or more *S. pneumoniae* strain 6B Spain 2 AI proteins and one or more AI proteins of any one or more of *S. pneumoniae* from TIGR4, 670, 19A Hungary 6, 6B Finland 12, 14 CSR 10, 9V Spain 3, 19F Taiwan 14, 23F Taiwan 15, or 23F Poland 16 AI, wherein one or more of the *S. pneumoniae* AI proteins is in the form of an oligomer, preferably in a hyperoligomeric form.

In addition to the open reading frames encoding the *S. pneumoniae* strain 6B Spain 2 AI proteins, *S. pneumoniae* strain 6B Spain 2 AI may also include a transcriptional regulator.

*S. pneumoniae* Strain 9V Spain 3 Adhesin Island

As discussed above, Applicants have identified adhesin islands within the genome of *S. pneumoniae* strain 9V Spain 3. The *S. pneumoniae* strain 9V Spain 3 Adhesin Island comprises a series of approximately seven open reading frames encoding for a collection of amino acid sequences comprising surface proteins and sortases. Specifically, the *S. pneumoniae* strain 9V Spain 3 AI proteins includes open reading frames encoding for two or more (i.e., 2, 3, 4, 5, 6, or 7) of ORF2_9VSP, ORF3_9VSP, ORF4_9VSP, ORF5_9VSP, ORF6_9VSP, ORF7_9VSP, and ORF8_9VSP.

A preferred immunogenic composition of the invention comprises a *S. pneumoniae* strain 9V Spain 3 AI surface protein which may be formulated or purified in an oligomeric (pilis) form. Another preferred immunogenic composition of the invention comprises a *S. pneumoniae* strain 9V Spain 3 AI surface protein which has been isolated in an oligomeric (pilis) form.

One or more of the *S. pneumoniae* strain 9V Spain 3 AI open reading frame polynucleotide sequences may be replaced by a polynucleotide sequence coding for a fragment of the replaced ORF. Alternatively, one or more of the *S. pneumoniae* strain 9V Spain 3 AI open reading frames may be replaced by a sequence having sequence homology to the replaced ORF.

One or more of the *S. pneumoniae* strain 9V Spain 3 AI surface protein sequences typically include an LPXTG motif (such as LPXTG (SEQ ID NO:122)) or other sortase substrate motif.

The *S. pneumoniae* strain 9V Spain 3 AI surface proteins of the invention may affect the ability of the *S. pneumoniae* bacteria to adhere to and invade epithelial cells. AI surface proteins may also affect the ability of *S. pneumoniae* to translocate through an epithelial cell layer. Preferably, one or more *S. pneumoniae* strain 9V Spain 3 AI surface proteins are capable of binding to or otherwise associating with an epithelial cell surface. *S. pneumoniae* strain 9V Spain 3 AI surface proteins may also be able to bind to or associate with fibrinogen, fibronectin, or collagen.

The *S. pneumoniae* strain 9V Spain 3 AI sortase proteins are predicted to be involved in the secretion and anchoring of the LPXTG containing surface proteins. *S. pneumoniae* strain 9V Spain 3 AI may encode for at least one surface protein. Alternatively, *S. pneumoniae* strain 9V Spain 3 AI may encode for at least two surface exposed proteins and at least one sortase. Preferably, *S. pneumoniae* strain 9V Spain 3 AI encodes for at least three surface exposed proteins and at least two sortases.

The AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722.

In one embodiment, the invention includes a composition comprising oligomeric, pilus-like structures comprising a *S. pneumoniae* strain 9V Spain 3 AI surface protein such as orf3_9VSP, orf4_9VSP, or orf5_9VSP. The oligomeric, pilus-like structure may comprise numerous units of AI surface protein. Preferably, the oligomeric, pilus-like structures comprise two or more AI surface proteins. Still more preferably, the oligomeric, pilus-like structure comprises a hyperoligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine or serine amino acid residue, respectively.

AI surface proteins or fragments thereof to be incorporated into the oligomeric, pilus-like structures of the invention will preferably include a pilin motif.

The oligomeric, pilus like structures may be used alone or in the combinations of the invention. In one embodiment, the invention comprises a *S. pneumoniae* strain 9V Spain 3 AI protein in oligomeric form, preferably in a hyperoligomeric form. In one embodiment, the invention comprises a composition comprising one or more *S. pneumoniae* strain 9V Spain 3 AI proteins and one or more AI proteins from any one or more of *S. pneumoniae* from TIGR4, 670, 19A Hungary 6, 6B Finland 12, 6B Spain 2, 14 CSR 10, 19F Taiwan 14, 23F Taiwan 15, or 23F Poland 16 AI, wherein one or more of the *S. pneumoniae* AI proteins is in the form of an oligomer, preferably in a hyperoligomeric form.

In addition to the open reading frames encoding the *S. pneumoniae* strain 9V Spain 3 AI proteins, *S. pneumoniae* strain 9V Spain 3 AI may also include a transcriptional regulator.

The *S. pneumoniae* oligomeric, pilus-like structures may be isolated or purified from bacterial cultures in which the bacteria express an *S. pneumoniae* AI surface protein. The invention therefore includes a method for manufacturing an oligomeric AI surface antigen comprising culturing a *S. pneumoniae* bacterium that expresses the oligomeric AI protein and isolating the expressed oligomeric AI protein from the *S. pneumoniae* bacteria. The AI protein may be collected from secretions into the supernatant or it may be purified from the bacterial surface. The method may further comprise purification of the expressed AI protein. Preferably, the AI protein is in a hyperoligomeric form.

The oligomeric, pilus-like structures may be isolated or purified from bacterial cultures overexpressing an AI surface protein. The invention therefore includes a method for manufacturing an *S. pneumoniae* oligomeric Adhesin Island surface antigen comprising culturing a *S. pneumoniae* bacterium adapted for increased AI protein expression and isolation of the expressed oligomeric Adhesin Island protein from the *S. pneumoniae* bacteria. The AI protein may be collected from secretions into the supernatant or it may be purified from the bacterial surface. The method may further comprise purification of the expressed Adhesin Island protein. Preferably, the Adhesin Island protein is in a hyperoligomeric form.

The *S. pneumoniae* bacteria are preferably adapted to increase AI protein expression by at least two (e.g., 2, 3, 4, 5, 8, 10, 15, 20, 25, 30, 35, 40, 45, 50, 60, 70, 80, 90, 100, 125, 150 or 200) times wild type expression levels.

*S. pneumoniae* bacteria may be adapted to increase AI protein expression by any means known in the art, including methods of increasing gene dosage and methods of gene upregulation. Such means include, for example, transformation of the *S. pneumoniae* bacteria with a plasmid encoding the AI protein. The plasmid may include a strong promoter or it may include multiple copies of the sequence encoding the AI protein. Optionally, the sequence encoding the AI protein within the *S. pneumoniae* bacterial genome may be deleted. Alternatively, or in addition, the promoter regulating the *S. pneumoniae* Adhesin Island may be modified to increase expression.

The invention further includes *S. pneumoniae* bacteria which have been adapted to produce increased levels of AI surface protein. In particular, the invention includes *S. pneumoniae* bacteria which have been adapted to produce oligomeric or hyperoligomeric AI surface protein. In one embodiment, the *S. pneumoniae* of the invention are inactivated or attenuated to permit in vivo delivery of the whole bacteria, with the AI surface protein exposed on its surface.

The invention further includes *S. pneumoniae* bacteria which have been adapted to have increased levels of expressed AI protein incorporated in pili on their surface. The *S. pneumoniae* bacteria may be adapted to have increased exposure of oligomeric or hyperoligomeric AI proteins on its surface by increasing expression levels of a signal peptidase polypeptide. Increased levels of a local signal peptidase expression in Gram positive bacteria (such us LepA in GAS) are expected to result in increased exposure of pili proteins on the surface of Gram positive bacteria. Increased expression of a leader peptidase in *S. pneumoniae* may be achieved by any means known in the art, such as increasing gene dosage and methods of gene upregulation. The *S. pneumoniae* bacteria adapted to have increased levels of leader peptidase may additionally be adapted to express increased levels of at least one pili protein.

Alternatively, the AI proteins of the invention may be expressed on the surface of a non-pathogenic Gram positive bacteria, such as *Streptococcus gordonii* (See, e.g., Byrd et al., "Biological consequences of antigen and cytokine co-expression by recombinant *Streptococcus gordonii* vaccine vectors", Vaccine (2002) 20:2197-2205) or *Lactococcus* lactis (See, e.g., Mannam et al., "Mucosal Vaccine Made from Live, Recombinant *Lactococcus* lactis Protects Mice against Pharangeal Infection with *Streptococcus pyogenes*" Infection and Immunity (2004) 72 (6):3444-3450). As used herein, non-pathogenic Gram positive bacteria refer to Gram positive bacteria which are compatible with a human host subject and are not associated with human pathogenisis. Preferably, the non-pathogenic bacteria are modified to express the AI surface protein in oligomeric, or hyper-oligomeric form. Sequences encoding for an AI surface protein and, optionally, an AI sortase, may be integrated into the non-pathogenic Gram positive bacterial genome or inserted into a plasmid. The non-pathogenic Gram positive bacteria may be inactivated or attenuated to facilitate in vivo delivery of the whole bacteria, with the AI surface protein exposed on its surface. Alternatively, the AI surface protein may be isolated or purified from a bacterial culture of the non-pathogenic Gram positive bacteria. For example, the AI surface protein may be isolated from cell extracts or culture supernatants. Alternatively, the AI surface protein may be isolated or purified from the surface of the non-pathogenic Gram positive bacteria.

The non-pathogenic Gram positive bacteria may be used to express any of the *S. pneumoniae* Adhesin Island proteins described herein. The non-pathogenic Gram positive bacteria are transformed to express an Adhesin Island surface protein. Preferably, the non-pathogenic Gram positive bacteria also express at least one Adhesin Island sortase. The AI transformed non-pathogenic Gram positive bacteria of the invention may be used to prevent or treat infection with pathogenic *S. pneumoniae.*

FIGS. 190 A and B, and 193-195 provide examples of three methods successfully practiced by applicants to purify pili from *S. pneumoniae* TIGR4.

Immunogenic Compositions

The Gram positive bacteria AI proteins described herein are useful in immunogenic compositions for the prevention or treatment of Gram positive bacterial infection. For example, the GBS AI surface proteins described herein are useful in immunogenic compositions for the prevention or treatment of GBS infection. As another example, the GAS AI surface proteins described herein may be useful in immunogenic compositions for the prevention or treatment of GAS infection. As another example, the *S. pneumoniae* AI surface proteins may be useful in immunogenic compositions for the prevention or treatment of *S. pneumoniae* infection.

Gram positive bacteria AI surface proteins that can provide protection across more than one serotype or strain isolate may be used to increase immunogenic effectiveness. For example, a particular GBS AI surface protein having an amino acid sequence that is at least 50% (i.e., at least 55%, 60%, 65%, 70%, 75%, 80%, 85%, 90%, 95%, 96%, 97%, 98%, 99%, or 100%) homologous to the particular GBS AI surface protein of at least 2 (i.e., at least 3, 4, 5, 6, 7, 8, 9, 10, or more) other GBS serotypes or strain isolates may be used to increase the effectiveness of such compositions.

As another example, fragments of Gram positive bacteria AI surface proteins that can provide protection across more than one serotype or strain isolate may be used to increase immunogenic effectiveness. Such a fragment may be identified within a consensus sequence of a full length amino acid sequence of a Gram positive bacteria AI surface protein. Such a fragment can be identified in the consensus sequence by its high degree of homology or identity across multiple (i.e., at least 3, 4, 5, 6, 7, 8, 9, 10, or more) Gram positive bacteria serotypes or strain isolates. Preferably, a high degree of homology is a degree of homology of at least 90% (i.e., at least 90%, 91%, 92%, 93%, 94%, 95%, 96%, 97%, 98%, 99%, or 100%) across Gram positive bacteria serotypes or strain isolates. Preferably, a high degree of identity is a degree of identity of at least 90% (i.e., at least 90%, 91%, 92%, 93%, 94%, 95%, 96%, 97%, 98%, 99%, or 100%) across Gram positive bacteria serotypes or strain isolates. In one embodiment of the invention, such a fragment of a Gram positive bacteria AI surface protein may be used in the immunogenic compositions.

In addition, the AI surface protein oligomeric pilus structures may be formulated or purified for use in immunization. Isolated AI surface protein oligomeric pilus structures may also be used for immunization.

The invention includes an immunogenic composition comprising a first Gram positive bacteria AI protein and a second Gram positive bacterial AI protein. One or more of the AI proteins may be a surface protein. Such surface proteins may contain an LPXTG motif or other sortase substrate motif.

The first and second AI proteins may be from the same or different genus or species of Gram positive bacteria. If within the same species, the first and second AI proteins may be from the same or different AI subtypes. If two AIs are of the same subtype, the AIs have the same numerical designation. For example, all AIs designated as AI-1 are of the same AI subtype. If two AIs are of a different subtype, the AIs have different numerical designations. For example, AI-1 is of a different AI subtype from AI-2, AI-3, AI-4, etc. Likewise, AI-2 is of a different AI subtype from AI-1, AI-3, and AI-4, etc.

For example, the invention includes an immunogenic composition comprising one or more GBS AI-1 proteins and one or more GBS AI-2 proteins. One or more of the AI proteins may be a surface protein. Such surface proteins may contain an LPXTG motif (such as LPXTG (SEQ ID NO:122)) and may bind fibrinogen, fibronectin, or collagen. One or more of the AI proteins may be a sortase. The GBS AI-1 proteins may be selected from the group consisting of GBS 80, GBS 104, GBS 52, SAG0647 and SAG0648. Preferably, the GBS AI-1 proteins include GBS 80 or GBS 104.

The GBS AI-2 proteins may be selected from the group consisting of GBS 67, GBS 59, GBS 150, SAG1405, SAG1406, 01520, 01521, 01522, 01523, 01523, 01524 and 01525. In one embodiment, the GBS AI-2 proteins are selected from the group consisting of GBS 67, GBS 59, GBS 150, SAG1405, and SAG1406. In another embodiment, the GBS AI-2 proteins may be selected from the group consisting of 01520, 01521, 01522, 01523, 01523, 01524 and 01525. Preferably, the GBS AI-2 protein includes GBS 59 or GBS 67.

As another example, the invention includes an immunogenic composition comprising one or more of any combination of GAS AI-1, GAS AI-2, GAS AI-3, or GAS AI-4 proteins. One or more of the GAS AI proteins may be a sortase.

The GAS AI-1 proteins may be selected from the group consisting of M6_Spy0156, M6_Spy0157, M6_Spy0158, M6_Spy0159, M6_Spy0160, M6_Spy0161, CDC SS 410_fimbrial, ISS3650_fimbrial, and DSM2071_fimbrial. Preferably, the GAS AI-1 proteins are selected from the group consisting of M6_Spy0157, M6_Spy0159, M6_Spy0160, CDC SS 410_fimbrial, ISS3650_fimbrial, and DSM2071_fimbrial.

The GAS AI-2 proteins may be selected from the group consisting of Spy0124, GAS15, Spy0127, GAS16, GAS17, GAS18, Spy0131, Spy0133, and GAS20. Preferably, the GAS AI-2 proteins are selected from the group consisting of GAS 15, GAS 16, and GAS 18.

The GAS AI-3 proteins may be selected from the group consisting of SpyM3__0097, SpyM3__0098, SpyM3__0099, SpyM3__0100, SpyM3__0101, SpyM3__0102, SpyM3__0103, SpyM3__0104, SPs0099, SPs0100, SPs0101, SPs0102, SPs0103, SPs0104, SPs0105, SPs0106, orf77, orf78, orf79, orf80, orf81, orf82, orf83, orf84, spyM18__0125, spyM18__0126, spyM18__0127, spyM18__0128, spyM18__0129, spyM18__0130, spyM18__0131, spyM18__0132, SpyoM01000156, SpyoM01000155, SpyoM01000154, SpyoM01000153, SpyoM01000152, SpyoM01000151, SpyoM01000150, SpyoM01000149, ISS3040_fimbrial, ISS3776_fimbrial, and ISS4959_fimbrial. In one embodiment the GAS AI-3 proteins are selected from the group consisting of SpyM3__0097, SpyM3__0098, SpyM3__0099, SpyM3__0100, SpyM3__0101, SpyM3__0102, SpyM3__0103, and SpyM3__0104. In another embodiment, the GAS AI-3 proteins are selected from the group consisting of SPs0099, SPs0100, SPs0101, SPs0102, SPs0103, SPs0104, SPs0105, and SPs0106. In yet another embodiment, the GAS AI-3 proteins are selected from the group consisting of orf77, orf78, orf79, orf80, orf81, orf82, orf83, and orf84. In a further embodiment, the GAS AI-3 proteins are selected from the group consisting of spyM18__0125, spyM18__0126, spyM18__0127, spyM18__0128, spyM18__0129, spyM18__0130, spyM18__0131, and spyM18__0132. In yet another embodiment the GAS AI-3 proteins are selected from the group consisting of SpyoM01000156, SpyoM01000155, SpyoM01000154, SpyoM01000153, SpyoM01000152, SpyoM01000151, SpyoM01000150, and SpyoM01000149.

The GAS AI-4 proteins may be selected from the group consisting of 19224133, 19224134, 19224135, 19224136, 19224137, 19224138, 19224139, 19224140, 19224141, 20010296_fimbrial, 20020069_fimbrial, CDC SS 635_fimbrial, ISS4883_fimbrial, and ISS4538_fimbrial. Preferably, the GAS-AI-4 proteins are selected from the group consisting of 19224134, 19224135, 19224137, 19224139, 19224141, 20010296_fimbrial, 20020069_fimbrial, CDC SS 635_fimbrial, ISS4883_fimbrial, and ISS4538_fimbrial.

As yet another example, the invention includes an immunogenic composition comprising one or more of any combination of *S. pneumoniae* from TIGR4, *S. pneumoniae* strain 670, *S. pneumoniae* from 19A Hungary 6, *S. pneumoniae* from 6B Finland 12, *S. pneumoniae* from 6B Spain 2, *S. pneumoniae* from 9V Spain 3, *S. pneumoniae* from 14 CSR 10, *S. pneumoniae* from 19F Taiwan 14, *S. pneumoniae* from 23F Taiwan 15, or *S. pneumoniae* from 23F Poland 16 AI proteins. One or more of the AI proteins may be a surface protein. Such surface proteins may contain an LPXTG motif (such as LPXTG (SEQ ID NO:122)) and may bind fibrinogen, fibronectin, or collagen. One or more of the AI proteins may be a sortase.

The *S. pneumoniae* from TIGR4 AI proteins may be selected from the group consisting of SP0462, SP0463, SP0464, SP0465, SP0466, SP0467, SP0468. Preferably, the *S. pneumoniae* from TIGR4 AI proteins include SP0462, SP0463, or SP0464.

The *S. pneumoniae* strain 670 AI proteins may be selected from the group consisting of Orf1__670, Orf3__670, Orf4__670, Orf5__670, Orf6__670, Orf7__670, and Orf8__670. Preferably, the *S. pneumoniae* strain 670 AI proteins include Orf3__670, Orf4__670, or Orf5__670.

The *S. pneumoniae* from 19A Hungary 6 AI proteins may be selected from the group consisting of ORF2__1 gAH, ORF3__1 gAH, ORF4__19AH, ORF5__19AH, ORF6__1 gAH, ORF7__19AH, or ORF8__19AH.

The *S. pneumoniae* from 6B Finland 12 AI proteins may be selected from the group consisting of ORF2__6BF, ORF3__6BF, ORF4__6BF, ORF5__6BF, ORF6__6BF, ORF7__6BF, or ORF8__6BF.

The *S. pneumoniae* from 6B Spain 2 AI proteins may be selected from the group consisting of ORF2__6BSP, ORF3__6BSP, ORF4__6BSP, ORF5__6BSP, ORF6__6BSP, ORF7__6BSP, or ORF8__6BSP.

The *S. pneumoniae* from 9V Spain 3 AI proteins may be selected from the group consisting of ORF2__9VSP, ORF3__9VSP, ORF4__9VSP, ORF5__9VSP, ORF6__9VSP, ORF7__9VSP, or ORF8__9VSP.

The *S. pneumoniae* from 14 CSR 10 AI proteins may be selected from the group consisting of ORF2__14CSR, ORF3__14CSR, ORF4__14CSR, ORF5__14CSR, ORF6__14CSR, ORF7__14CSR, or ORF8__14CSR.

The *S. pneumoniae* from 19F Taiwan 14 AI proteins may be selected from the group consisting of ORF2__1gFTW, ORF3__19FTW, ORF4__19FTW, ORF5__19FTW, ORF6__19FTW, ORF7__19FTW, or ORF8__19FTW.

The *S. pneumoniae* from 23F Taiwan 15 AI proteins may be selected from the group consisting of ORF2__23FTW, ORF3__23FTW, ORF4__23FTW, ORF5__23FTW, ORF6__23FTW, ORF7__23FTW, or ORF8__23FTW.

The *S. pneumoniae* from 23F Poland 16 AI proteins may be selected from the group consisting of ORF2__23FP, ORF3__23FP, ORF4__23FP, ORF5__23FP, ORF6__23FP, ORF7__23FP or ORF8__23FP.

Preferably, the Gram positive bacteria AI proteins included in the immunogenic compositions of the invention can provide protection across more than one serotype or strain isolate. For example, the immunogenic composition may comprise a first AI protein, wherein the amino acid sequence of said AI protein is at least 90% (i.e., at least 90, 91, 92, 93, 94, 95, 96, 97, 98, 99 or 100%) homologous to the amino acid sequence of a second AI protein, and wherein said first AI protein and said second AI protein are derived from the genomes of different serotypes of a Gram positive bacteria. The first AI protein may also be homologous to the amino acid sequence of a third AI protein, such that the first AI protein, the second AI protein and the third AI protein are derived from the genomes of different serotypes of a Gram positive bacteria. The first AI protein may also be homologous to the amino acid sequence of a fourth AI protein, such that the first AI protein, the second AI protein and the third AI protein are derived from the genomes of different serotypes of a Gram positive bacteria.

For example, preferably, the GBS AI proteins included in the immunogenic compositions of the invention can provide protection across more than one GBS serotype or strain isolate. For example, the immunogenic composition may comprise a first GBS AI protein, wherein the amino acid sequence of said AI protein is at least 90% (i.e., at least 90, 91, 92, 93, 94, 95, 96, 97, 98, 99 or 100%) homologous to the amino acid sequence of a second GBS AI protein, and wherein said first AI protein and said second AI protein are derived from the genomes of different GBS serotypes. The first GBS AI protein may also be homologous to the amino acid sequence of a third GBS AI protein, such that the first AI protein, the second AI protein and the third AI protein are derived from the genomes of different GBS serotypes. The first AI protein may also be homologous to the amino acid sequence of a fourth GBS AI protein, such that the first AI protein, the second AI protein and the third AI protein are derived from the genomes of different GBS serotypes.

The first AI protein may be selected from an AI-1 protein or an AI-2 protein. For example, the first AI protein may be a GBS AI-1 surface protein such as GBS 80. The amino acid sequence of GBS 80 from GBS serotype V, strain isolate 2603 is greater than 90% homologous to the GBS 80 amino acid sequence from GBS serotype III, strain isolates NEM316 and COH1 and the GBS 80 amino acid sequence from GBS serotype 1a, strain isolate A909.

As another example, the first AI protein may be GBS 104. The amino acid sequence of GBS 104 from GBS serotype V, strain isolate 2603 is greater than 90% homologous to the GBS 104 amino acid sequence from GBS serotype III, strain isolates NEM316 and COH1, the GBS 104 amino acid sequence from GBS serotype 1a, strain isolate A909, and the GBS 104 amino acid sequence serotype II, strain isolate 18RS21.

Table 12 provides the amino acid sequence identity of GBS 80 and GBS 104 across GBS serotypes Ia, Ib, II, III, V, and VIII. The GBS strains in which genes encoding GBS 80 and GBS 104 were identified share, on average, 99.88 and 99.96 amino acid sequence identity, respectively. This high degree of amino acid identity indicates that an immunogenic composition comprising a first protein of GBS 80 or GBS 104 may provide protection across more than one GBS serotype or strain isolate.

TABLE 12

Conservation of GBS 80 and GBS 104 amino acid sequences

| | | GBS 80 | | GBS 104 | |
|---|---|---|---|---|---|
| Serotype | Strains | cGH | % AA identity | cGH | % AA identity |
| Ia | 090 | + | 99.79 | + | 100.00 |
| | A909 | + | 100.00 | + | 100.00 |
| | 515 | − | | − | |
| | DK1 | − | | − | |
| | DK8 | − | | − | |
| | Davis | − | | − | |
| Ib | 7357b | + | 100.00 | + | |
| | H36B | − | | − | |
| II | 18RS21 | − | | + | 100.00 |
| | DK21 | − | | − | |
| III | NEM316 | + | 100.00 | + | 100.00 |
| | COH31 | + | 100.00 | + | |
| | D136 | + | 100.00 | + | |
| | M732 | + | 100.00 | + | 99.88 |
| | COH1 | + | 99.79 | + | 99.88 |
| | M781 | + | 99.79 | + | 99.88 |
| No type | CJB110 | + | 99.37 | + | 100.00 |
| | 1169NT | − | | − | |
| V | CJB111 | + | 100.00 | + | 100.00 |
| | 2603 | + | 100.00 | + | 100.00 |
| VIII | JM130013 | + | 99.79 | + | 100.00 |
| | SMU014 | + | 100.00 | + | |
| total | | 14/22 | 99.88 +/− 0.19 | 15/22 | 99.96 +/− 0.056 |

As another example, the first AI protein may be an AI-2 protein such as GBS 67. The amino acid sequence of GBS 67 from GBS serotype V, strain isolate 2603 is greater than 90% homologous to the GBS 67 amino acid sequence from GBS serotype III, strain isolate NEM316, the GBS 67 amino acid sequence from GBS serotype Ib, strain isolate H36B, and the GBS 67 amino acid sequence from GBS serotype II, strain isolate 17RS21.

As another example, the first AI protein may be an AI-2 protein such as spb1. The amino acid sequence of spb1 from GBS serotype III, strain isolate COH1 is greater than 90% homologous to the spb1 amino acid sequence from GBS serotype Ia, strain isolate A909.

As yet another example, the first AI protein may be an AI-2 protein such as GBS 59. The amino acid sequence of GBS 59 from GBS serotype II, strain isolate 18RS21 is 100% homologous to the GBS 59 amino acid sequence from GBS serotype V, strain isolate 2603. The amino acid sequence of GBS 59 from GBS serotype V, strain isolate CJB111 is 98% homologous to the GBS 59 amino acid sequence from GBS serotype III, strain isolate NEM316.

The compositions of the invention may also be designed to include Gram positive AI proteins from divergent serotypes or strain isolates, i.e., to include a first AI protein which is present in one collection of serotypes or strain isolates of a Gram positive bacteria and a second AI protein which is present in those serotypes or strain isolates not represented by the first AI protein.

For example, the invention may include an immunogenic composition comprising a first and second Gram positive bacteria AI protein, wherein a polynucleotide sequence encoding for the full length sequence of the first AI protein is not present in a similar Gram positive bacterial genome comprising a polynucleotide sequence encoding for the second AI protein.

The compositions of the invention may also be designed to include AI proteins from divergent GBS serotypes or strain isolates, i.e., to include a first AI protein which is present in one collection of GBS serotypes or strain isolates and a second AI protein which is present in those serotypes or strain isolates not represented by the first AI protein.

For example, the invention may include an immunogenic composition comprising a first and second GBS AI protein, wherein a polynucleotide sequence encoding for the full length sequence of the first GBS AI protein is not present in a genome comprising a polynucleotide sequence encoding for the second GBS AI protein. For example, the first AI protein could be GBS 80 (such as the GBS sequence from GBS serotype V, strain isolate 2603). As previously discussed (and depicted in FIG. 2), the sequence for GBS 80 in GBS sertoype II, strain isolate 18RS21 is disrupted. In this instance, the second AI protein could be GBS 104 or GBS 67 (sequences selected from the GBS serotype II, strain isolate 18RS21).

Further, the invention may include an immunogenic composition comprising a first and second GBS AI protein, wherein the first GBS AI protein has detectable surface exposure on a first GBS strain or serotype but not a second GBS strain or serotype and the second GBS AI protein has detectable surface exposure on a second GBS strain or serotype but not a first GBS strain or serotype. For example, the first AI protein could be GBS 80 and the second AI protein could be GBS 67. As seen in Table 15, there are some GBS serotypes and strains that have surface exposed GBS 80 but that do not have surface exposed GBS 67 and vice versa. An immunogenic composition comprising a GBS 80 and a GBS 67 protein may provide protection across a wider group of GBS strains and serotypes.

TABLE 15

| Antigen surface exposure of GBS 80, GBS 322, GBS 104, and GBS 67 | | | | | |
|---|---|---|---|---|---|
| GBS strains | Type | GBS 80 | GBS 322 | GBS 104 | GBS 67 |
| DK1* | Ia | 0 | nd | 237 | 478 |
| DK8* | | 0 | 213 | 151 | 475 |
| Davis* | | 0 | 86 | 271 | 430 |
| 515* | | 0 | 227 | 262 | 409 |
| 090 | | 0 | 0 | 0 | 0 |
| A909 | | 0 | 0 | 0 | 0 |
| 2986 | | 0 | 0 | 157 | 397 |
| 5551 | | 0 | 36 | 384 | 485 |
| 2177 | Ib | 477 | 323 | 328 | 66 |
| H36B* | | 0 | 105 | 518 | 444 |
| 7357b- | | 91 | 102 | 309 | 316 |
| 2129 | | 57 | 71 | 132 | 0 |
| 5518 | | 31 | nd | 60 | 28 |
| COH1 | III | 305 | 130 | 305 | 0 |
| D136C | | 16 | 460 | 226 | 406 |
| COH31 | | 0 | 479 | 71 | 273 |
| M732 | | 105 | 292 | 101 | 0 |
| M781 | | 65 | 224 | 136 | 0 |
| 1998 | | 95 | 288 | 205 | 350 |
| 5376 | | 165 | 76 | 156 | 0 |
| 5435 | | 93 | 88 | 100 | 0 |
| 18RS21 | II | 0 | 471 | 50 | 103 |
| DK21* | | 0 | 342 | 419 | 331 |
| 3050 | | 43 | 188 | 289 | 460 |
| 5401 | | 170 | 135 | 494 | 618 |
| 2141 | | 0 | 76 | 0 | 69 |
| CJB111 | V | 365 | 58 | 355 | 481 |
| 2603 | | 62 | 293 | 100 | 105 |
| 5364 | | 454 | 463 | 379 | 394 |
| 2110 | | 0 | 11 | 345 | 589 |
| 2274 | IV | 113 | 161 | 465 | 484 |
| 1999 | | 0 | 55 | 492 | 453 |
| 2210 | | 0 | 0 | 363 | 574 |
| 2928 | VII | 0 | 0 | 0 | 0 |
| SMU071 | VIII | 556 | 170 | 393 | 79 |
| JM9130013 | | 587 | 133 | 436 | 83 |
| 2189 | | 0 | 0 | 0 | 0 |
| 5408 | | 0 | 0 | 159 | 433 |
| CJB110 | NT | 71 | 587 | 169 | 245 |
| 1169* | | 0 | 213 | 371 | 443 |
| Δ Mean > 100 | | 9/40<br>22% | 22/38<br>58% | 32/40<br>80% | 25/40<br>62% |

Alternatively, the invention may include an immunogenic composition comprising a first and second Gram positive bacteria AI protein, wherein the polynucleotide sequence encoding the sequence of the first AI protein is less than 90% (i.e., less than 90, 88, 86, 84, 82, 80, 78, 76, 74, 72, 70, 65, 60, 55, 50, 45, 40, 35 or 30 percent) homologous than the corresponding sequence in the genome of the second AI protein.

The invention may include an immunogenic composition comprising a first and second GBS AI protein, wherein the polynucleotide sequence encoding the sequence of the first GBS AI protein is less than 90% (i.e., less than 90, 88, 86, 84, 82, 80, 78, 76, 74, 72, 70, 65, 60, 55, 50, 45, 40, 35 or 30 percent) homologous than the corresponding sequence in the genome of the second GBS AI protein. For example, the first GBS AI protein could be GBS 67 (such as the GBS sequence from GBS serotype 1b, strain isolate H36B). As shown in FIGS. 2 and 4, the GBS sequence for this strain is less than 90% homologous (87%) to the corresponding GBS sequence in GBS serotype V, strain isolate 2603. In this instance, the second GBS AI protein could then be the GBS sequence from GBS serotype V, strain isolate 2603.

An example immunogenic composition of the invention may comprise adhesin island proteins GBS 80, GBS 104, GBS 67, and GBS 59, and non-AI protein GBS 322. FACS analysis of different GBS strains demonstrates that at least one of these five proteins is always found to be expressed on the surface of GBS bacteria. An initial FACS analysis of 70 strains of GBS bacteria, obtained from the CDC in the United States (33 strains), ISS in Italy (17 strains), and Houston/Harvard (20 strains), detected surface exposure of at least one of GBS 80, GBS 104, GBS 322, GBS 67, or GBS 59 on the surface of the GBS bacteria. FIG. 227 provides the FACS data obtained for surface exposure of GBS 80, GBS 104, GBS 67, GBS 322, and GBS 59 on each of 37 GBS strains. FIG. 228 provides the FACS data obtained for surface exposure of GBS 80, GBS 104, GBS 67, GBS 322, and GBS 59 on each of 41 GBS strains obtained from the CDC. As can be seen from FIGS. 227 and 228, each GBS strain had surface expression of at least one of GBS 80, GBS 104, GBS 67, GBS 322, and GBS 59. The surface exposure of at least one of these proteins on each bacterial strain indicates that an immunogenic composition comprising these proteins will provide wide protection across GBS strains and serotypes.

The surface exposed GBS 80, GBS 104, GBS 67, GBS 322, and GBS 59 proteins are also present at high levels as determined by FACs. Table 49 summarizes the FACS results for the initial 70 GBS strains examined for GBS 80, GBS 104, GBS 67, GBS 322, and GBS 59 surface expression. A protein was designated as having high levels of surface expression of a protein if a five-fold shift in fluorescence was observed when using antibodies for the protein relative to preimmune control serum.

TABLE 49

| Exposure Levels of GBS 80, GBS 104, GBS 67, GBS 322, and GBS 59 on GBS Strains | | | | | |
|---|---|---|---|---|---|
| 5-fold shift in fluorescence by FACS | GBS 80<br>17/70<br>24% | GBS 104<br>14/70<br>20% | GBS 67<br>49/70<br>70% | GBS 59<br>46/70<br>66% | GBS 322<br>33/70<br>47% |

Table 50 details which of the surface proteins is highly expressed on the different GBS serotype.

TABLE 50

| High Levels of Surface Protein Expression on GBS Serotypes | | | | | |
|---|---|---|---|---|---|
| | 5-fold shift in fluorescence by FACS | | | | |
| | GBS 80 | GBS 104 | GBS 67 | GBS 59 | GBS 322 |
| Ia + Ib + III | 4/36 | 2/36 | 22/36 | 20/36 | 18/36 |
| II + V | 11/25 | 9/25 | 21/25 | 21/25 | 13/25 |
| Others | 2/9 | 3/9 | 6/9 | 5/9 | 2/9 |

Alternatively, the immunogenic composition of the invention may include GBS 80, GBS 104, GBS 67, and GBS 322. Assuming that protein antigens that are highly accessible to antibodies confer 100% protection with suitable adjuvants, an immunogenic composition containing GBS 80, GBS 104, GBS 67, GBS 59 and GBS 322 will provide protection for 89% of GBS strains and serotypes, the same percentage as an immunogenic composition containing GBS 80, GBS 104, GBS 67, and GBS 322 proteins. See FIG. 229. However, it may be preferable to include GBS 59 in the composition to increase its immunogenic strength. As seen from Table 50, GBS 59 is highly expressed on the surface two-thirds of GBS bacteria examined by FACS analysis, unlike GBS 80, GBS 104, and GBS 322, which are highly expressed in less than half of GBS bacteria examined GBS 59 opsonophagocytic activity is also comparable to that of a mix of GBS 322, GBS 104, GBS 67, and GBS 80 proteins. See FIG. 230.

By way of another example, preferably, the GAS AI proteins included in the immunogenic compositions of the invention can provide protection across more than one GAS serotype or strain isolate. For example, the immunogenic composition may comprise a first GAS AI protein, wherein the amino acid sequence of said AI protein is at least 90% (i.e., at least 90, 91, 92, 93, 94, 95, 96, 97, 98, 99 or 100%) homologous to the amino acid sequence of a second GAS AI protein, and wherein said first AI protein and said second AI protein are derived from the genomes of different GAS serotypes. The first GAS AI protein may also be homologous to the amino acid sequence of a third GAS AI protein, such that the first AI protein, the second AI protein and the third AI protein are derived from the genomes of different GAS serotypes. The first AI protein may also be homologous to the amino acid sequence of a fourth GAS AI protein, such that the first AI protein, the second AI protein and the third AI protein are derived from the genomes of different GAS serotypes.

The compositions of the invention may also be designed to include GAS AI proteins from divergent serotypes or strain isolates, i.e., to include a first AI protein which is present in one collection of serotypes or strain isolates of a GAS bacteria and a second AI protein which is present in those serotypes or strain isolates not represented by the first AI protein.

For example, the first AI protein could be a prtF2 protein (such as the 19224141 protein from GAS serotype M12, strain isolate A735). As previously discussed (and depicted in FIG. 164), the sequence for a prtF2 protein is not present in GAS AI types 1 or 2. In this instance, the second AI protein could be collagen binding protein M6_Spy0159 (from M6 isolate (MGAS10394), which comprises an AI-1) or GAS15 (from M1 isolate (SF370), which comprises an AI-2).

Further, the invention may include an immunogenic composition comprising a first and second GAS AI protein, wherein the first GAS AI protein has detectable surface exposure on a first GAS strain or serotype but not a second GAS strain or serotype and the second GAS AI protein has detectable surface exposure on a second GAS strain or serotype but not a first GAS strain or serotype.

The invention may include an immunogenic composition comprising a first and second GAS AI protein, wherein the polynucleotide sequence encoding the sequence of the first GAS AI protein is less than 90% (i.e., less than 90, 88, 86, 84, 82, 80, 78, 76, 74, 72, 70, 65, 60, 55, 50, 45, 40, 35 or 30 percent) homologous than the corresponding sequence in the genome of the second GAS AI protein. Preferably the first and second GAS AI proteins are subunits of the pilus. More preferably the first and second GAS AI proteins are selected from the major pilus forming proteins (i.e., M6_Spy0160 from M6 strain 10394, SPy0128 from M1 strain SF370, SpyM3__0100 from M3 strain 315, SPs0102 from M3 strain SSI, orf80 from M5 isolate Manfredo, spyM18__0128 from M18 strain 8232, SpyoM01000153 from M49 strain 591, 19224137 from M12 strain A735, fimbrial structural subunit from M77 strain ISS4959, fimbrial structural subunit from M44 strain ISS3776, fimbrial structural subunit from M50 strain ISS3776 ISS 4538, fimbrial structural subunit from M12 strain CDC SS635, fimbrial structural subunit from M23 strain DSM2071, fimbrial structural subunit from M6 strain CDC SS410). Table 45 provides the percent identity between the amino acidic sequences of each of the main pilus forming subunits from GAS AI-1, AI-2, AI-3, and AI-4 representative strains (i.e., M6_Spy0160 from M6 strain 10394, SPy0128 from M1 strain SF370, SpyM3__0100 from M3 strain 315, SPs0102 from M3 strain SSI, orf80 from M5 isolate Manfredo, spyM18__0128 from M18 strain 8232, SpyoM01000153 from M49 strain 591, 19224137 from M12 strain A735, Fimbrial structural subunit from M77 strain ISS4959, fimbrial structural subunit from M44 strain ISS3776, fimbrial structural subunit from M50 strain ISS3776 ISS 4538, fimbrial structural subunit from M12 strain CDC SS635, fimbrial structural subunit from M23 strain DSM2071, fimbrial structural subunit from M6 strain CDC SS410).

TABLE 45

Comparison of Amino Acid Sequences of Major Pilus Proteins in the Four GAS AIs

| | | AI-1 | AI-2 | AI-3 | | | AI-4 |
|---|---|---|---|---|---|---|---|
| | | M6-10394 | M1-370 | M3-315 | M5-Manfredo | M18-8232 | M12-A735 |
| AI-1 | M6-10394 | 100% M6-10394 M6-SS-410 56% M23-DSM2071 | 23% | 25% | 23% | 24% | 26% |
| AI-2 | M1-370 | 23% | 100% | 40% | 41% | 38% | 40% |
| AI-3 | M3-315 | 25% | 40% | 100% M3-315 M3-SSI-1 | 64% | 67% | 61% |
| | M5-Manfredo | 23% | 39% | 64% | 100% M5-Manfredo M44-3776 M77-4959 | 60% | 65% |
| | M18-8232 | 24% | 38% | 67% | 60% | 90% M18-8232 M49-591 | 62% |
| AI-4 | M12-A735 | 26% | 40% | 61% | 65% | 62% | 97-100% M12-A735 M12-SS-635 M50-4538 |

For example, the first main pilus subunit may be selected from bacteria of GAS serotype M6 strain 10394 and the second main pilus subunit may be selected from bacteria of GAS serotype M1 strain 370. As can be seen from Table 45, the main pilus subunits encoded by these strains of bacteria share only 23% nucleotide identity. An immunogenic composition comprising pilus main subunits from each of these strains of bacteria is expected to provide protection across a wider group of GAS strains and serotypes. Other examples of main pilus subunits that can be used in combination to provide increased protection across a wider range of GAS strains and serotypes include proteins encoded by GAS serotype M5 Manfredo isolate and serotype M6 strain 10394, which share 23% sequence identity, GAS serotype M18 strain 8232 and serotype M1 strain 370, which share 38% sequence identity, GAS serotype M3 strain 315 and serotype M12 strain A735, which share 61% sequence identity, and GAS serotype M3 strain 315 and serotype M6 strain 10394 which share 25% sequence identity.

As also can be seen from Table 45, the amino acid sequences of the four types of main pilus subunits present in GAS are relatively divergent. FIGS. 198-201 provide further tables comparing the percent identity of adhesin island-encoded surface exposed proteins for different GAS serotypes relative to other GAS serotypes harbouring an adhesin island of the same or a different subtype (GAS AI-1, GAS AI-2, GAS AI-3, and GAS AI-4). See also further discussion below.

Immunizations with the Adhesin Island proteins of the invention are discussed further in the Examples.

Co-Expression of GBS Adhesin Island Proteins and Role of GBS AI Proteins in Surface Presentation In addition to the use of the GBS adhesin island proteins for cross strain and cross serotype protection, Applicants have identified interactions between adhesin island proteins which appear to affect the delivery or presentation of the surface proteins on the surface of the bacteria.

In particular, Applicants have discovered that surface exposure of GBS 104 is dependent on the concurrent expression of GBS 80. As discussed further in Example 2, reverse transcriptase PCR analysis of AI-1 shows that all of the AI genes are co-transcribed as an operon. Applicants constructed a series of mutant GBS containing in frame deletions of various AI-1 genes. (A schematic of the GBS mutants is presented in FIG. 7). FACS analysis of the various mutants comparing mean shift values using anti-GBS 80 versus anti-GBS 104 antibodies is presented in FIG. 8. Removal of the GBS 80 operon prevented surface exposure of GBS 104; removal of the GBS 104 operon did not affect surface exposure of GBS 80. While not being limited to a specific theory, it is thought that GBS 80 is involved in the transport or localization of GBS 104 to the surface of the bacteria. The two proteins may be oligomerized or otherwise associated. It is possible that this association involves a conformational change in GBS 104 that facilitates its transition to the surface of the GBS bacteria.

Figure 68:
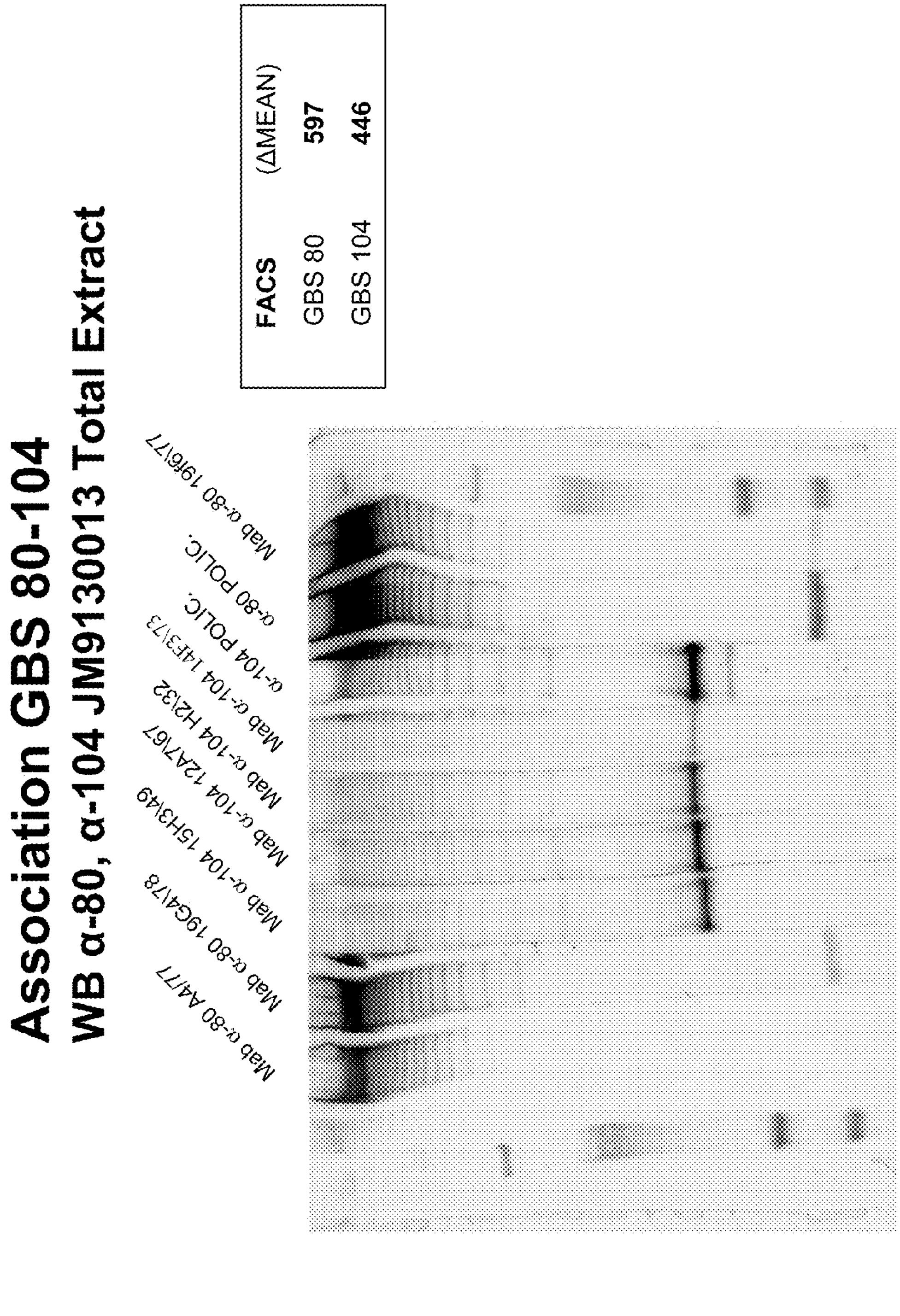
FIG. 68: Western blotting of GBS strain JM9130013 total extracts.

Pili structures that comprise GBS 104 appear to be of a lower molecular weight than pili structures lacking GBS 104. FIG. 68 shows that polyclonal anti-GBS 104 antibodies (see lane marked α-104 POLIC.) cross-hybridize with smaller structures than do polyclonal anti-GBS 80 antibodies (see lane marked α-GBS 80 POLIC.).

In addition, Applicants have shown that removal of GBS 80 can cause attenuation, further suggesting the protein contributes to virulence. As described in more detail in Example 3, the $LD_{50}$s for the Δ80 mutant and the Δ80, Δ104 double mutant were reduced by an order of magnitude compared to wildtype and Δ104 mutant.

The sortases within the adhesin island also appear to play a role in localization and presentation of the surface proteins. As discussed further in Example 4, FACS analysis of various sortase deletion mutants showed that removal of sortase SAG0648 prevented GBS 104 from reaching the surface and slightly reduced the surface exposure of GBS 80. When sortase SAG0647 and sortase SAG0648 were both knocked out, neither GBS 80 nor GBS 104 were surface exposed. Expression of either sortase alone was sufficient for GBS 80 to arrive at the bacterial surface. Expression of SAG0648, however, was required for GBS 104 surface localization.

Accordingly, the compositions of the invention may include two or more AI proteins, wherein the AI proteins are physically or chemically associated. For example, the two AI proteins may form an oligomer. In one embodiment, the associated proteins are two AI surface proteins, such as GBS 80 and GBS 104. The associated proteins may be AI surface proteins from different adhesin islands, including host cell adhesin island proteins if the AI surface proteins are expressed in a recombinant system. For example, the associated proteins may be GBS 80 and GBS 67.

Adhesin Island Proteins from Other Gram Positive Bacteria

Applicants' identification and analysis of the GBS adhesin islands and the immunological and biological functions of these AI proteins and their pilus structures provides insight into similar structures in other Gram positive bacteria.

As discussed above, "Adhesin Island" or "AI" refers to a series of open reading frames within a bacterial genome that encode for a collection of surface proteins and sortases. An Adhesin Island may encode for amino acid sequences comprising at least one surface protein. The Adhesin Island may encode at least one surface protein. Alternatively, an Adhesin Island may encode for at least two surface proteins and at least one sortase. Preferably, an Adhesin Island encodes for at least three surface proteins and at least two sortases. One or more of the surface proteins may include an LPXTG motif (such as LPXTG (SEQ ID NO:122)) or other sortase substrate motif. One or more AI surface proteins may participate in the formation of a pilus structure on the surface of the Gram positive bacteria.

Gram positive adhesin islands of the invention preferably include a divergently transcribed transcriptional regulator. The transcriptional regulator may regulate the expression of the AI operon.

The invention includes a composition comprising one or more Gram positive bacteria AI surface proteins. Such AI surface proteins may be associated in an oligomeric or hyperoligomeric structure.

Preferred Gram positive adhesin island proteins for use in the invention may be derived from *Staphylococcus* (such as *S. aureus*), *Streptococcus* (such as *S. agalactiae* (GBS), *S. pyogenes* (GAS), *S. pneumoniae, S. mutans*), *Enterococcus* (such as *E. faecalis* and *E. faecium*), *Clostridium* (such as *C. difficile*), *Listeria* (such as *L. monocytogenes*) and *Corynebacterium* (such as *C. diphtheria*).

One or more of the Gram positive AI surface protein sequences typically include an LPXTG motif or other sortase substrate motif. Gram positive AI surface proteins of the invention may affect the ability of the Gram positive bacteria to adhere to and invade epithelial cells. AI surface proteins may also affect the ability of Gram positive bacteria to translocate through an epithelial cell layer. Preferably, one or more AI surface proteins are capable of binding to or otherwise associating with an epithelial cell surface. Gram positive AI surface proteins may also be able to bind to or associate with fibrinogen, fibronectin, or collagen.

Gram positive AI sortase proteins are predicted to be involved in the secretion and anchoring of the LPXTG containing surface proteins. A Gram positive bacteria AI may encode for at least one surface exposed protein. The Adhesin Island may encode at least one surface protein. Alternatively, a Gram positive bacteria AI may encode for at least two surface exposed proteins and at least one sortase. Preferably, a Gram positive AI encodes for at least three surface exposed proteins and at least two sortases.

Gram positive AI surface proteins may be covalently attached to the bacterial cell wall by membrane-associated transpeptidases, such as an AI sortase. The sortase may function to cleave the surface protein, preferably between the threonine and glycine residues of an LPXTG motif. The sortase may then assist in the formation of an amide link between the threonine carboxyl group and a cell wall precursor such as lipid II. The precursor can then be incorporated into the peptidoglycan via the transglycoslylation and transpeptidation reactions of bacterial wall synthesis. See Comfort et al., Infection & Immunity (2004) 72 (5): 2710-2722. Typically, Gram positive bacteria AI surface proteins of the invention will contain an N-terminal leader or secretion signal to facilitate translocation of the surface protein across the bacterial membrane.

Gram positive bacteria AI surface proteins of the invention may affect the ability of the Gram positive bacteria to adhere to and invade target host cells, such as epithelial cells. Gram positive bacteria AI surface proteins may also affect the ability of the gram positive bacteria to translocate through an epithelial cell layer. Preferably, one or more of the Gram positive AI surface proteins are capable of binding to or other associating with an epithelial cell surface. Further, one or more Gram positive AI surface proteins may bind to fibrinogen, fibronectin, or collagen protein.

In one embodiment, the invention includes a composition comprising oligomeric, pilus-like structures comprising a Gram positive bacteria AI surface protein. The oligomeric, pilus-like structure may comprise numerous units of the AI surface protein. Preferably, the oligomeric, pilus-like structures comprise two or more AI surface proteins. Still more preferably, the oligomeric, pilus-like structure comprises a hyper-oligomeric pilus-like structure comprising at least two (e.g., 2, 3, 4, 5, 6, 7, 8, 9, 10, 11, 12, 13, 14, 15, 20, 25, 30, 35, 40, 45, 50, 60, 70, 80, 90, 100, 120, 140, 150, 200 or more) oligomeric subunits, wherein each subunit comprises an AI surface protein or a fragment thereof. The oligomeric subunits may be covalently associated via a conserved lysine within a pilin motif. The oligomeric subunits may be covalently associated via an LPXTG motif, preferably, via the threonine amino acid residue.

Gram positive bacteria AI surface proteins or fragments thereof to be incorporated into the oligomeric, pilus-like structures of the invention will preferably include one or both of a pilin motif comprising a conserved lysine residue and an E box motif comprising a conserved glutamic acid residue.

The oligomeric, pilus like structures may be used alone or in the combinations of the invention. In one embodiment, the invention comprises a Gram positive bacteria Adhesin Island in oligomeric form, preferably in a hyperoligomeric form.

The oligomeric, pilus-like structures of the invention may be combined with one or more additional Gram positive AI proteins (from the same or a different Gram positive species or genus). In one embodiment, the oligomeric, pilus-like structures comprise one or more Gram positive bacteria AI surface proteins in combination with a second Gram positive bacteria protein. The second Gram positive bacteria protein may be a known antigen, and need not normally be associated with an AI protein.

The oligomeric, pilus-like structures may be isolated or purified from bacterial cultures overexpressing a Gram positive bacteria AI surface protein. The invention therefore includes a method for manufacturing an oligomeric Adhesin Island surface antigen comprising culturing a Gram positive bacteria adapted for increased AI protein expression and isolation of the expressed oligomeric Adhesin Island protein from the Gram positive bacteria. The AI protein may be collected from secretions into the supernatant or it may be purified from the bacterial surface. The method may further comprise purification of the expressed Adhesin Island protein. Preferably, the Adhesin Island protein is in a hyperoligomeric form.

Gram positive bacteria are preferably adapted to increase AI protein expression by at least two (e.g., 2, 3, 4, 5, 8, 10, 15, 20, 25, 30, 35, 40, 45, 50, 60, 70, 80, 90, 100, 125, 150 or 200) times wild type expression levels.

Gram positive bacteria may be adapted to increase AI protein expression by means known in the art, including methods of increasing gene dosage and methods of gene upregulation. Such means include, for example, transformation of the Gram positive bacteria with a plasmid encoding the AI protein. The plasmid may include a strong promoter or it may include multiple copies of the sequence encoding the AI protein. Optionally, the sequence encoding the AI protein within the Gram positive bacterial genome may be deleted. Alternatively, or in addition, the promoter regulating the Gram positive Adhesin Island may be modified to increase expression.

The invention further includes Gram positive bacteria which have been adapted to produce increased levels of AI surface protein. In particular, the invention includes Gram positive bacteria which have been adapted to produce oligomeric or hyperoligomeric AI surface protein. In one embodiment, the Gram positive bacteria of the invention are inactivated or attenuated to permit in vivo delivery of the whole bacteria, with the AI surface protein exposed on its surface.

The invention further includes Gram positive bacteria which have been adapted to have increased levels of expressed AI protein incorporated in pili on their surface. The Gram positive bacteria may be adapted to have increased exposure of oligomeric or hyperoligomeric AI proteins on its surface by increasing expression levels of a signal peptidase polypeptide. Increased levels of a local signal peptidase expression in Gram positive bacteria (such us LepA in GAS) are expected to result in increased exposure of pili proteins on the surface of Gram positive bacteria. Increased expression of a leader peptidase in Gram positive may be achieved by any means known in the art, such as increasing gene dosage and methods of gene upregulation. The Gram positive bacteria adapted to have increased levels of leader peptidase may additionally be adapted to express increased levels of at least one pili protein.

Alternatively, the AI proteins of the invention may be expressed on the surface of a non-pathogenic Gram positive bacteria, such as *Streptococcus gordonii* (See, e.g., Byrd et al., "Biological consequences of antigen and cytokine co-expression by recombinant *Streptococcus gordonii* vaccine vectors", Vaccine (2002) 20:2197-2205) or *Lactococcus* lactis (See, e.g., Mannam et al., "Mucosal VaccineMade from Live, Recombinant *Lactococcus* lactis Protects Mice against Pharangeal Infection with *Streptococcus pyogenes*" Infection and Immunity (2004) 72 (6):3444-3450). It has already been demonstrated, above, that *L. lactis* expresses GBS and GAS AI polypeptides in oligomeric form and on its surface.

Alternatively, the oligomeric, pilus-like structures may be produced recombinantly. If produced in a recombinant host cell system, the Gram positive bacteria AI surface protein will preferably be expressed in coordination with the expression of one or more of the AI sortases of the invention. Such AI sortases will facilitate oligomeric or hyperoligomeric formation of the AI surface protein subunits.

Gram positive AI Sortases of the invention will typically have a signal peptide sequence within the first 70 amino acid residues. They may also include a transmembrane sequence within 50 amino acid residues of the C terminus. The sortases may also include at least one basic amino acid residue within the last 8 amino acids. Preferably, the sortases have one or more active site residues, such as a catalytic cysteine and histidine.

Adhesin island surface proteins from two or more Gram positive bacterial genus or species may be combined to provide an immunogenic composition for prophylactic or therapeutic treatment of disease or infection of two more Gram positive bacterial genus or species. Optionally, the adhesin island surface proteins may be associated together in an oligomeric or hyperoligomeric structure.

In one embodiment, the invention comprises an adhesin island surface proteins from two or more *Streptococcus* species. For example, the invention includes a composition comprising a GBS AI surface protein and a GAS adhesin island surface protein. As another example, the invention includes a composition comprising a GAS adhesin island surface protein and a *S. pneumoniae* adhesin island surface protein.

In one embodiment, the invention comprises an adhesin island surface protein from two or more Gram positive bacterial genus. For example, the invention includes a composition comprising a *Streptococcus* adhesin island protein and a *Corynebacterium* adhesin island protein.

Examples of AI sequences in several Gram positive bacteria are discussed further below.

*Streptococcus pyogenes* (GAS)

As discussed above, Applicants have identified at least four different GAS Adhesin Islands. These adhesion islands are thought to encode surface proteins which are important in the bacteria's virulence, and Applicants have obtained the first electron micrographs revealing the presence of these adhesin island proteins in hyperoligomeric pilus structures on the surface of Group A *Streptococcus*.

Group A *Streptococcus* is a human specific pathogen which causes a wide variety of diseases ranging from pharyngitis and impetigo through life threatening invasive disease and necrotizing fasciitis. In addition, post-streptococcal autoimmune responses are still a major cause of cardiac pathology in children.

Group A Streptococcal infection of its human host can generally occur in three phases. The first phase involves attachment and/or invasion of the bacteria into host tissue and multiplication of the bacteria within the extracellular spaces. Generally this attachment phase begins in the throat or the skin. The deeper the tissue level infected, the more severe the damage that can be caused. In the second stage of infection, the bacteria secrete a soluble toxin that diffuses into the surrounding tissue or even systemically through the vasculature. This toxin binds to susceptible host cell receptors and triggers inappropriate immune responses by these host cells, resulting in pathology. Because the toxin can diffuse throughout the host, the necrosis directly caused by the GAS toxins may be physically located in sites distant from the bacterial infection. The final phase of GAS infection can occur long after the original bacteria have been cleared from the host system. At this stage, the host's previous immune response to the GAS bacteria due to cross reactivity between epitopes of a GAS surface protein, M, and host tissues, such as the heart. A general review of GAS infection can be found in Principles of Bacterial Pathogeneis, Groisman ed., Chapter 15 (2001).

In order to prevent the pathogenic effects associated with the later stages of GAS infection, an effective vaccine against GAS will preferably facilitate host elimination of the bacteria during the initial attachment and invasion stage.

Isolates of Group A *Streptococcus* are historically classified according to the M surface protein described above. The M protein is surface exposed trypsin-sensitive protein generally comprising two polypeptide chains complexed in an alpha helical formation. The carboxyl terminus is anchored in the cytoplasmic membrane and is highly conserved among all group A streptococci. The amino terminus, which extends through the cell wall to the cell surface, is responsible for the antigenic variability observed among the 80 or more serotypes of M proteins.

A second layer of classification is based on a variable, trypsin-resistant surface antigen, commonly referred to as the T-antigen. Decades of epidemiology based on M and T serological typing have been central to studies on the biological diversity and disease causing potential of Group A Streptococci. While the M-protein component and its inherent variability have been extensively characterized, even after five decades of study, there is still very little known about the structure and variability of T-antigens. Antisera to define T types are commercially available from several sources, including Sevapharma (http://www.sevapharma.cz/en).

The gene coding for one form of T-antigen, T-type 6, from an M6 strain of GAS (D741) has been cloned and characterized and maps to an approximately 11 kb highly variable pathogenicity island. Schneewind et al., J. Bacteriol. (1990) 172 (6):3310-3317. This island is known as the Fibronectin-binding, Collagen-binding T-antigen (FCT) region because it contains, in addition to the T6 coding gene (tee6), members of a family of genes coding for Extra Cellular Matrix (ECM) binding proteins. Bessen et al., Infection & Immunity (2002) 70 (3):1159-1167. Several of the protein products of this gene family have been shown to directly bind either fibronectin and/or collagen. See Hanski et al., Infection & Immunity (1992) 60 (12):5119-5125; Talay et al., Infection & Immunity (1992 (60 (9):3837-3844; Jaffe et al. (1996) 21 (2):373-384; Rocha et al., Adv Exp Med. Biol. (1997) 418:737-739; Kreikemeyer et al., J Biol Chem (2004) 279 (16):15850-15859; Podbielski et al., Mol. Microbiol. (1999) 31 (4):1051-64; and Kreikemeyer et al., Int. J. Med Microbiol (2004) 294 (2-3):177-88. In some cases direct evidence for a role of these proteins in adhesion and invasion has been obtained.

Applicants raised antiserum against a recombinant product of the tee6 gene and used it to explore the expression of T6 in M6 strain ISS3650. In immunoblot of mutanolysin extracts of this strain, the antiserum recognized, in addition to a band corresponding to the predicted molecular mass of the tee6 gene product, very high molecular weight ladders ranging in mobility from about 100 kDa to beyond the resolution of the 3-8% gradient gels used. See FIG. 163A, last lane labeled "M6 Tee6."

This pattern of high molecular weight products is similar to that observed in immunoblots of the protein components of the pili identified in *Streptococcus agalactiae* (described above) and previously in *Corynebacterium diphtheriae*. Electron microscopy of strain M6 ISS3650 with antisera specific for the product of tee6 revealed abundant surface staining and long pilus like structures extending up to 700 nanometers from the bacterial surface, revealing that the T6 protein, one of the antigens recognized in the original Lancefield serotyping system, is located within a GAS Adhesin Island (GAS AI-1) and forms long covalently linked pilus structures. See FIG. 163I.

In addition to the tee6 gene, the FCT region in M6_ISS3650 (GAS AI-1) contains two other genes (prtF1 and cpa) predicted to code for surface exposed proteins; these proteins are characterized as containing the cell wall attachment motif LPXTG. Western blot analysis using antiserum specific for PrtF1 detected a single molecular species with electrophoretic mobility corresponding to the predicted molecular mass of the protein and one smaller band of unknown origin. Western blot analysis using antisera specific for Cpa recognized a high molecular weight covalently linked ladder (FIG. 163A, second lane). Immunogold labeling of Cpa with specific antiserum followed by transmission electron microscopy detected an abundance of Cpa at the cell surface and only occasional structures extending from the cell surface (FIG. 163J).

Four classes of FCT region can be discerned by the types and order of the genes contained within the region. The FCT region of strains of types M3, M5, M18 and M49 have a similar organization whereas those of M6, M1 and M12 differ. See FIG. 164. As discussed below, these four FCT regions correlate to four GAS Adhesin Island types (AI-1, AI-2, AI-3 and AI-4).

Applicants discovery of genes coding for pili in the FCT region of strain M6_ISS3650 prompted them to examine the predicted surface exposed proteins in the variant FCT regions of three other GAS strains of having different M-type (M1_SF370, M5_ISS4883 and M12_20010296) representing the other three FCT variants. Each gene present in the FCT region of each bacteria was cloned and expressed. Antisera specific for each recombinant protein was then used to probe mutanolysin extracts of the respective strains (6). In M1 strain SF370, there are three predicted surface proteins (Cpa (also referred to as M1__126 and GAS 15), M1__128 (a fimbrial protein also referred to as Spy0128 and GAS 16), and M1__130 (also referred to as Spy0130 and GAS 18)) (GAS AI-2). Antisera specific for each surface protein reacted with a ladder of high molecular weight material (FIG. 163B). Immunogold staining of M1 strain SF370 with antiserum specific for M1__128 revealed pili structures similar to those seen when M6 strain ISS3650 was immunogold stained with antiserum specific for tee6 (See FIG. 1163K). Antisera specific for surface proteins Cpa and M1__130 revealed abundant surface staining and occasional structures extending from the surface of M1 strain SF370 bacteria (FIG. 163S).

The M1__128 protein appears to be necessary for polymerization of Cpa and M1__130 proteins. If the M1__128 gene in M1_SF370 was deleted, Western blot analysis using antibodies that hybridize to Cpa and M1__130 no longer detected high molecular weight ladders comprising the Cpa and M1__130 proteins (FIG. 163 E). See also FIGS. 177 A-C which provide the results of Western blot analysis of the M1__128 (Δ128) deleted bacteria using anti-M1__130 antiserum (FIG. 177 A), anti-M1__128 antiserum (FIG. 177 B), and anti-M1__126 antiserum (FIG. 177 C). High molecular weight ladders, indicative of pilus formation on the surface of M1 strain SF370, could not be detected by any of the three antisera in Δ128 bacteria. If the Δ128 bacteria were transformed with a plasmid containing the gene for M1__128, Western blot analysis using antisera specific for Cpa and M1__130 again detected high molecular weight ladders (FIG. 163 H).

Figure 178:
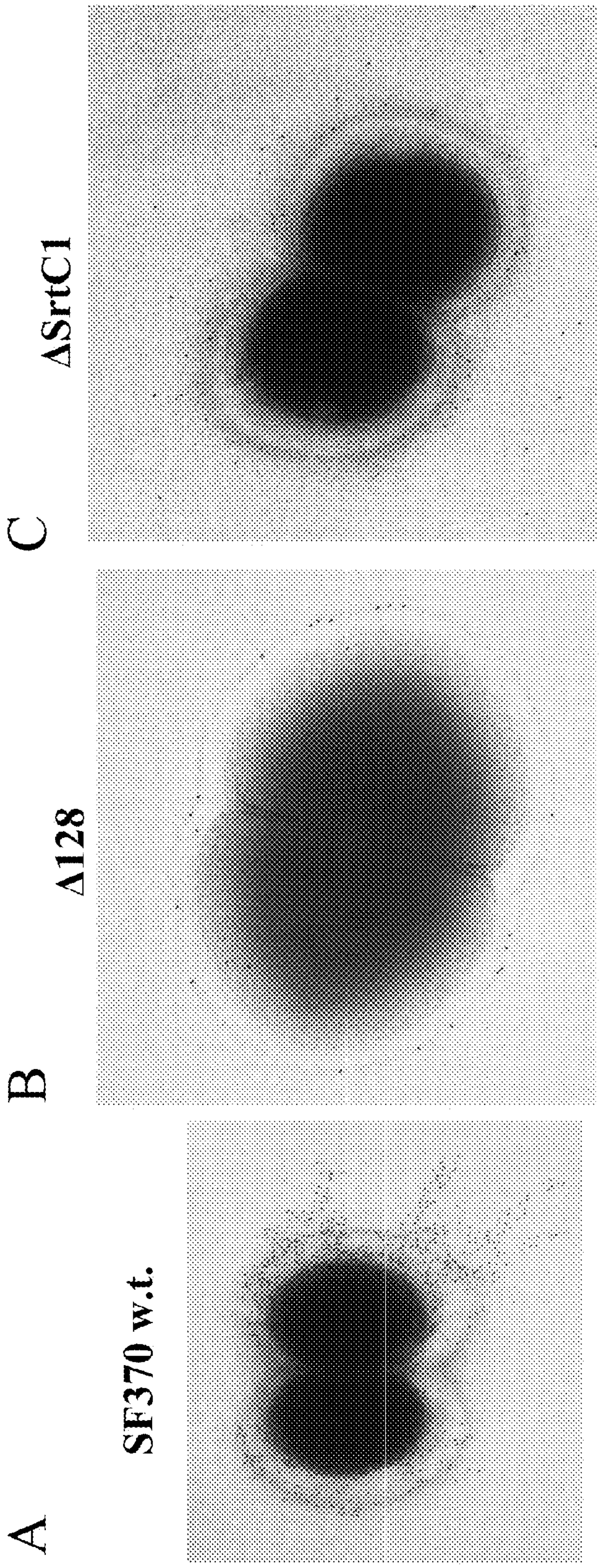
Figure 179:
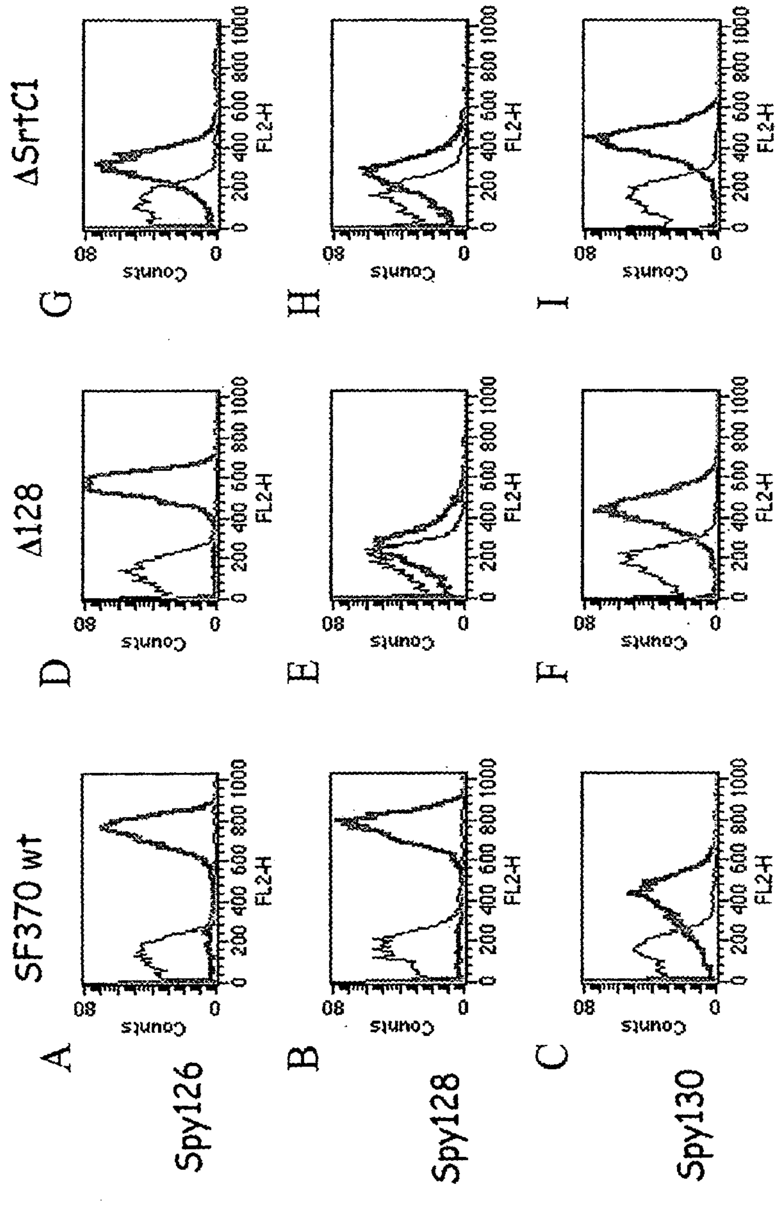

In agreement with the Western blot analysis, immunoelectron microscopy failed to detect pilus assembly on the Δ128 strain SF370 bacteria using M1__128 antisera (FIG. 178 B). Although Δ128 SF370 bacteria were unable to form pili, M1__126 (cpa) and M1__130, which contain sortase substrate motifs, were present on the bacteria's surface. FACS analysis of the M1__128 deleted (Δ128) strain SF370 bacteria also detected both M1__126 and M1__130 on the surface of the Δ128 strain SF370 bacteria. See FIGS. 179 D and F, which show a shift in fluorescence when antibodies immunoreactive to M1__126 and M1__130 are used on Δ128 bacteria. As expected, virtually no shift in fluorescence is observed when antibodies immunoreactive to M1__128 are used with the Δ128 bacteria (FIG. 179 E).

By contrast, deletion of the M1__130 gene did not effect polymerization of M1__128 (FIG. 163 F). See also FIGS. 177 A-C, which provide Western blot analysis results of the M1__130 deleted (Δ130) strain SF370 bacteria using anti-M1__130 (FIG. 177 A), anti-M1__128 (FIG. 177 B), and anti-M1__126 antiserum (FIG. 177 C). The anti-M1__128 and anti-M1__126 antiserum both detected the presence of high molecular weight ladders in the A130 strain SF370 bacteria, indicating that the A130 bacteria form pili that comprise M1__126 and M1__128 polypeptides in the absence of M1__130. As expected, the Western blot probed with antiserum immunoreactive with M1__130 did not detect any proteins for the Δ130 bacteria (FIG. 177A).

Hence, the composition of the pili in GAS resembles that previously described for both *C. diphtheria* (7, 8) and *S. agalactiae* (described above) (9) in that each pilus is formed by a backbone component which abundantly stains the pili in EM and is essential for the incorporation of the other components.

Also similar to *C. diphtheria*, elimination of the srtC1 gene from the FCT region of M1_SF370 abolished polymerization of all three proteins and assembly of pili (FIG. 163 G). See also FIGS. 177 A-C, which provide Western blot analysis of the SrtC1 deleted (ΔsrtC1) strain SF370 bacteria using anti-M1__130 (FIG. 177 A), anti-M1__128 (FIG. 177 B), and anti-M1__126 antiserum (FIG. 177 C). None of the three antisera immunoreacted with high molecular weight structures (pili) in the ΔSrtC1 bacteria. Confirming that deletion of the SrtC1 gene abrogates pilus assembly in strain SF370, immunoelectron microscopy using antisera against M1__128 failed to detect pilus formation on the bacteria surface. See FIG. 178 C. Although no assembled pili were detected on ΔSrtC1 SF370, M1__128 proteins could be detected on the surface of SF370. Thus, it appeared that SrtC1 deletion prevented pilus assembly on the surface of the SF370 bacteria, but not anchoring of the proteins that comprise pili to the bacterial cell wall. FACS analysis of the ΔSrtC1 strain SF370 confirmed that deletion of SrtC1 does not eliminate cell surface expression of M1__126, M1__128 or M1__130. See FIG. 179 G-I, which show a shift in fluorescence when antibodies immunoreactive to M1__126 (FIG. 179 G), M1__128 (FIG. 179 H), and M1__130 (FIG. 179 I) are used to detect cell surface protein expression on ΔSrtC1 bacteria. Thus, SrtC1 deletion prevents pilus formation, but not surface anchoring of proteins involved in pilus formation on the surface of bacteria. Another sortase is possibly involved in anchoring of the proteins to the bacteria surface. Pilus polymerization in *C. diphtheriae* is also dependent on particular sortase enzyme whose gene resides at the same genetic locus as the pilus components (7, 8).

The LepA signal peptidase, Spy0127, also appears to be essential for pilus assembly in strain SF370. LepA deletion mutants (ΔLepA) of strain SF370 fail to assemble pili on the cell surface. Not only are the ΔLepA mutants unable to assemble pili, they are also deficient at cell surface M1 expression. See FIG. 180, which provides a FACS analysis of the wildtype (A) and ΔLepA mutant (B) SF370 bacteria using M1 antisera. No shift in fluorescence is observed for the ΔLepA mutant bacteria in the presence of M1 immune serum. It is possible that these deletion mutants of LepA will be useful for detecting non-M, non-pili, surface exposed antigens on the surface of GAS, or any Gram positive bacteria. These antigens may also be useful in immunogenic compositions.

Pili were also observed in M5 strain ISS4882 and M12 strain 20010296. The M5 strain ISS4882 contains genes for four predicted surface exposed proteins (GAS AI-3). Antisera against three of the four products of the FCT region (GAS AI-3) of M5_ISS4883 (Cpa, M5_orf80, M5_orf82) stained high molecular weight ladders in Western blot analysis (FIG. 163 C). Long pili were visible when antisera against M5_orf80 was used in immunogold staining followed by electron microscopy (FIG. 163L).

The M12 strain 20010296 contains genes for five predicted surface exposed proteins. (GAS AI-4) Antisera against three of the five products of the FCT region (GAS AI-4) of M12__20010296 (Cpa, EftLSL.A, Orf2) stained high molecular weight ladders in Western blot analysis (FIG. 163 D). Long pili were visible when antisera against EftLSL.A were used (FIG. 163M).

The major pilus forming proteins identified in the four strains studied by applicants (T6, M1__128, M5_orf80 and EftLSL.A) share between 23% and 65% amino acid identity in any pairwise comparison, indicating that each pilus may represent a different Lancefield T-antigen. Each pilus is part of a trypsin resistant structure on the GAS bacteria surface, as is the case for the Lancefield T antigens. See FIG. 165, which provides a FACS analysis of bacteria harboring each of the FCT types that had or had not been treated with trypsin (6). Following treatment, surface expression of the pilus proteins was assayed by indirect immunofluorescence and flow cytometry using antibodies specific for the pilus proteins, the bacteria's respective M proteins, or surface proteins not associated with the pili (FIG. 165). Staining the cells with sera specific for proteins associated with the pili was not effected by trypsin treatment, whereas trypsin treatment substantially reduced detection of M-proteins or surface proteins not associated with pili.

Figure 166:
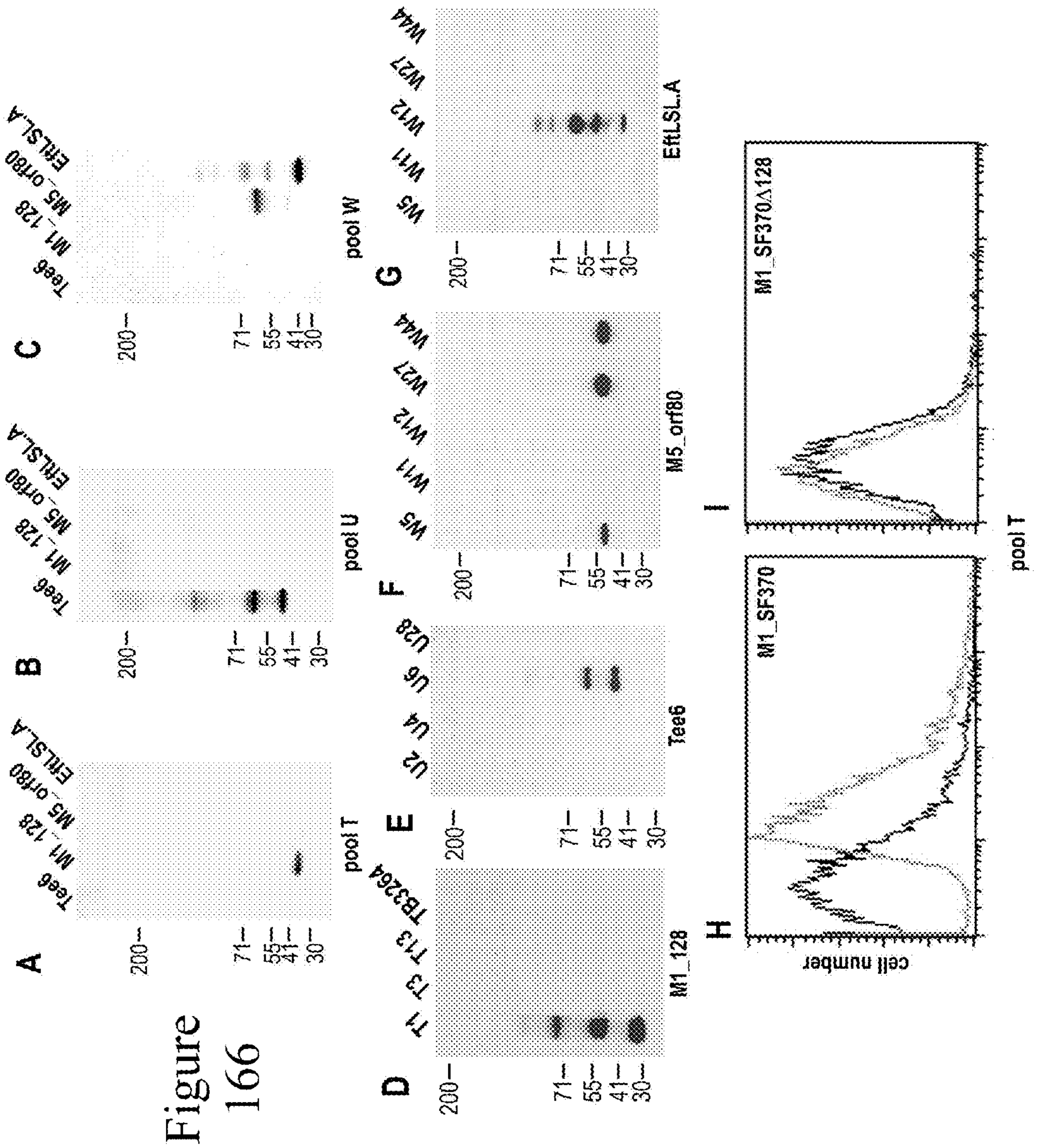

The pili structures identified on the surface of the GAS bacteria were confirmed to be Lancefield T antigens when commercially available T-serotyping sera detected the pili on the surface of bacteria. Western blot analysis was initially performed to determine if polyvalent serum pools (designated T, U, W, X, and Y) could detect recombinant proteins for each of the major pilis components (T6, M1__128, M5_orf80 and EftLSL.A) identified in the strains of bacteria discussed above. Pool U, which contains the T6 serum, recognized the T6 protein specifically (a surface exposed pilus protein from GAS AI-1) (FIG. 166 B). Pool T specifically recognized M1__128 (a surface exposed pilus protein from GAS AI-2) (FIG. 166 A). Pool W recognized both M5_orf80 and EftLSL.A (FIG. 166 C). Using monovalent sera representative of each of the components of each polyvalent pool, applicants confirmed the specificity of the T6 antigen (corresponding to a surface exposed pilus protein from GAS AI-1) (FIG. 166 E) and identified M1__28 as antigen T1 (corresponding to a surface exposed pilus protein from GAS AI-2) (FIG. 166 D), EftLSL.A as antigen T12 (corresponding to a surface exposed pilus protein from GAS AI-4) (FIG. 166 G) and M5_orf80 as a common antigen recognized by the related sera T5, T27 and T44 (corresponding to a surface exposed pilus protein from GAS AI-3).

Confirming applicants observations, discussed above, that deleting the M1__128 gene from M1_SF370 abolishes pilus formation, the pool T sera stained whole M1_SF370 bacteria (FIG. 166 H) but failed to stain M1_SF370 bacteria lacking the M1__128 gene (FIG. 166 I).

As discussed above, Applicants have identified at least four different Group A *Streptococcus* Adhesin Islands. While these GAS AI sequences can be identified in numerous M types, Applicants have surprisingly discovered a correlation between the four main pilus subunits from the four different GAS AI types and specific T classifications. While other trypsin-resistant surface exposed proteins are likely also implicated in the T classification designations, the discovery of the role of the GAS adhesin islands (and the associated hyper-oligomeric pilus like structures) in T classification and GAS serotype variance has important implications for prevention and treatment of GAS infections. Applicants have identified protein components within each of the GAS adhesin islands which are associated with the pilus formation. These proteins are believed to be involved in the bacteria's initial adherence mechanisms. Immunological recognition of these proteins may allow the host immune response to slow or prevent the bacteria's transition into the more pathogenic later stages of infection. In addition, the GAS pili may be involved in formation of biofilms. Applicants have discovered that the GBS pili structures appear to be implicated in the formation of biofilms (populations of bacteria growing on a surface, often enclosed in an exopolysaccharide matrix). Biofilms are generally associated with bacterial resistance, as antibiotic treatments and host immune response are frequently unable to eradicate all of the bacteria components of the biofilm. Direction of a host immune response against surface proteins exposed during the first steps of bacterial attachment (i.e., before complete biofilm formation) is preferable.

The invention therefore provides for improved immunogenic compositions against GAS infection which may target GAS bacteria during their initial attachment efforts to the host epithelial cells and may provide protection against a wide range of GAS serotypes. The immunogenic compositions of the invention include GAS AI surface proteins which may be formulated in an oligomeric, or hyperoligomeric (pilus) form. The invention also includes combinations of GAS AI surface proteins. Combinations of GAS AI surface proteins may be selected from the same adhesin island or they may be selected from different GAS adhesin islands.

The invention comprises compositions comprising a first GAS AI protein and a second GAS AI protein wherein the first and second GAS AI proteins are derived from different GAS adhesin islands. For example, the invention includes a composition comprising at least two GAS AI proteins wherein the GAS AI proteins are encoded by the adhesin islands selected from the group consisting of GAS AI-1 and AI-2; GAS AI-1 and GAS AI-3; GAS AI-1 and GAS AI-4; GAS AI-2 and GAS AI-3; GAS AI-2 and GAS AI-4; and GAS AI-3 and GAS AI-4. Preferably the two GAS AI proteins are derived from different T-types.

Figure 162:
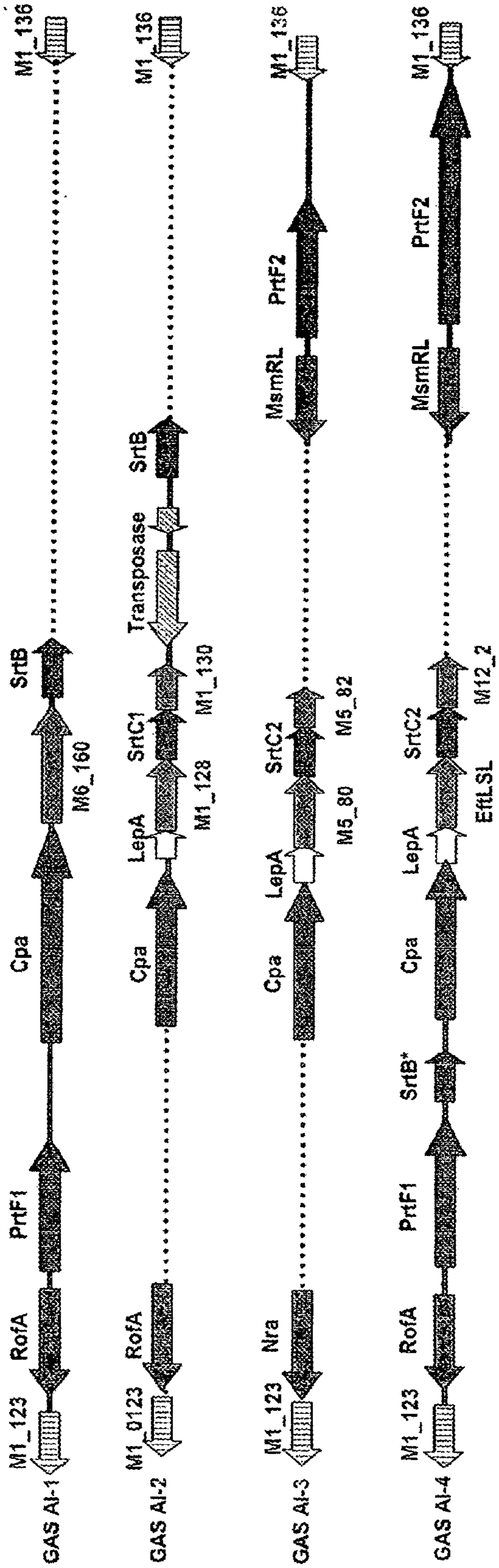

A schematic arrangement of GAS Adhesin Island sequences is set forth in FIG. 162. In all strains, the AI region is flanked by the highly conserved open reading frames M1__123 and M1-136. Between three and five genes in each locus code for surface proteins containing LPXTG motifs. These surface proteins also all belong to the family of genes coding for ECM binding adhesins.

Adhesin island sequences can be identified in numerous M types of Group A *Streptococcus*. Examples of AI sequences within M1, M6, M3, M5, M12, M18, and M49 serotypes are discussed below.

GAS Adhesin Islands generally include a series of open reading frames within a GAS genome that encode for a collection of surface proteins and sortases. A GAS Adhesin Island may encode for amino acid sequences comprising at least one surface protein. Alternatively, a GAS Adhesin Island may encode for at least two surface proteins and at least one sortase. Preferably, a GAS Adhesin Island encodes for at least three surface proteins and at least two sortases. One or more of the surface proteins may include an LPXTG motif (such as LPXTG (SEQ ID NO:122)) or other sortase substrate motif One or more GAS AI surface proteins may participate in the formation of a pilus structure on the surface of the Gram positive bacteria.

GAS Adhesin Islands of the invention preferably include a divergently transcribed transcriptional regulator. The transcriptional regulator may regulate the expression of the GAS AI operon. Examples of transcriptional regulators found in GAS AI sequences include RofA and Nra.

The GAS AI surface proteins may bind or otherwise adhere to fibrinogen, fibronectin, or collagen. One or more of the GAS AI surface proteins may comprise a fimbrial structural subunit.

One or more of the GAS AI surface proteins may include an LPXTG motif or other sortase substrate motif. The LPXTG motif may be followed by a hydrophobic region and a charged C terminus, which are thought to retard the protein in the cell membrane to facilitate recognition by the membrane-localized sortase. See Barnett, et al., J. Bacteriology (2004) 186 (17): 5865-5875.

GAS AI sequences may be generally categorized as Type 1, Type 2, Type 3, or Type 4, depending on the number and type of sortase sequences within the island and the percentage identity of other proteins (with the exception of RofA and cpa) within the island. FIG. 167 provides a chart indicating the number and type of sortase sequences identified within the adhesin islands of various strains and serotypes of GAs. As can be seen in this FIG., all GAS strains and serotypes thus far characterized as an AI-1 have a SrtB type sortase, all GAS strains and serotypes thus far characterized as an AI-2 have SrtB and SrtC1 type sortases, all GAS strains and serotypes thus far characterized as an AI-3 have a SrtC2 type sortase, and all GAS strains and serotypes thus far characterized as an AI-4 have SrtB and SrtC2 type sortases. A comparison of the percentage identity of sequences within the adhesin islands was presented in Table 45, see above.

(1) Adhesin Island Sequence within M6: GAS Adhesin Island 1 ("GAS AI-1")

A GAS Adhesin Island within M6 serotype (MGAS10394) is outlined in Table 4 below. This GAS adhesin island 1 ("GAS AI-1") comprises surface proteins, a srtB sortase and a rofA divergently transcribed transcriptional regulator.

GAS AI-1 surface proteins include Spy0157 (a fibronectin binding protein), Spy0159 (a collagen adhesion protein) and Spy0160 (a fimbrial structural subunit). Preferably, each of these GAS AI-1 surface proteins includes an LPXTG sortase substrate motif, such as LPXTG (SEQ ID NO:122) or LPXSG (SEQ ID NO:134) (conservative replacement of threonine with serine).

GAS AI-1 includes a srtB type sortase. GAS srtB sortases may preferably anchor surface proteins with an LPSTG motif (SEQ ID NO:166), particularly where the motif is followed by a serine.

TABLE 4

GAS AI-1 sequences from M6 isolate (MGAS10394)

| AI-1 sequence identifier | Sortase substrate sequence or sortase type | functional description |
|---|---|---|
| M6_Spy0156 | | Transcriptional regulator (rofA) |
| M6_Spy0157 | LPXTG SEQ ID NO: 122 | Fibronectin-binding protein |
| M6_Spy0158 | | Reverse transcriptase |
| M6_Spy0159 | LPXSG SEQ ID NO: 541 | Collagen adhesion protein |
| M6_Spy0160 | LPXTG SEQ ID NO: 122 | Fimbrial structural subunit |
| M6_Spy0161 | srtB | Sortase |

M6_Spy0160 appears to be present on the surface of GAS as part of oligomeric (pilus) structures. FIGS. 127-132 present electron micrographs of GAS serotype M6 strain 3650 immunogold stained for M6 Spy0160 using anti-M6 Spy0160 antiserum. Oligomeric or hyperoligmeric structures labelled with gold particles can be seen extending from the surface of the GAS in each of these FIG. s, indicating the presence of multiple M6_Spy0160 polypeptides in the oligomeric or hyperoligomeric structures. FIG. 176 A-F present electron micrographs of GAS M6 strain 2724 immunogold stained for M6_Spy0160 using anti-M6_Spy0160 antiserum (FIG. 176 A-E) or immunogold stained for M6_Spy0159 using anti-M6_Spy0159 antiserum (FIG. 176 F). Oligomeric or hyperoligomeric structures labelled with gold particles can again be seen extending from the surface of the M6 strain 2724 GAS bacteria immunogold stained for M6_Spy0160. M6_Spy0159 is also detected on the surface of the M6 strain 2724 GAs.

Figure 73:
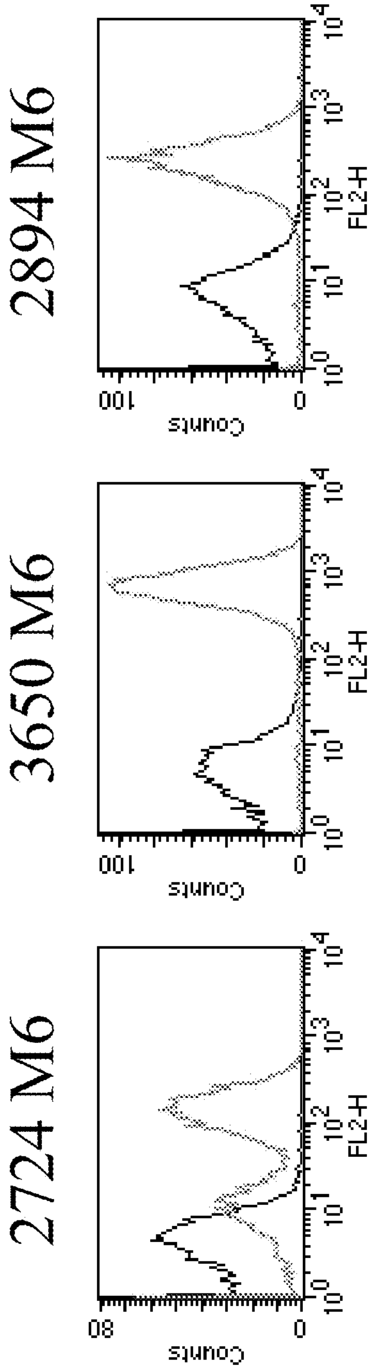
FIG. 73: FACS analysis of GAS serotype M6 for spyM6__0159 surface expression.

1 FACS analysis has confirmed that the GAS AI-1 surface proteins spyM6__0159 and spyM6__0160 are indeed expressed on the surface of GAs. FIG. 73 provides the results of FACS analysis for surface expression of spyM6__0159 on each of GAS serotypes M6 2724, M6 3650, and M6 2894. A shift in fluorescence is observed for each GAS serotype when anti-spyM6__0159 antiserum is present, demonstrating cell surface expression. Table 18, below, quantitatively summarizes the FACS fluorescence values obtained for each GAS serotype in the presence of pre-immune antiserum, anti-spyM6__0159 antiserum, and the difference in fluorescence value between the pre-immune and anti-spyM6__0159 antiserum.

TABLE 18

Summary of FACS values for surface expression of spyM6__0159

| 2724 | | | 3650 | | | 2894 | | |
|---|---|---|---|---|---|---|---|---|
| Pre-immune | Anti-spyM6__0159 | Change | Pre-immune | Anti-spyM6__0159 | Change | Pre-immune | Anti-spyM6__0159 | Change |
| 134.84 | 427.48 | 293 | 149.68 | 712.62 | 563 | 193.86 | 597.8 | 404 |

Figure 74:
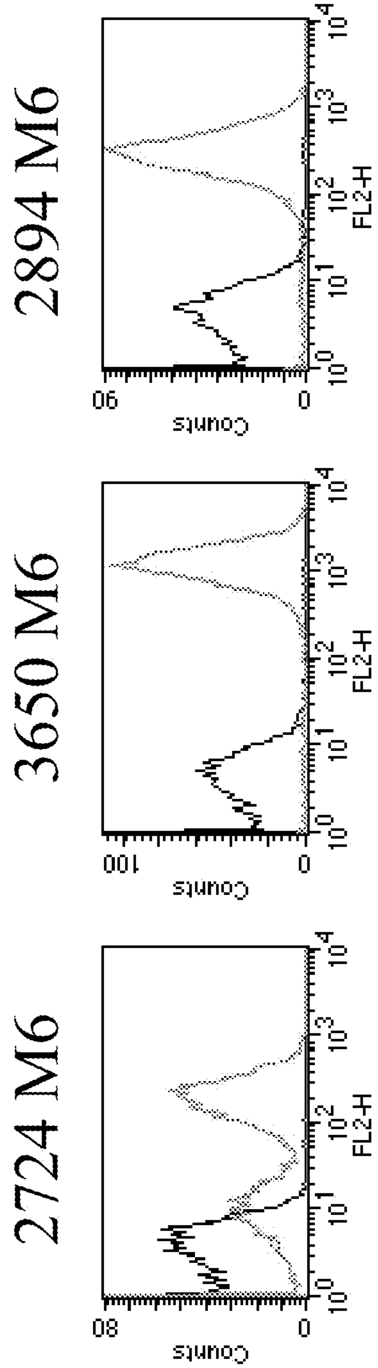
FIG. 74: FACS analysis of GAS serotype M6 for spyM6__0160 surface expression.

FIG. 74 provides the results of FACS analysis for surface expression of spyM6_0160 on each of GAS serotypes M6 2724, M6 3650, and M6 2894. In the presence of anti-spyM6_0160 antiserum, a shift in fluorescence is observed for each GAS serotype, which demonstrates its cell surface expression. Table 19, below, quantitatively summarizes the FACS fluorescence values obtained for each GAS serotype in the presence of pre-immune antiserum, anti-spyM6_0160 antiserum, and the change in fluorescence value between the pre-immune and anti-spyM6_0160 antiserum.

TABLE 19

Summary of FACS values for surface expression of spyM6_0160

| 2724 | | | 3650 | | | 2894 | | |
|---|---|---|---|---|---|---|---|---|
| Pre-immune | Anti-spyM6_0160 | change | Pre-immune | Anti-spyM6_0160 | change | Pre-immune | Anti-spyM6_0160 | change |
| 117.12 | 443.24 | 326 | 128.57 | 776.39 | 648 | 125.87 | 621.17 | 495 |

Figure 98:
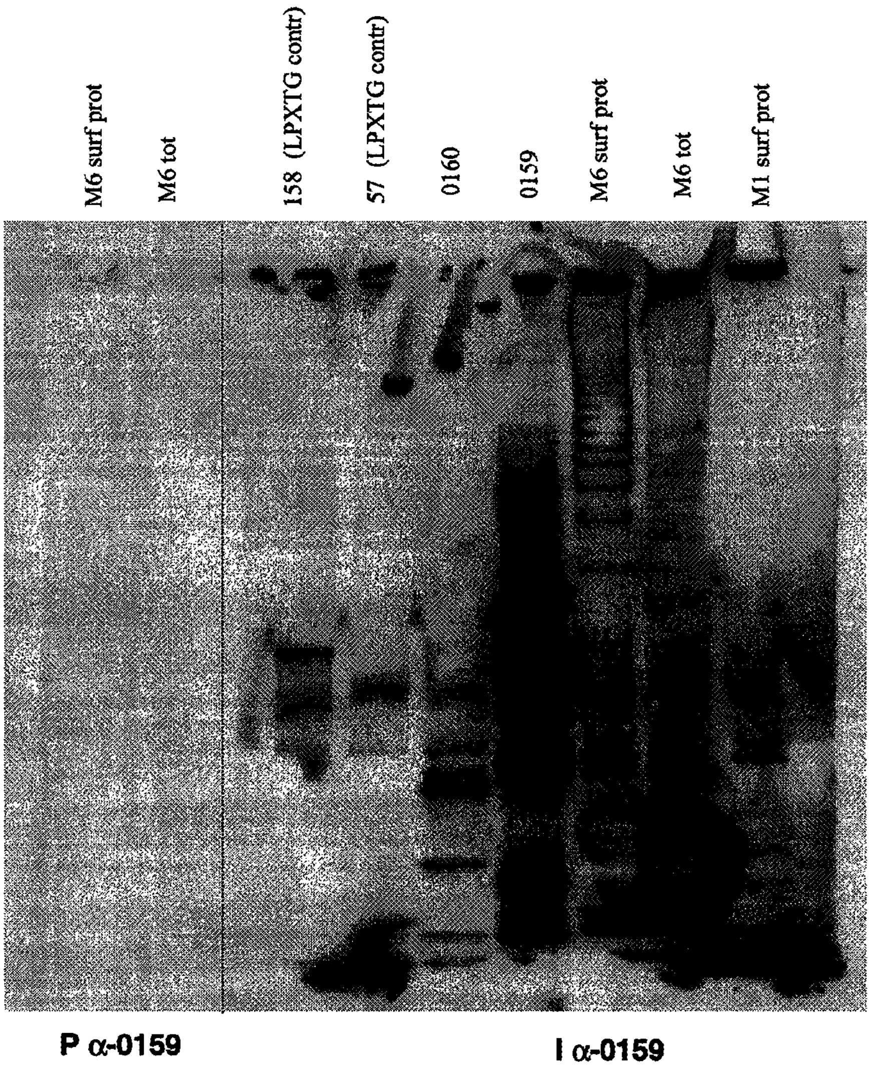
FIG. 98: Western blot analysis of M6_Spy0159 expression on GAS bacteria.

Surface expression of M6_Spy0159 and M6_Spy0160 on M6 serotype GAS has also been confirmed by Western blot analysis. FIG. 98 shows that while pre-immune sera (P α-0159) does not detect expression of M6_Spy0159 in GAS serotype M6, anti-M6_Spy0159 immune sera (I α-0159) is able to detect M6_Spy0159 protein in both total GAS M6 extracts (M6 tot) and GAS M6 fractions enriched for cell surface proteins (M6 surf prot). The M6_Spy0159 proteins detected in the total GAS M6 extracts or the GAS M6 extracts enriched for surface proteins are also present as high molecular weight structures, indicating that M6_Spy0159 may be in an oligomeric (pilus) form.

Figure 112:
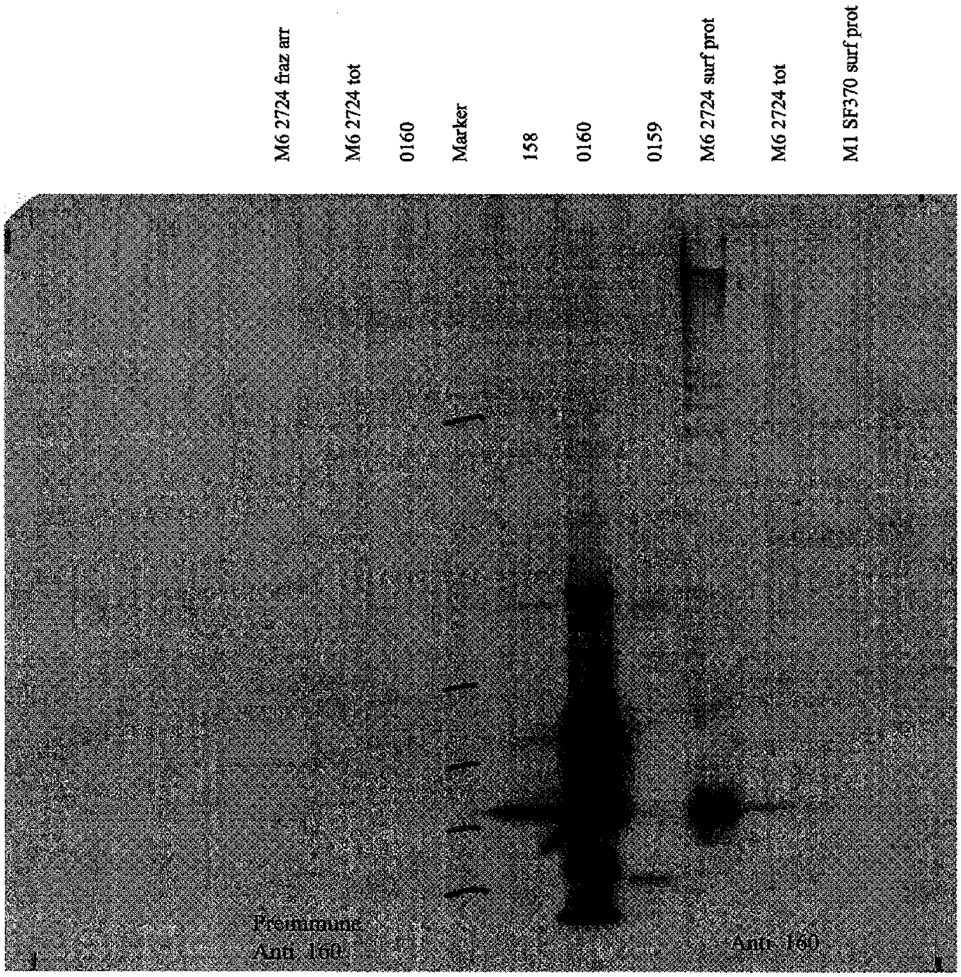
FIG. 112: Western blot analysis of M6_Spy160 in GAS M6 strain 2724.

FIG. 112 shows that while preimmune sera (Preimmune Anti 106) does not detect expression of M6_Spy0160 in GAS serotype M6 strain 2724, anti-M6_Spy0160 immune sera (Anti 160) does in both total GAS M6 strain 2724 extracts (M6 2724 tot) and GAS M6 strain 2724 fractions enriched for surface proteins. The M6_Spy0160 proteins detected in the total GAS M6 strain 2724 extracts or the GAS M6 strain 2724 extracts enriched for surface proteins are also present as high molecular weight structures, indicating that M6_Spy0160 may be in an oligomeric (pilus) form.

Figure 110:
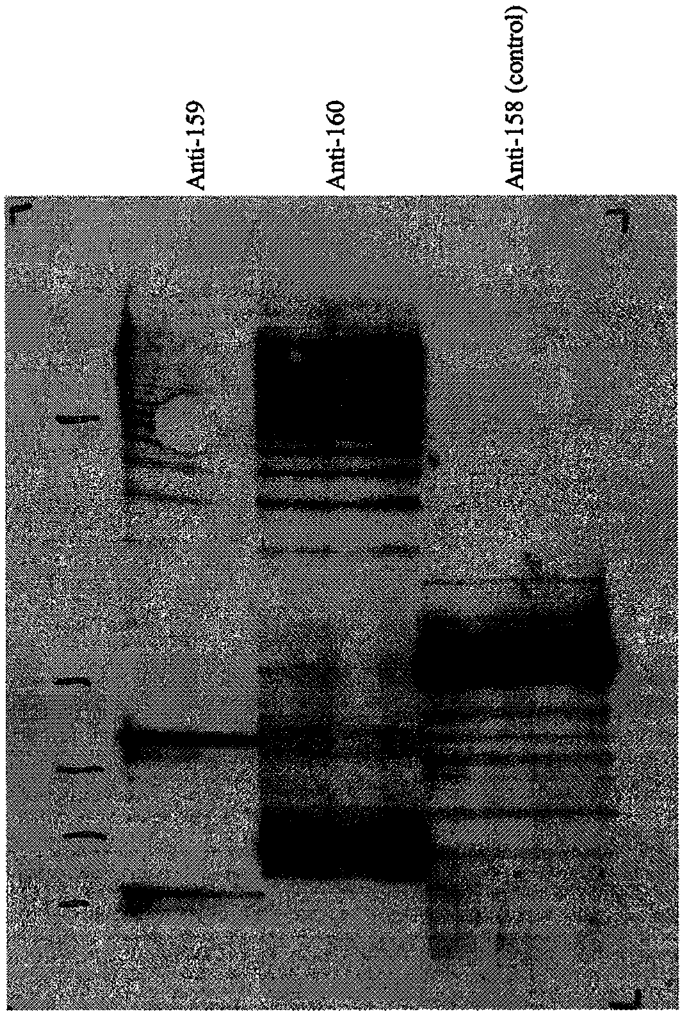
FIG. 110: Western blot analysis of M6_Spy0159 and M6_Spy0160 in GAS M6 strain 2724.
Figure 111:
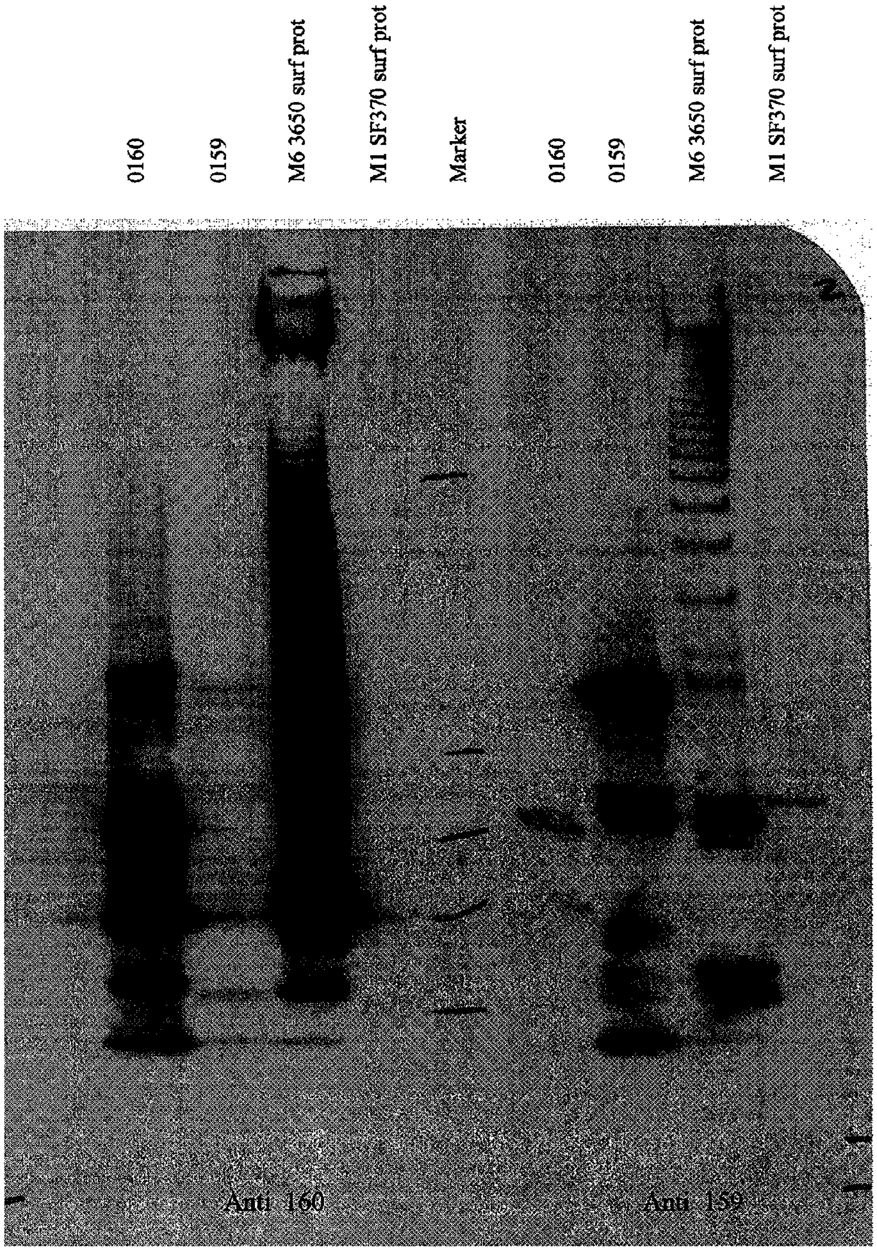
FIG. 111: Western blot analysis of M6 Spy0159 and M6 Spy0160 in GAS M6 strain SF370.

FIGS. 110 and 111 both further verify the presence of M6_Spy0159 and M6_Spy0160 in higher molecular weight structures on the surface of GAs. FIG. 110 provides a Western blot performed to detect M6_Spy0159 and M6_Spy0160 in GAS M6 strain 2724 extracts enriched for surface proteins. Antiserum raised against either M6_Spy0159 (Anti-159) or M6_Spy0160 (Anti-160) cross-hybridizes with high molecular weight structures (pili) in these extracts. FIG. 111 provides a similar Western blot that verifies the presence of M6_Spy0159 and M6_Spy0160 in high molecular weight structures in GAS M6 strain 3650 extracts enriched for surface proteins.

SpyM6_0157 (a fibronectin-binding protein) may also be expressed on the surface of GAS serotype M6 bacteria. FIG. 174 shows the results of FACS analysis for surface expression of spyM6_0157 on M6 strain 3650. A slight shift in fluorescence is observed, which demonstrates that some spyM6_0157 may be expressed on the GAS cell surface.

Adhesin Island Sequence within M6: GAS Adhesin Island 2 ("GAS AI-2")

A GAS Adhesin Island within M1 serotype (SF370) is outlined in Table 5 below. This GAS adhesin island 2 ("GAS AI-2") comprises surface proteins, a SrtB sortase, a SrtC1 sortase and a RofA divergently transcribed transcriptional regulator.

GAS AI-2 surface proteins include GAS 15 (Cpa), Spy0128 (thought to be a fimbrial protein) and Spy0130 (a hypothetical protein). Preferably, each of these GAS AI-2 surface proteins includes an LPXTG sortase substrate motif, such as LPXTG (SEQ ID NO:122), VVXTG (SEQ ID NO:135), or EVXTG (SEQ ID NO:136).

GAS AI-2 includes a srtB type sortase and a srtC1 sortase. As discussed above, GAS SrtB sortases may preferably anchor surface proteins with an LPSTG (SEQ ID NO:166) motif, particularly where the motif is followed by a serine. GAS SrtC1 sortase may preferentially anchor surface proteins with a V(P/V)PTG (SEQ ID NO:167) motif. GAS SrtC1 may be differentially regulated by RofA.

GAS AI-2 may also include a LepA putative signal peptidase I protein.

TABLE 5

GAS AI-2 sequence from M1 isolate (SF370)

| AI-2 sequence identifier | Sortase substrate sequence or sortase type | functional description |
|---|---|---|
| SPy0124 | | rofA regulatory protein |
| GAS15 (not annotated in SF370) | VVXTG SEQ ID NO: 542 | cpa |
| SPy0127 | | LepA putative signal peptidase I |
| SPy0128 (GAS16) | EVXTG SEQ ID NO: 543 | hypothetical protein (fimbrial) |
| SPy0129 (GAS17) | srtC1 | sortase |
| SPy0130 (GAS18) | LPXTG SEQ ID NO: 122 | hypothetical protein |
| SPy0131 | | conserved hypothetical protein |
| SPy0133 | | conserved hypothetical protein |
| SPy0135 (GAS20) | srtB | sortase (putative fimbrial-associated protein) |

Figure 113:
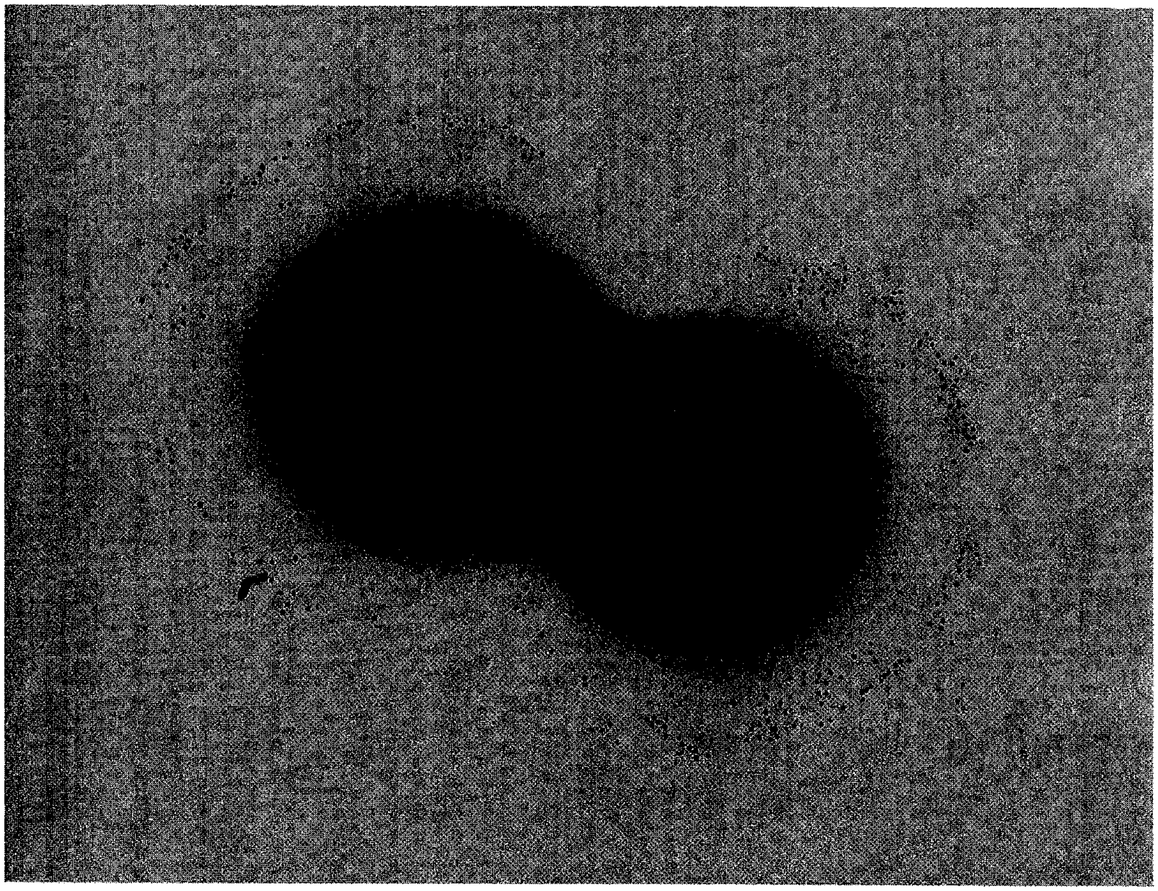
FIG. 113: Electron micrographs of surface exposed GAS 15 on GAS M1 strain SF370.
Figure 114:
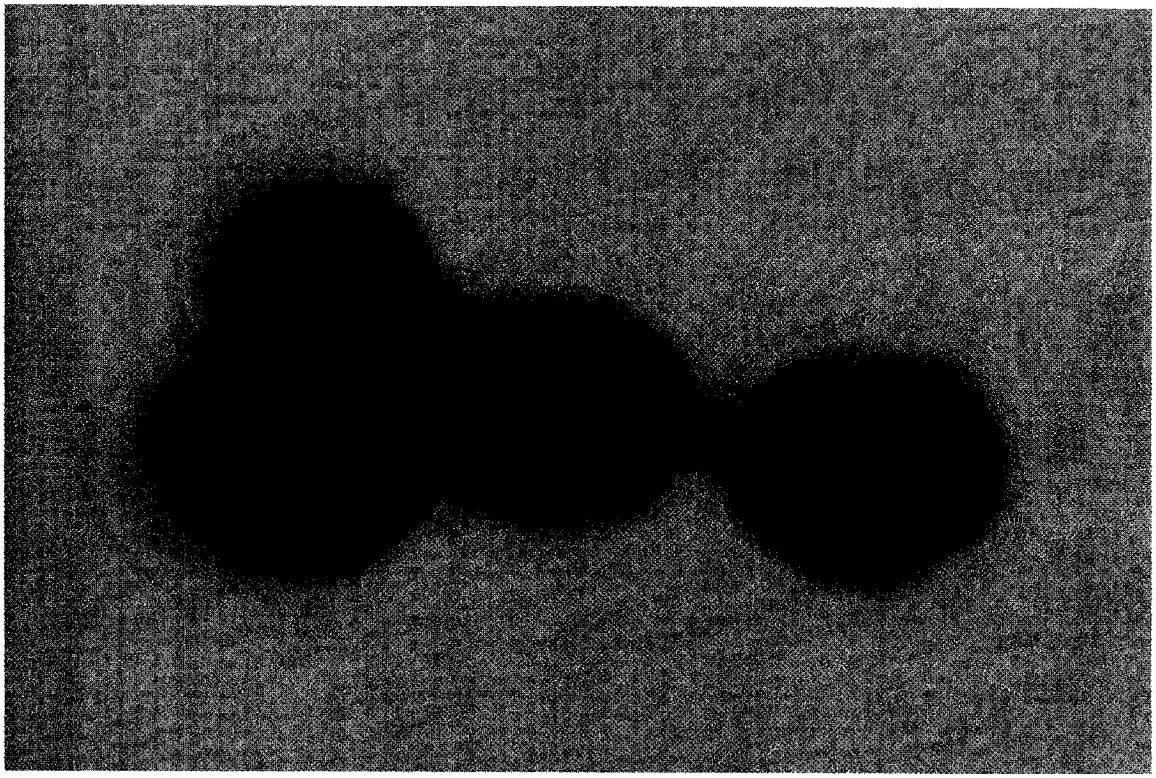
FIG. 114: Electron micrographs of surface exposed GAS 15 on GAS M1 strain SF370.
Figure 115:
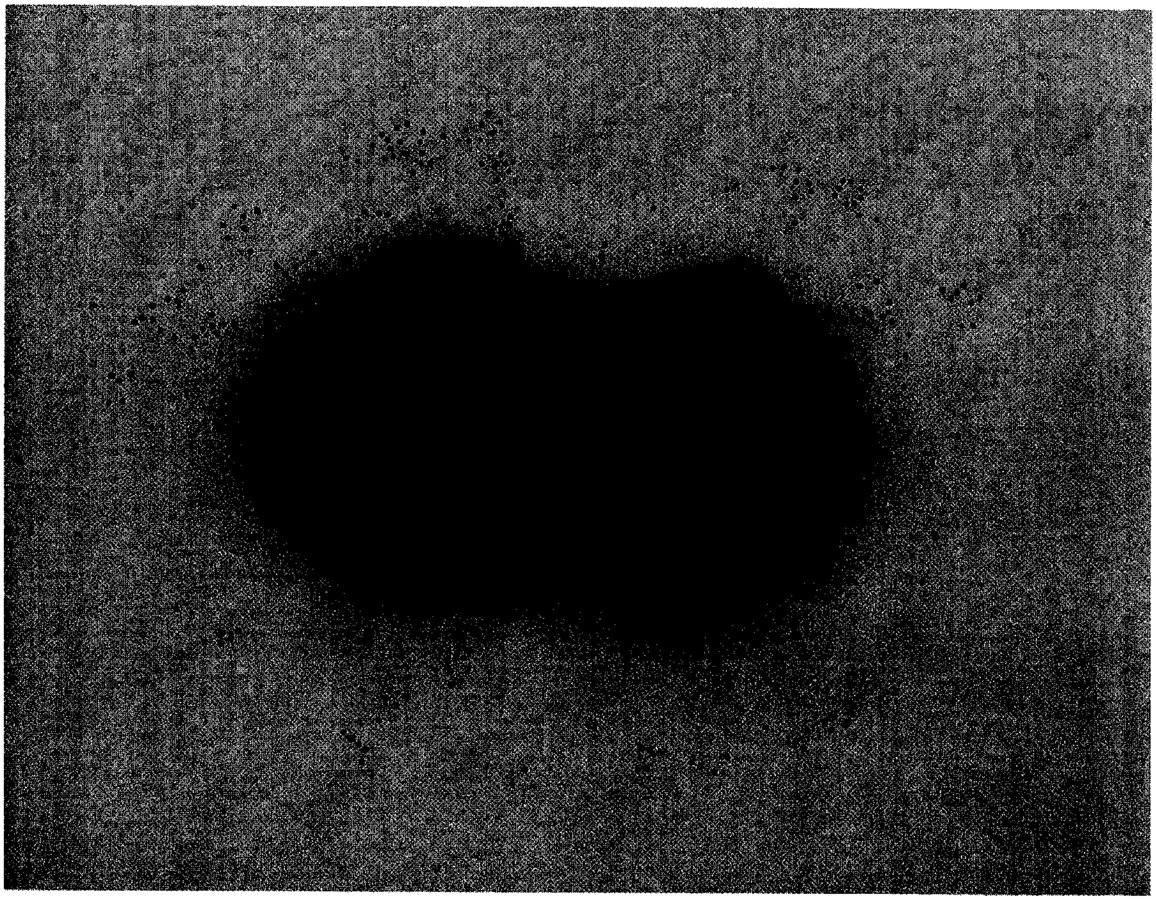
FIG. 115: Electron micrographs of surface exposed GAS 15 on GAS M1 strain SF370.
Figure 116:
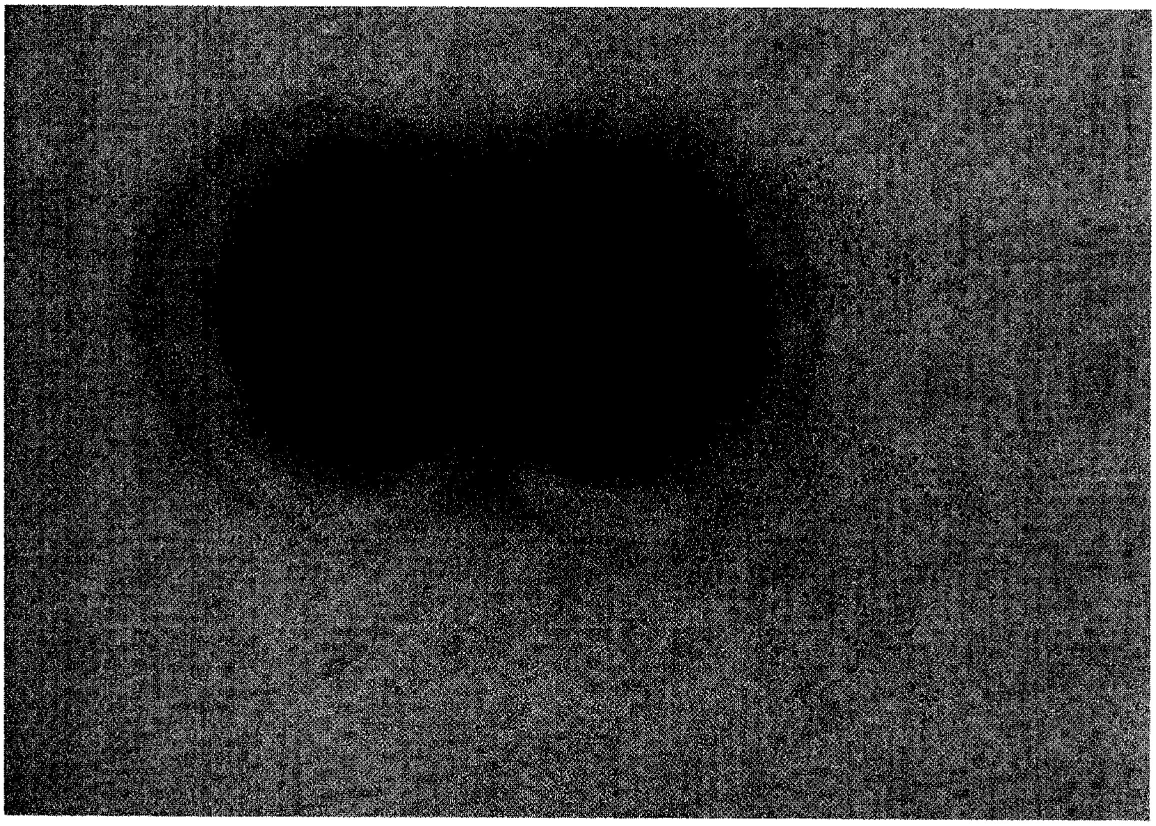
FIG. 116: Electron micrographs of surface exposed GAS 16 on GAS M1 strain SF370.
Figure 117:
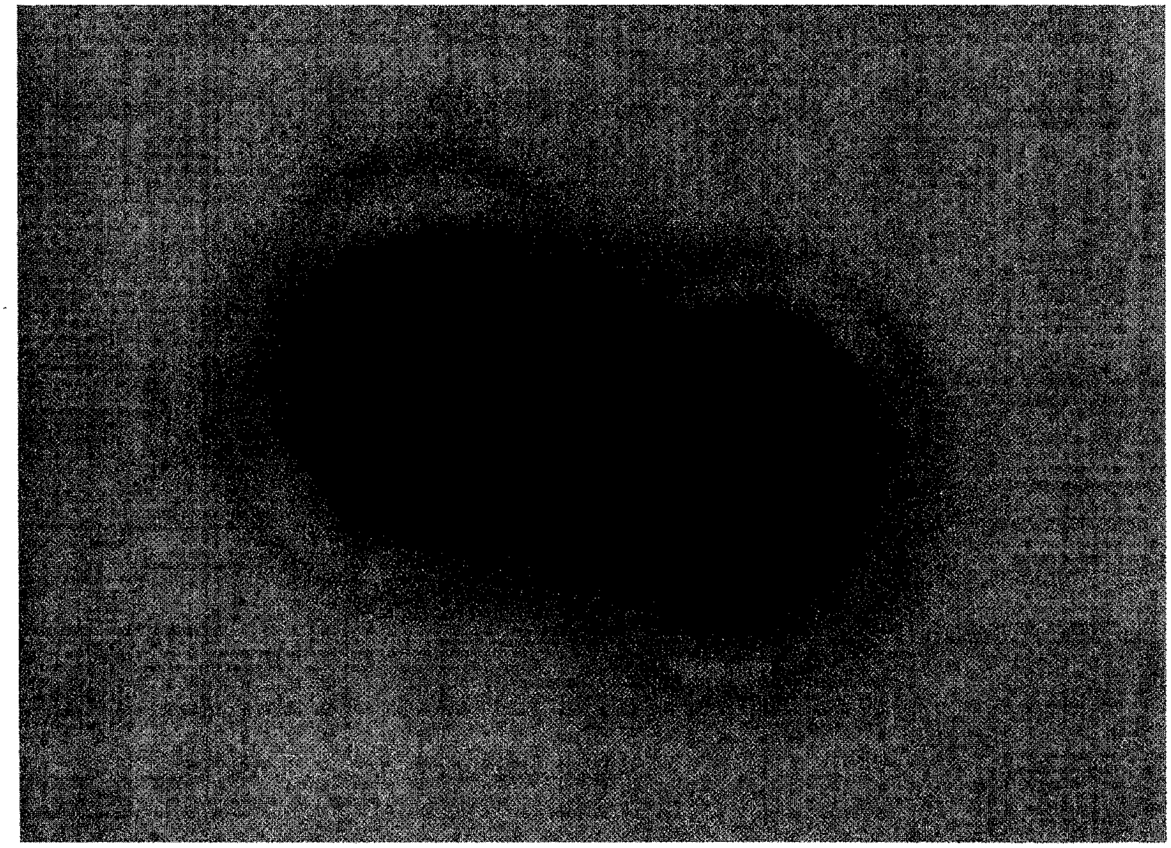
FIG. 117: Electron micrographs of surface exposed GAS 16 on GAS M1 strain SF370.
Figure 118:
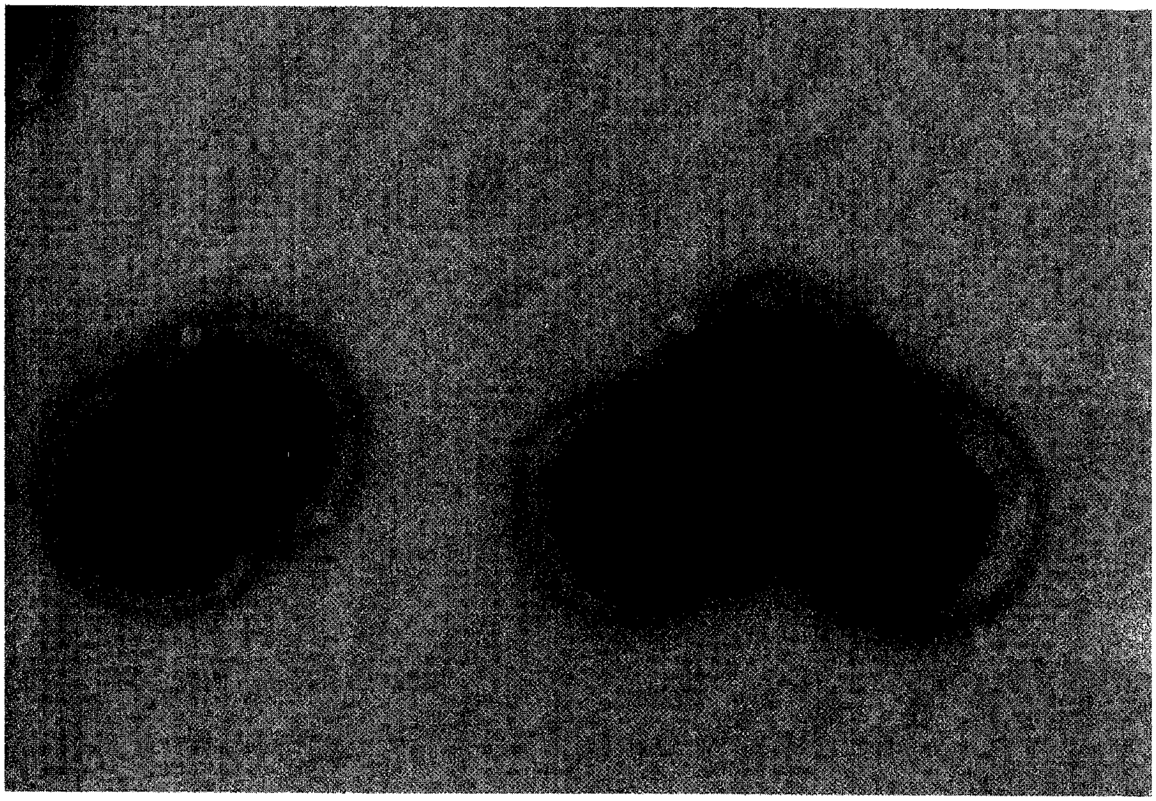
FIG. 118: Electron micrographs of surface exposed GAS 16 on GAS M1 strain SF370.
Figure 119:
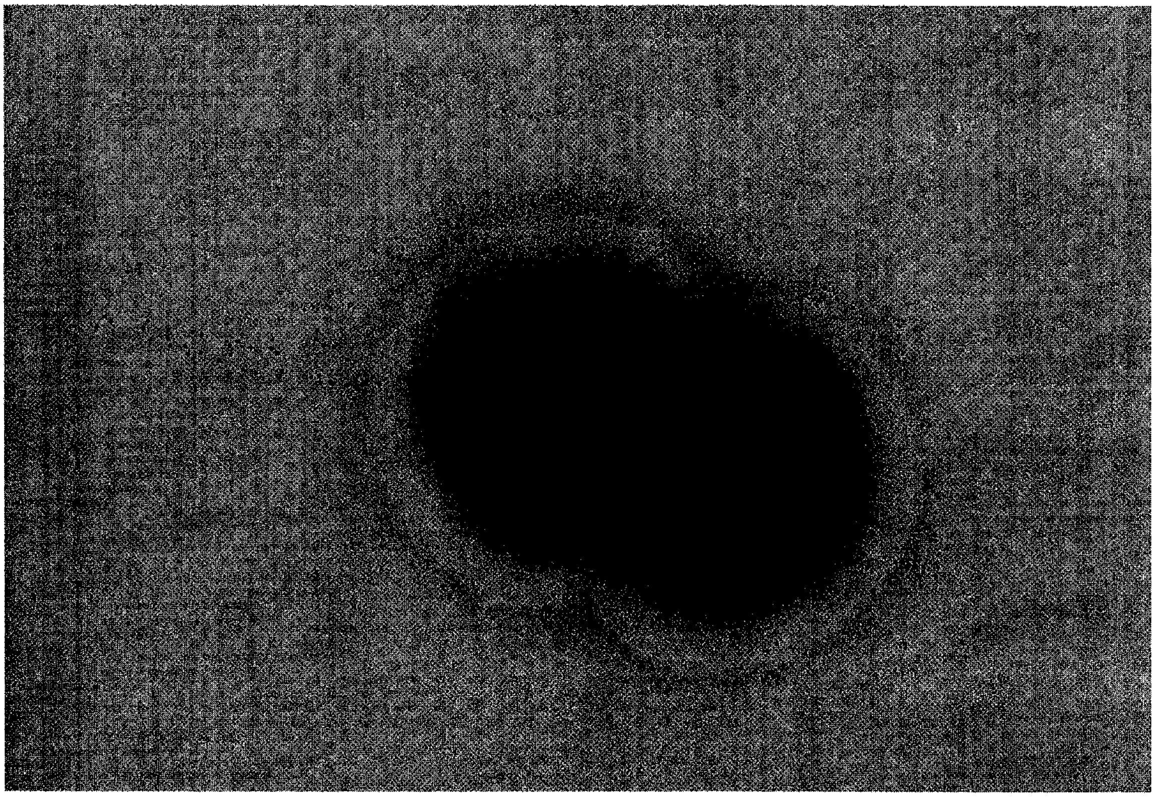
FIG. 119: Electron micrographs of surface exposed GAS 16 on GAS M1 strain SF370.

GAS 15, GAS 16, and GAS 18 appear to be present on the surface of GAS as part of oligomeric (pilus) structures. FIGS. 113-115 present electron micrographs of GAS serotype M1 strain SF370 immunogold stained for GAS 15 using anti-GAS 15 antiserum. FIGS. 116-121 provide electron micrographs of GAS serotype M1 strain SF370 immunogold stained for GAS 16 using anti-GAS 16 antiserum. FIGS. 122-125 present electron micrograph of GAS serotype M1 strain SF370 immunogold stained for GAS 18 using anti-GAS 18 antiserum. Oligomers of these proteins can be seen on the surface of SF370 bacteria in the immuno-gold stained micrographs.

FIG. 126 reveals a hyperoligomer on the surface of a GAS serotype M1 strain SF370 bacterium immunogold stained for GAS 18. This long hyperoliogmeric structure comprising GAS 18 stretches far out into the supernatant from the surface of the bacteria.

Figure 75:
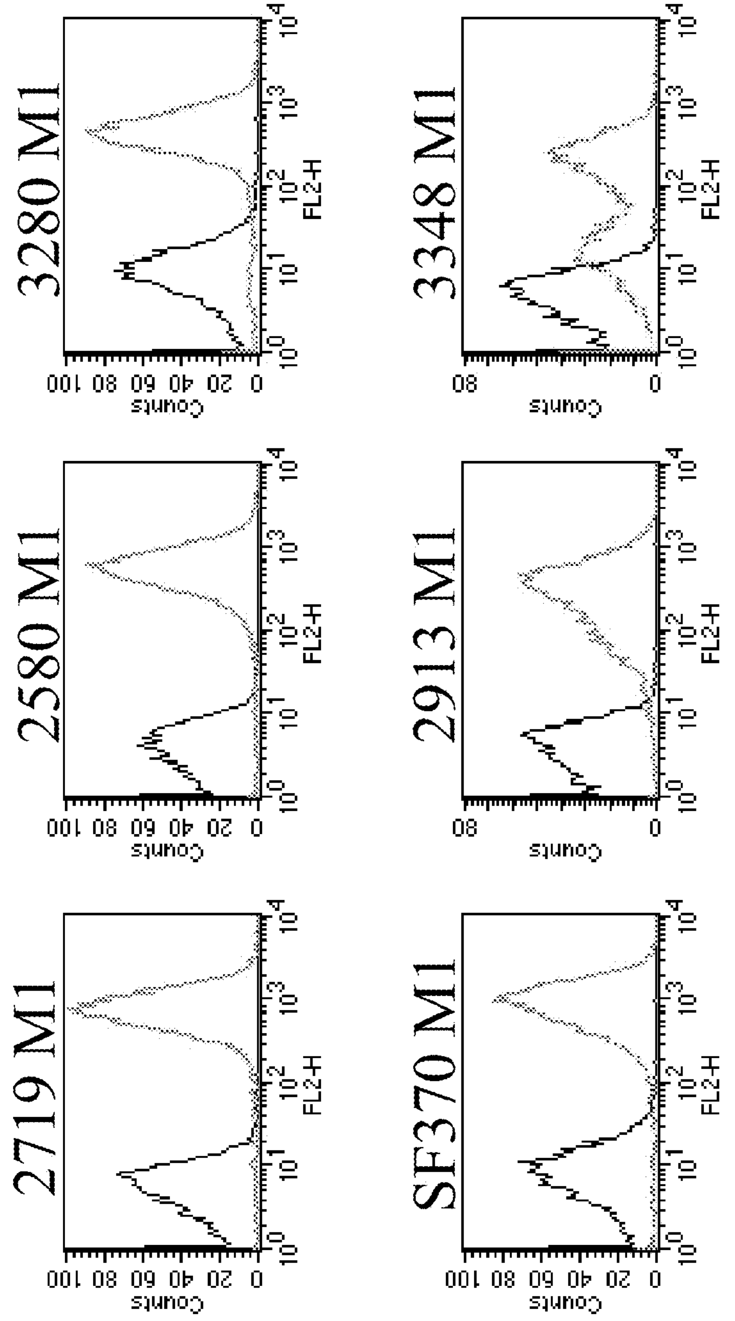
FIG. 75: FACS analysis of GAS serotype M1 for GAS 15 surface expression.

FACS analysis has confirmed that the GAS AI-2 surface proteins GAS 15, GAS 16, and GAS 18 are expressed on the surface of GAs. FIG. 75 provides the results of FACS analysis for surface expression of GAS 15 on each of GAS serotypes M1 2719, M1 2580, M1 3280, M1 SF370, M1 2913, and M1 3348. A shift in fluorescence is observed for each GAS serotype when anti-GAS 15 antiserum is present, demonstrating cell surface expression. Table 20, below, quantitatively summarizes the FACS fluorescence values obtained for each GAS serotype in the presence of pre-immune antiserum, anti-GAS 15 antiserum, and the difference in fluorescence value between the pre-immune and anti-GAS 15 antiserum.

TABLE 20

Summary of FACS values for surface expression of GAS 15

| Pre-immune | Anti-GAS 15 | Change | Pre-immune | Anti-GAS 15 | Change | Pre-immune | Anti-GAS 15 | Change |
|---|---|---|---|---|---|---|---|---|
| | 2719 | | | 2580 | | | 3280 | |
| 159.46 | 712.71 | 553 | 123.9 | 682.84 | 559 | 217.02 | 639.69 | 423 |
| | SF370 | | | 2913 | | | 3348 | |
| 201.93 | 722.68 | 521 | 121.41 | 600.45 | 479 | 152.09 | 446.41 | 294 |

Figure 76:
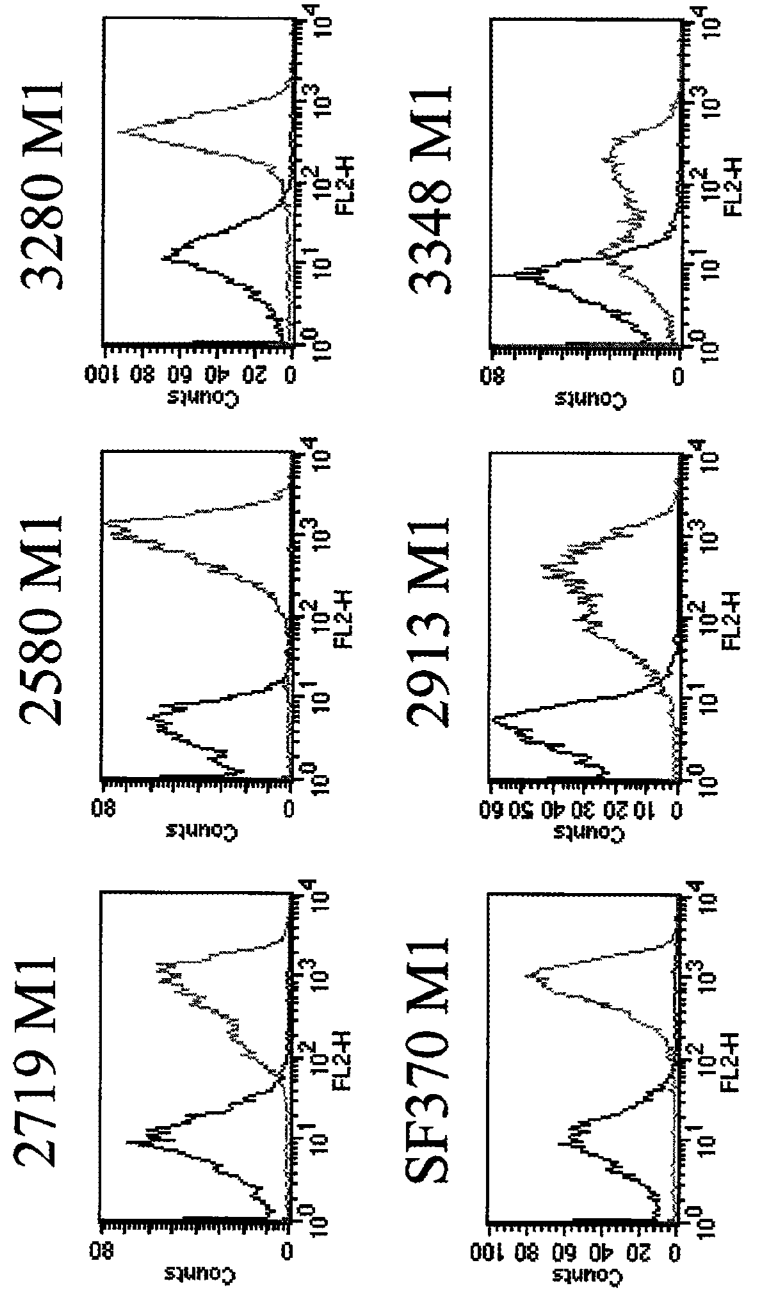
FIG. 76: FACS analysis of GAS serotype M1 for GAS 16 surface expression using a first anti-GAS 16 antiserum.
Figure 79:
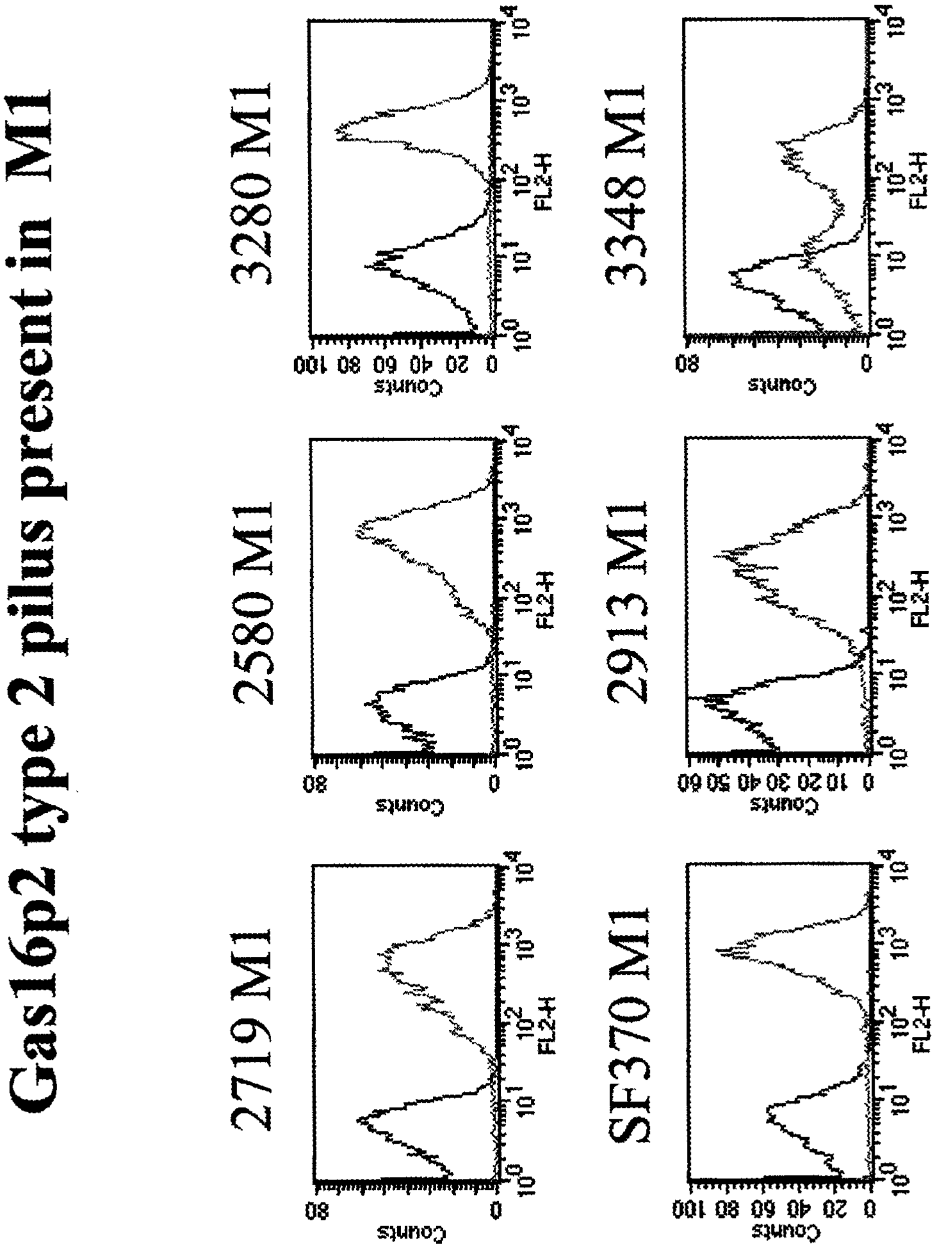
FIG. 79: FACS analysis of GAS serotype M1 for GAS 16 surface expression using a second anti-GAS 16 antisera.

FIGS. 76 and 79 provide the results of FACS analysis for surface expression of GAS 16 on each of GAS serotypes M1 2719, M1 2580, M1 3280, M1 SF370, M1 2913, and M1 3348. The FACS data in FIG. 76 was obtained using antisera was raised against full length GAS 16. In the presence of this anti-GAS 16 antiserum, a shift in fluorescence is observed for each GAS serotype, demonstrating its cell surface expression. Table 21, below, quantitatively summarizes the FACS fluorescence values obtained for each GAS serotype in the presence of pre-immune antiserum, anti-GAS 16 antiserum, and the change in fluorescence value between the pre-immune and anti-GAS 16 antiserum.

TABLE 21

Summary of FACS values for surface expression of GAS 16

| Pre-immune | Anti-GAS 16 | Change | Pre-immune | Anti-GAS 16 | Change | Pre-immune | Anti-GAS 16 | Change |
|---|---|---|---|---|---|---|---|---|
| | 2719 | | | 2580 | | | 3280 | |
| 233.27 | 690.09 | 457 | 133.82 | 732.29 | 598 | 264.47 | 649.43 | 385 |
| | SF370 | | | 2913 | | | 3348 | |
| 237.2 | 727.46 | 490 | 138.52 | 588.04 | 450 | 180.56 | 420.93 | 240 |

The FACS data in FIG. 79 was obtained using antisera was raised against a truncated GAS 16, which is encoded by SEQ ID NO:179, shown below.

```
SEQ ID NO: 179:
GCTACAACAGTTCACGGGGAGACTGTTGTAAACGGAGCCAAACTAACA

GTTACAAAAAACCTTGATTTAGTTAATAGCAATGCATTAATTCCAAAT

ACAGATTTTACATTTAAAATCGAACCTGATACTACTGTCAACGAAGAC

GGAAATAAGTTTAAAGGTGTAGCTTTGAACACACCGATGACTAAAGTC

ACTTACACCAATTCAGATAAAGGTGGATCAAATACGAAAACTGCAGAA

TTTGATTTTTCAGAAGTTACTTTTGAAAAACCAGGTGTTTATTATTAC

AAAGTAACTGAGGAGAAGATAGATAAAGTTCCTGGTGTTTCTTATGAT

ACAACATCTTACACTGTTCAAGTTCATGTCTTGTGGAATGAAGAGCAA

CAAAAACCAGTAGCTACTTATATTGTTGGTTATAAAGAAGGTAGTAAG

GTGCCAATTCAGTTCAAAAATAGCTTAGATTCTACTACATTAACGGTG

AAGAAAAAAGTTTCAGGTACCGGTGGAGATCGCTCTAAAGATTTTAAT

TTTGGTCTGACTTTAAAAGCAAATCAGTATTATAAGGCGTCAGAAAAA

GTCATGATTGAGAAGACAACTAAAGGTGGTCAAGCTCCTGTTCAAACA
```

-continued

```
GAGGCTAGTATAGATCAACTCTATCATTTTACCTTGAAAGATGGTGAA

TCAATCAAAGTCACAAATCTTCCAGTAGGTGTGGATTATGTTGTCACT

GAAGACGATTACAAATCAGAAAAATATACAACCAACGTGGAAGTTAGT

CCTCAAGATGGAGCTGTAAAAAATATCGCAGGTAATTCAACTGAACAA

GAGACATCTACTGATAAAGATATGACCATTACTTTTACAAATAAAAAA

GATTT
```

In the presence of this anti-GAS 16 antiserum, a shift in fluorescence is observed for each GAS serotype, demonstrating its cell surface expression. Table 22, below, quantitatively summarizes the FACS fluorescence values obtained for each GAS serotype in the presence of pre-immune antiserum, anti- GAS 16 antiserum, and the change in fluorescence value between the pre-immune and anti-GAS 16 antiserum.

TABLE 22

Summary of FACS values for surface expression of GAS 16 using a second antisera

| Pre-immune | Anti-GAS 16 | Change | Pre-immune | Anti-GAS 16 | Change | Pre-immune | Anti-GAS 16 | Change |
|---|---|---|---|---|---|---|---|---|
| | 2719 | | | 2580 | | | 3280 | |
| 141.55 | 650.22 | 509 | 119.57 | 672.35 | 553 | 209.18 | 666.71 | 458 |
| | SF370 | | | 2913 | | | 3348 | |
| 159.92 | 719.32 | 559 | 115.97 | 585.9 | 470 | 146.1 | 414.01 | 268 |

Figure 77:
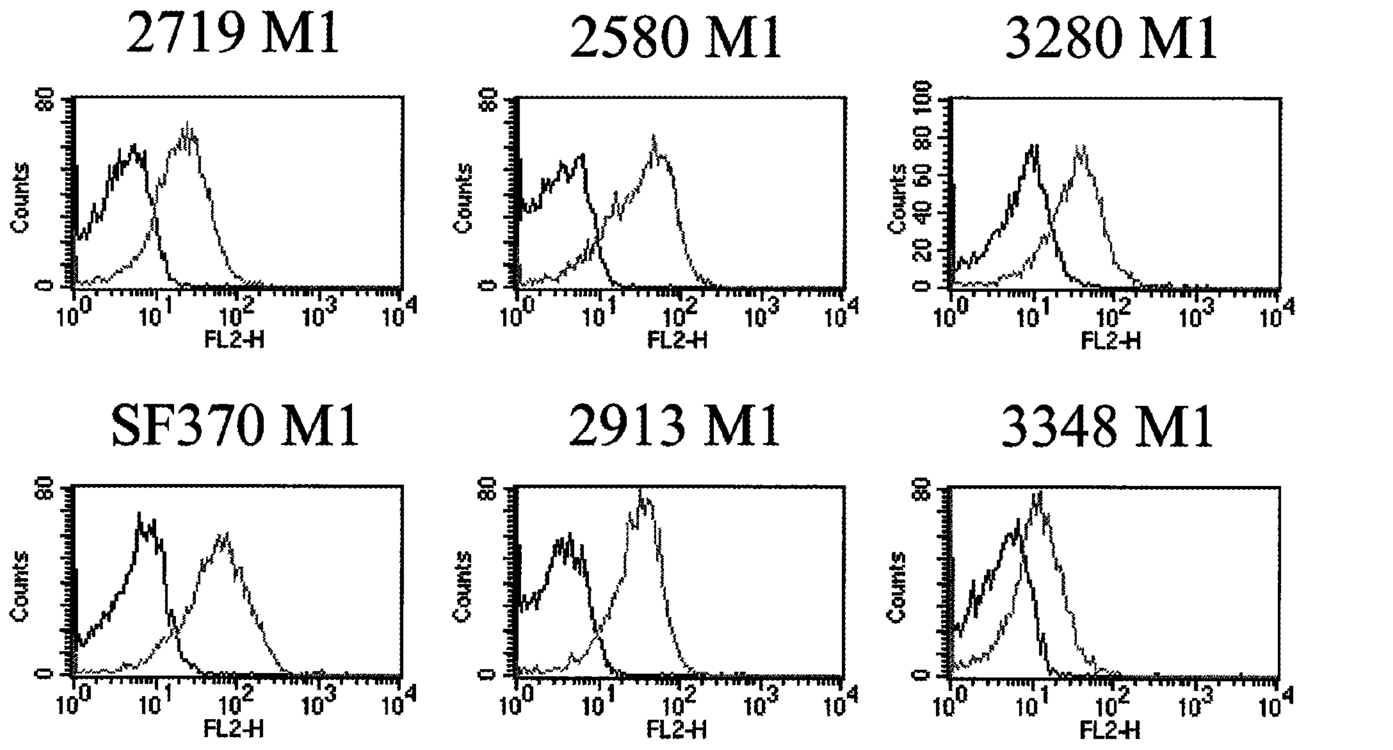
FIG. 77: FACS analysis of GAS serotype M1 for GAS 18 surface expression using a first anti-GAS 18 antiserum.
Figure 78:
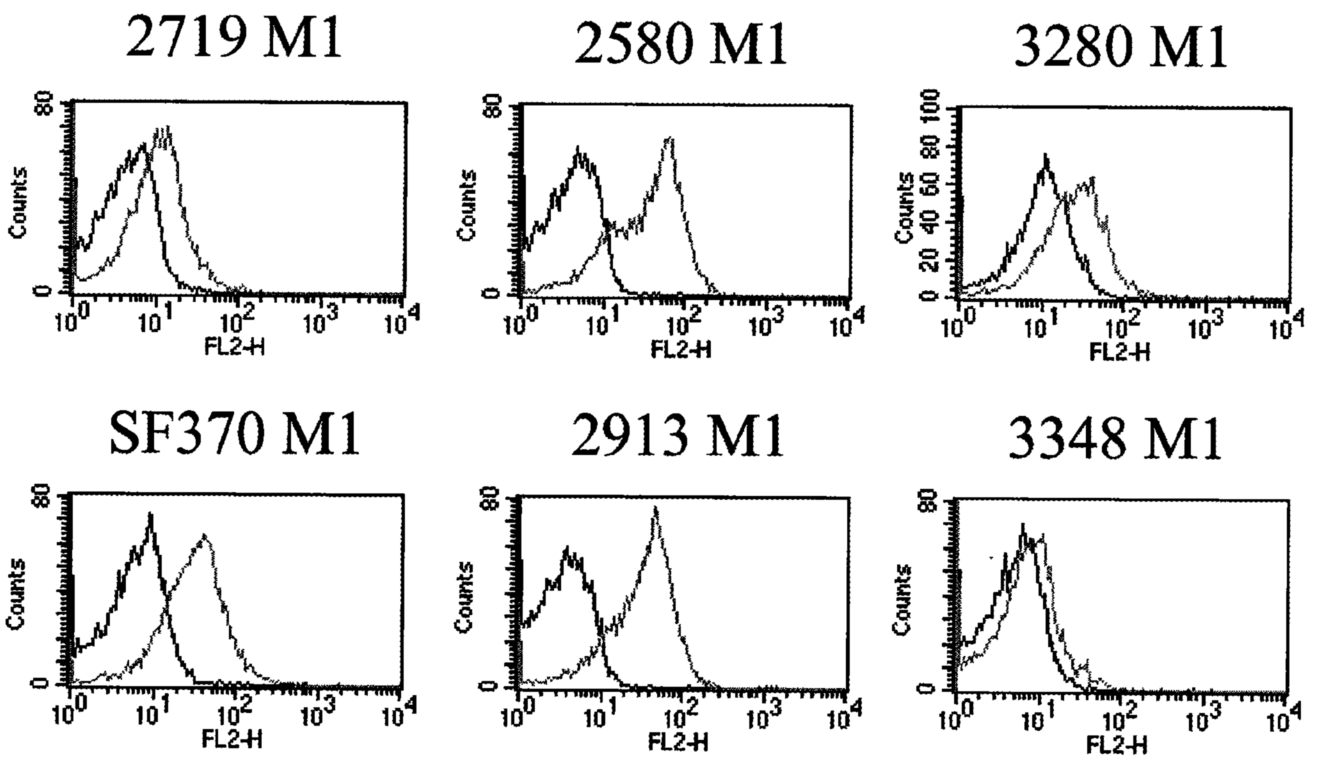
FIG. 78: FACS analysis of GAS serotype M1 for GAS 18 surface expression using a second anti-GAS 18 antiserum.

FIGS. 77 and 78 provide the results of FACS analysis for surface expression of GAS 18 on each of GAS serotypes M12719, M12580, M1 3280, M1 SF370, M12913, and M13348. The antiserum used to obtain the FACS data in each of FIGS. 77 and 78 was different, although each was raised against full length GAS 18. In the presence of each of the anti-GAS 18 antisera, a shift in fluorescence is observed for each GAS serotype, demonstrating its cell surface expression. Tables 23 and 24, below, quantitatively summarizes the FACS fluorescence values obtained for each GAS serotype in the presence of pre-immune antiserum, first or second anti-GAS 18 antiserum, and the change in fluorescence value between the pre-immune and first or second anti-GAS 18 antiserum.

TABLE 23

Summary of FACS values for surface expression of GAS 18

| Pre-immune | Anti-GAS 18 | Change | Pre-immune | Anti-GAS 18 | Change | Pre-immune | Anti-GAS 18 | Change |
|---|---|---|---|---|---|---|---|---|
| | 2719 | | | 2580 | | | 3280 | |
| 135.68 | 327.98 | 192 | 116.32 | 379.41 | 263 | 208.12 | 380.84 | 173 |
| | SF370 | | | 2913 | | | 3348 | |
| 185.39 | 438.23 | 253 | 119.95 | 373.32 | 253 | 147.12 | 266.51 | 119 |

TABLE 24

Summary of FACS values for surface expression of GAS 18 using a second antisera

| Pre-immune | Anti-GAS 18 | Change | Pre-immune | Anti-GAS 18 | Change | Pre-immune | Anti-GAS 18 | Change |
|---|---|---|---|---|---|---|---|---|
| | 2719 | | | 2580 | | | 3280 | |
| 150.4 | 250.39 | 100 | 139.18 | 386.38 | 247 | 253.38 | 347.72 | 94 |
| | SF370 | | | 2913 | | | 3348 | |
| 188.64 | 373.11 | 184 | 124.94 | 384.82 | 260 | 168.8 | 213.65 | 45 |

Figure 89:
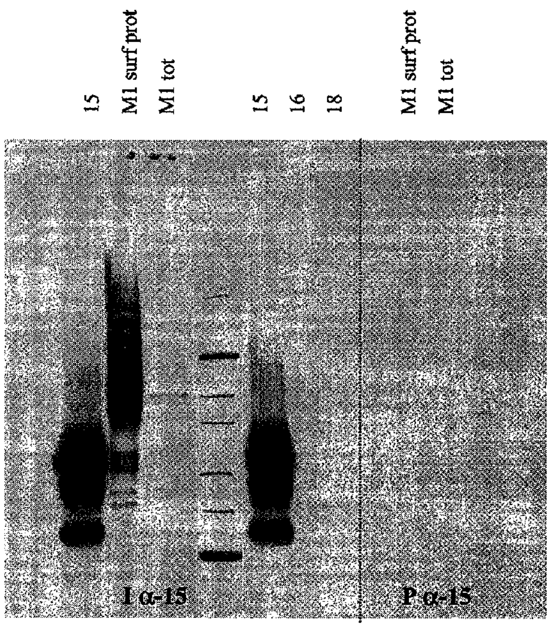
FIG. 89: Western blot analysis of GAS 15 expression on GAS M1 bacteria.
Figure 90:
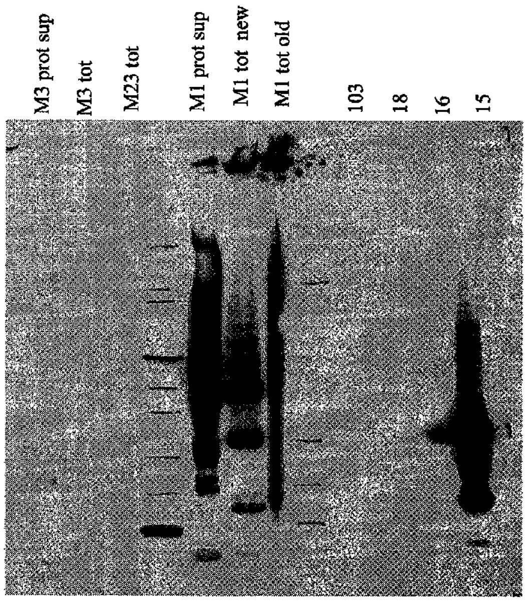
FIG. 90: Western blot analysis of GAS 15 expression using GAS 15 immune sera.
Figure 91:
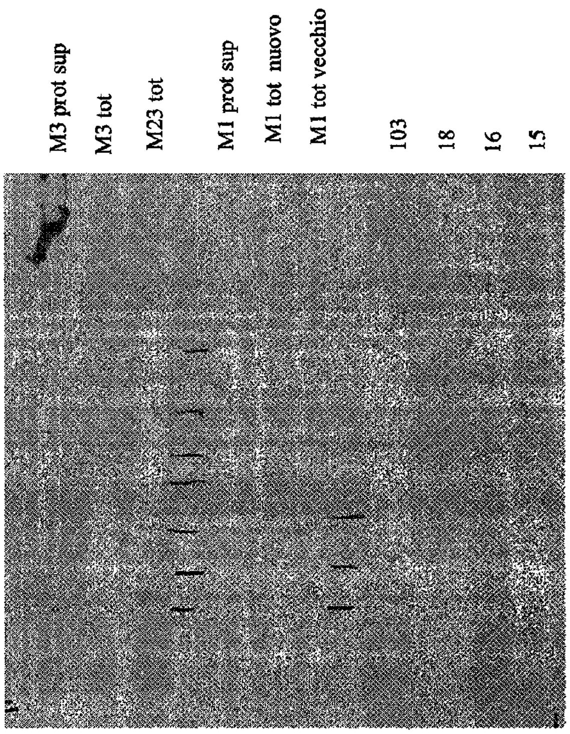
FIG. 91: Western blot analysis of GAS 15 expression using GAS 15 pre-immune sera.

Surface expression of GAS 15, GAS 16, and GAS 18 on M1 serotype GAS has also been confirmed by Western blot analysis. FIG. 89 shows that while pre-immune sera does not detect GAS M1 expression of GAS 15, anti-GAS 15 immune sera is able to detect GAS 15 protein in both total GAS M1 extracts and GAS M1 proteins enriched for cell surface proteins. The GAS 15 proteins detected in the M1 extracts enriched for surface proteins are also present as high molecular weight structures, indicating that GAS 15 may be in an oligomeric (pilus) form. FIG. 90 also shows the results of Western blot analysis of M1 serotype GAS using anti-GAS 15 antisera. Again, the lanes that contain GAS M1 extracts enriched for surface proteins (M1 prot sup) show the presence of high molecular weight structures that may be oligomers of GAS 15. FIG. 91 provides an additional Western blot identical to that of FIG. 90, but that was probed with pre-immune sera. As expected, no proteins were detected on this membrane.

Figure 92:
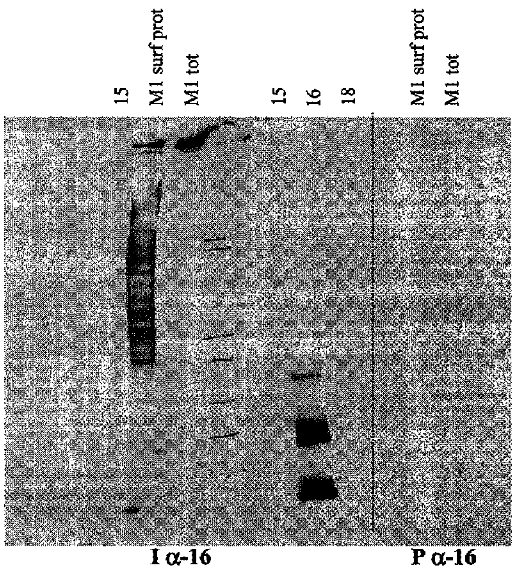
FIG. 92: Western blot analysis of GAS 16 expression on GAS M1 bacteria.
Figure 93:
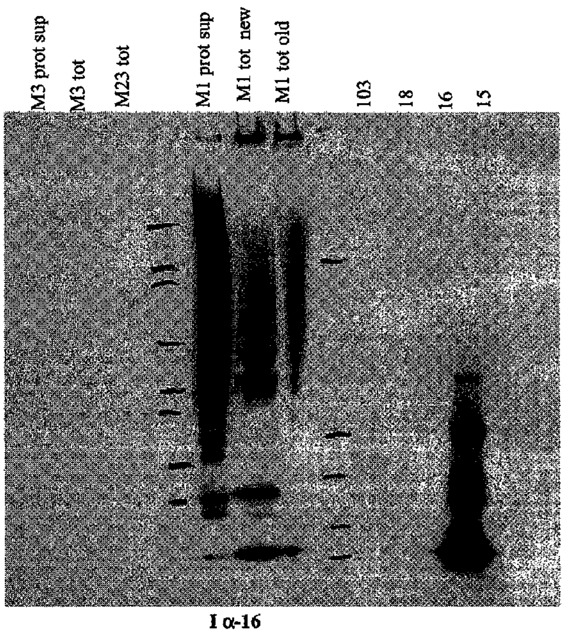
FIG. 93: Western blot analysis of GAS 16 expression using GAS 16 immune sera.
Figure 94:
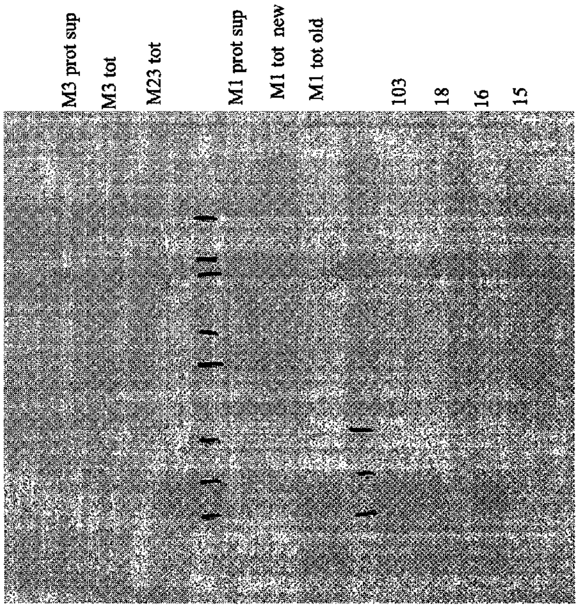
FIG. 94: Western blot analysis of GAS 16 expression using GAS 16 pre-immune sera.

FIG. 92 provides a Western blot that was probed for GAS 16 protein. While pre-immune sera does not detect GAS M1 expression of GAS 16, anti-GAS 16 immune sera is able to detect GAS 16 protein in GAS M1 extracts enriched for cell surface proteins. The GAS 16 proteins detected in the M1 extracts enriched for surface proteins are present as high molecular weight structures, indicating that GAS 16 may be in an oligomeric (pilus) form. FIG. 93 also shows the results of Western blot analysis of M1 serotype GAS using anti-GAS 16 antisera. The lanes that contain total GAS M1 protein (M1 tot new and M1 tot old) and the lane that contains GAS M1 extracts enriched for surface proteins (M1 prot sup) show the presence of high molecular weight structures that may be oligomers of GAS 16. FIG. 94 provides an additional Western blot identical to that of FIG. 93, but that was probed with pre-immune sera. As expected, no proteins were detected on this membrane.

Figure 95:
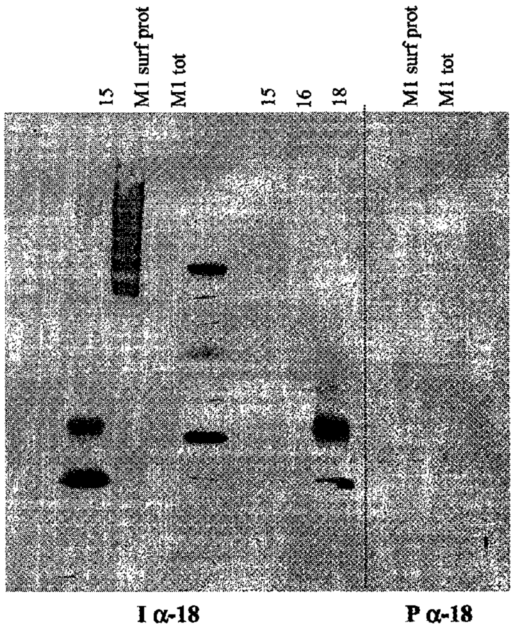
FIG. 95: Western blot analysis of GAS 18 on GAS M1 bacteria.
Figure 96:
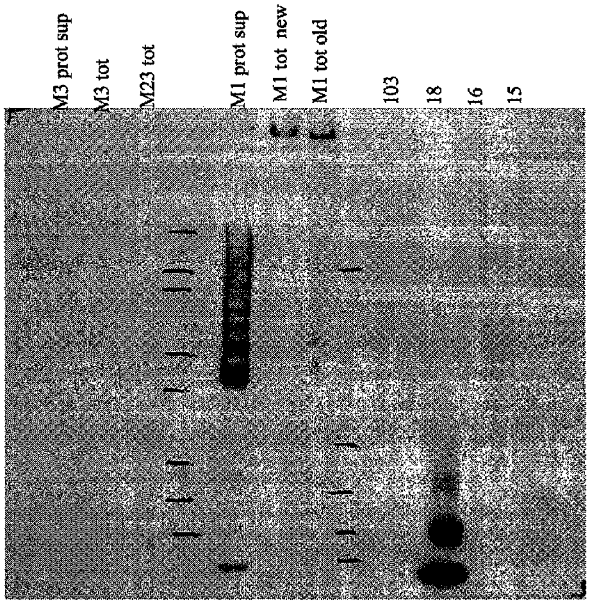
FIG. 96: Western blot analysis of GAS 18 using GAS 18 immune sera.
Figure 97:
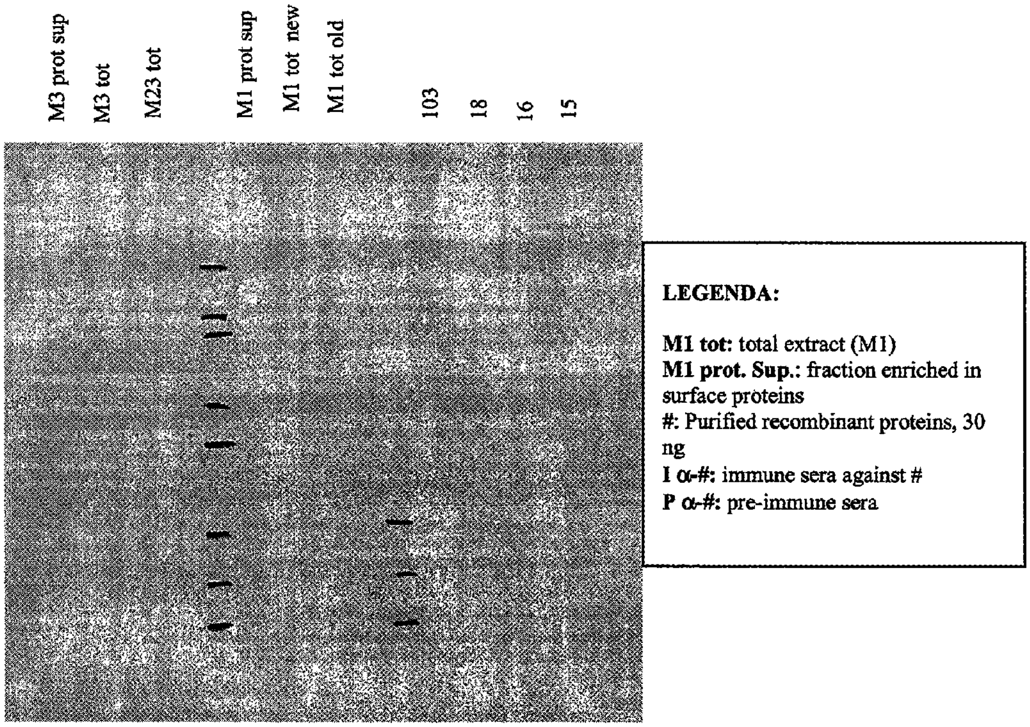
FIG. 97: Western blot analysis of GAS 18 using GAS 18 pre-immune sera.

FIG. 95 provides a Western blot that was probed for GAS 18 protein. While pre-immune sera does not detect GAS M1 expression of GAS 18, anti-GAS 18 immune sera is able to detect GAS 18 protein in GAS M1 extracts enriched for cell surface proteins. The GAS 18 proteins detected in the M1 extracts enriched for surface proteins are present as high molecular weight structures, indicating that GAS 18 may be in an oligomeric (pilus) form. FIG. 96 also shows the results of Western blot analysis of M1 serotype GAS using anti-GAS 18 antisera. The lane that contains GAS M1 extracts enriched for surface proteins (M1 prot sup) show the presence of high molecular weight structures that may be oligomers of GAS 18. FIG. 97 provides an additional Western blot identical to that of FIG. 96, but that was probed with pre-immune sera. As expected, no proteins were detected on this membrane.

FIGS. 102-106 provide additional Western blots to verify the presence of GAS 15, GAS 16, and GAS 18 in high molecular weight structures in GAs. Each Western blot was performed using proteins from a different GAS M1 strain, 2580, 2913, 3280, 3348, and 2719. Each Western blot was probed with antisera raised against each of GAS 15, GAS 16, and GAS 18. As can be seen in FIGS. 102-106, none of the Western blots shows detection of proteins using pre-immune serum (Pα-158, Pα-15, Pα-16, or Pα-18), while each Western blot shows cross-hybridization of the GAS 15 (1α-15), GAS 16 (1α-16), and GAS 18 (1α-18) antisera to high molecular weight structures. Thus, these Western blots confirm that GAS 15, GAS 16, and GAS 18 can be present in pili in GAS M1.

Figure 107:
FIG. 107: Western blot analysis of GAS 15, GAS 16, and GAS 18 in GAS M1 strain SF370.

FIG. 107 provides a similar Western blot performed to detect GAS 15, GAS 16, and GAS 18 proteins in a GAS serotype M1 strain SF370 protein fraction enriched for surface proteins. This Western blot also shows detection of GAS 15 (Anti-15), GAS 16 (Anti-16), and GAS 18 (Anti-18) as high molecular weight structures.

(3) Adhesin Island Sequence within M3, M5 and M18: Gas Adhesin Island 3 ("Gas AI-3")

GAS Adhesin Island sequences within M3, M5, and M18 serotypes are outlined in Tables 6-8 and 10 below. This GAS adhesin island 3 ("GAS AI-3") comprises surface proteins, a SrtC2 sortase, and a Negative transcriptional regulator (Nra) divergently transcribed transcriptional regulator.

GAS AI-3 surface proteins within include a collagen binding protein, a fimbrial protein, a F2 like fibronectin-binding protein. GAS AI-3 surface proteins may also include a hypothetical surface protein. Preferably, each of these GAS AI-3 surface proteins include an LPXTG sortase substrate motif, such as LPXTG (SEQ ID NO:122), VPXTG (SEQ ID NO:137), QVXTG (SEQ ID NO:138) or LPXAG (SEQ ID NO:139).

GAS AI-3 includes a SrtC2 type sortase. GAS SrtC2 type sortases may preferably anchor surface proteins with a QVPTG (SEQ ID NO:140) motif, particularly when the motif is followed by a hydrophobic region and a charged C terminus tail. GAS SrtC2 may be differentially regulated by Nra.

GAS AI-3 may also include a LepA putative signal peptidase I protein.

GAS AI-3 may also include a putative multiple sugar metabolism regulator.

TABLE 6

GAS AI-3 sequences from M3 isolate (MGAS315)

| AI-3 sequence identifier | Sortase substrate sequence or sortase type | Functional description |
|---|---|---|
| SpyM3_0097 | | Negative transcriptional regulator (Nra) |
| SpyM3_0098 | VPXTG SEQ ID NO: 544 | putative collagen binding protein (Cpb) |
| SpyM3_0099 | | LepA putative signal peptidase I |
| SpyM3_0100 | QVXTG SEQ ID NO: 545 | conserved hypothetical protein (fimbrial) |
| SpyM3_0101 | SrtC2 | sortase |
| SpyM3_0102 | LPXAG SEQ ID NO: 546 | hypothetical protein |
| SpyM3_0103 | | putative multiple sugar metabolism regulator |
| SpyM3_0104 | LPXTG SEQ ID NO: 122 | protein F2 like fibronectin-binding protein |

TABLE 7

GAS AI-3 sequence from M3 isolate (SSI-1)

| AI-3 sequence identifier | Sortase Substrate sequence or sortase type | Functional description |
|---|---|---|
| SPs0099 | | Negative transcriptional regulator (Nra) |
| SPs0100 | VPXTG SEQ ID NO: 544 | putative collagen binding protein (Cpb) |
| SPs0101 | | LepA putative signal peptidase I |
| SPs0102 | QVXTG SEQ ID NO: 545 | conserved hypothetical protein (fimbrial) |
| SPs0103 | SrtC2 | sortase |
| SPs0104 | LPXAG SEQ ID NO: 546 | hypothetical protein |
| SPs0105 | | putative multiple sugar metabolism regulator |
| SPs0106 | LPXTG SEQ ID NO: 122 | protein F2 like fibronectin-binding protein |

TABLE 10

GAS AI-3 sequences from M5 isolate (Manfredo)

| AI-3 sequence identifier | Sortase substrate sequence or sortase type | Functional description |
|---|---|---|
| orf77 | | Negative transcriptional regulator (Nra) |

TABLE 10-continued

| GAS AI-3 sequences from M5 isolate (Manfredo) | | |
|---|---|---|
| AI-3 sequence identifier | Sortase substrate sequence or sortase type | Functional description |
| orf78 | VPXTG SEQ ID NO: 544 | putative collagen binding protein (Cpb) |
| orf79 | | LepA putative signal peptidase I |
| orf80 | QVXTG SEQ ID NO: 545 | conserved hypothetical protein (fimbrial) |
| orf81 | SrtC2 | sortase |
| orf82 | LPXAG SEQ ID NO: 546 | hypothetical protein |
| orf83 | | putative multiple sugar metabolism regulator |
| orf84 | LPXTG SEQ ID NO: 122 | protein F2 like fibronectin-binding protein |

TABLE 8

| GAS AI-3 sequences from M18 isolate (MGAS8232) | | |
|---|---|---|
| AI-3 sequence identifier | Sortase substrate sequence or sortase type | Functional description |
| spyM18_0125 | | Negative transcriptional regulator (Nra) (N-terminal fragment) |
| spyM18_0126 | VPXTG SEQ ID NO: 544 | putative collagen binding protein (Cpb) |
| spyM18_0127 | | LepA putative signal peptidase I |
| spyM18_0128 | QVXTG SEQ ID NO: 545 | conserved hypothetical protein (fimbrial) |
| spyM18_0129 | SrtC2 | sortase |
| spyM18_0130 | LPXAG SEQ ID NO: 546 | hypothetical protein |
| spyM18_0131 | | putative multiple sugar metabolism regulator |
| spyM18_0132 | LPXTG SEQ ID NO: 122 | protein F2 like fibronectin-binding protein |

TABLE 44

| GAS AI-3 sequences from M49 isolate (591) | | |
|---|---|---|
| AI-3 sequence identifier | Sortase substrate sequence or sortase type | Functional description |
| SpyoM01000156 | | Negative transcriptional regulator (Nra) |
| SpyoM01000155 | VPXTG SEQ ID NO: 544 | collagen binding protein (Cpa) |
| SpyoM01000154 | | LepA putative signal peptidase I |
| SpyoM01000153 | QVXTG SEQ ID NO: 545 | conserved hypothetical protein (fimbrial) |
| SpyoM01000152 | SrtC2 | sortase |
| SpyoM01000151 | LPXAG SEQ ID NO: 546 | hypothetical protein |
| SpyoM01000150 | | MsmRL |
| SpyoM01000149 | LPXTG SEQ ID NO: 122 | protein F2 like fibronectin-binding protein |

Figure 51:
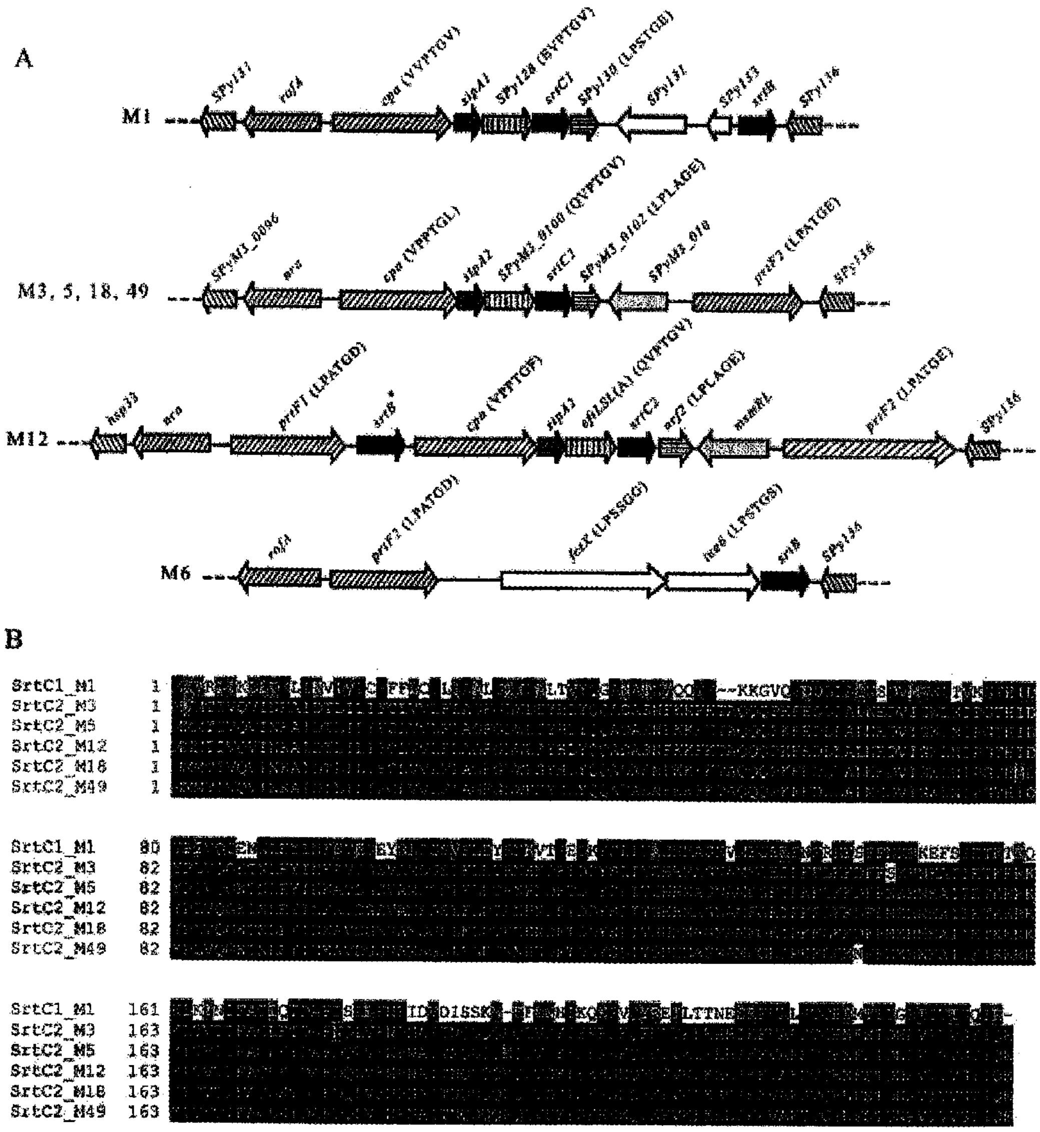
FIG. 51A: Schematic depiction of open reading frames comprising a GAS AI-2 serotype M1 isolate, GAS AI-3 serotype M3, M5, M18, and M49 isolates, a GAS AI-4 serotype M12 isolate, and an GAS AI-1 serotype M6 isolate. M1 cpa, SEQ ID NO:526; M1 Spy128, SEQ ID NO:527; M1 Spy130, SEQ ID NO:528; M3, 5, 18, 49 cpa, SEQ ID NO:529; M3, 5, 18, 49 SpyM3_0100, SEQ ID NO:530; M3, 5, 18, 49 prtF2, SEQ ID NO:532; M12 prtF1, SEQ ID NO:533; M12 cpa, SEQ ID NO:534; M12 eft, SEQ ID NO:535; M12 orf2, SEQ ID NO:536; M12 prtF2, SEQ ID NO:537; M6 prtF2, SEQ ID NO:538; M6 fctX, SEQ ID NO:539; and M6 tee6, SEQ ID NO:540.
FIG. 51B: Amino acid alignment of SrtC1-type sortase of a GAS AI-2 serotype M1 isolate (SEQ ID NO:322), SrtC2-type sortases of serotype M3 (SEQ ID NO:323), M5 (SEQ ID NO:324), M18 (SEQ ID NO:326), and M49 (SEQ ID NO:327) isolates, and a SrtC2-type sortase of a GAS AI-4 serotype M12 isolate (SEQ ID NO:325).

A schematic of AI-3 serotypes M3, M5, M 18, and M49 is shown in FIG. 51A. Each contains an open reading frame encoding a SrtC2-type sortase of nearly identical amino acid sequence. See FIG. 52B for an amino acid sequence alignment for each of the SrtC2 amino acid sequences.

The protein F2-like fibronectin-binding protein of each these type 3 adhesin islands contains a pilin motif and an E-box. FIG. 60 indicates the amino acid sequence of the pilin motif and E-box of each of GAS AI-3 serotype M3 MGAS315 (SpyM3__0104/21909640), GAS AI-3 serotype M3 SSI (Sps0106/28895018), GAS AI-3 serotype M18 (SpyM18__0132/19745307), and GASAI-3 serotype M5 (orf84).

Figure 80:
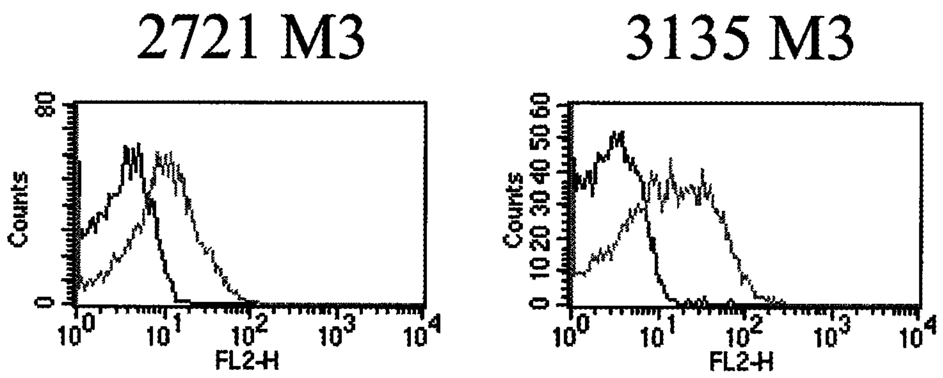
FIG. 80: FACS analysis of GAS serotype M3 for spyM3__0098 surface expression.

FACS analysis has confirmed that the GAS AI-3 surface proteins SpyM3__0098, SpyM3__0100, SpyM3__0102, and SpyM3__0104 are expressed on the surface of GAs. FIG. 80 provides the results of FACS analysis for surface expression of SpyM3__0098 on each of GAS serotypes M3 2721 and M3 3135. A shift in fluorescence is observed for each GAS serotype when anti-SpyM3__0098 antiserum is present, demonstrating cell surface expression. Table 25, below, quantitatively summarizes the FACS fluorescence values obtained for each GAS serotype in the presence of pre-immune antiserum, anti-SpyM3__0098 antiserum, and the difference in fluorescence value between the pre-immune and anti-SpyM3__0098 antiserum.

TABLE-US-00026 TABLE 25 Summary of FACS values for surface expression of SpyM3__0098 2721 3135 Pre-Anti-Pre-Anti-immune spyM3__0098 Change immune spyM3__0098 Change 117.85 249.51 132 99.17 277.21 178

Figure 81:
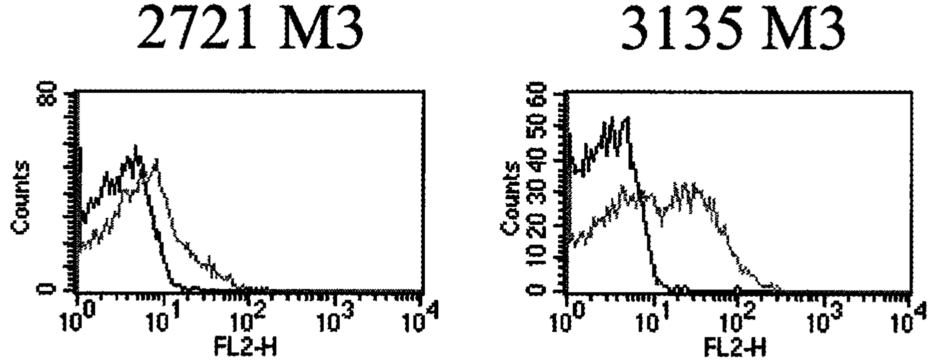
FIG. 81: FACS analysis of GAS serotype M3 for spyM3__0100 surface expression.

FIG. 81 provides the results of FACS analysis for surface expression of SpyM3__0100 on each of GAS serotypes M3 2721 and M3 3135. A shift in fluorescence is observed for each GAS serotype when anti-SpyM3__0100 antiserum is present, demonstrating cell surface expression. Table 26, below, quantitatively summarizes the FACS fluorescence values obtained for each GAS serotype in the presence of pre-immune antiserum, anti-SpyM3_0100 antiserum, and the difference in fluorescence value between the pre-immune and anti-SpyM3_0100 antiserum.

TABLE 25

Summary of FACS values for surface expression of SpyM3_0098

| 2721 | | | 3135 | | |
|---|---|---|---|---|---|
| Pre-immune | Anti-spyM3_0098 | Change | Pre-immune | Anti-spyM3_0098 | Change |
| 117.85 | 249.51 | 132 | 99.17 | 277.21 | 178 |

Figure 82:
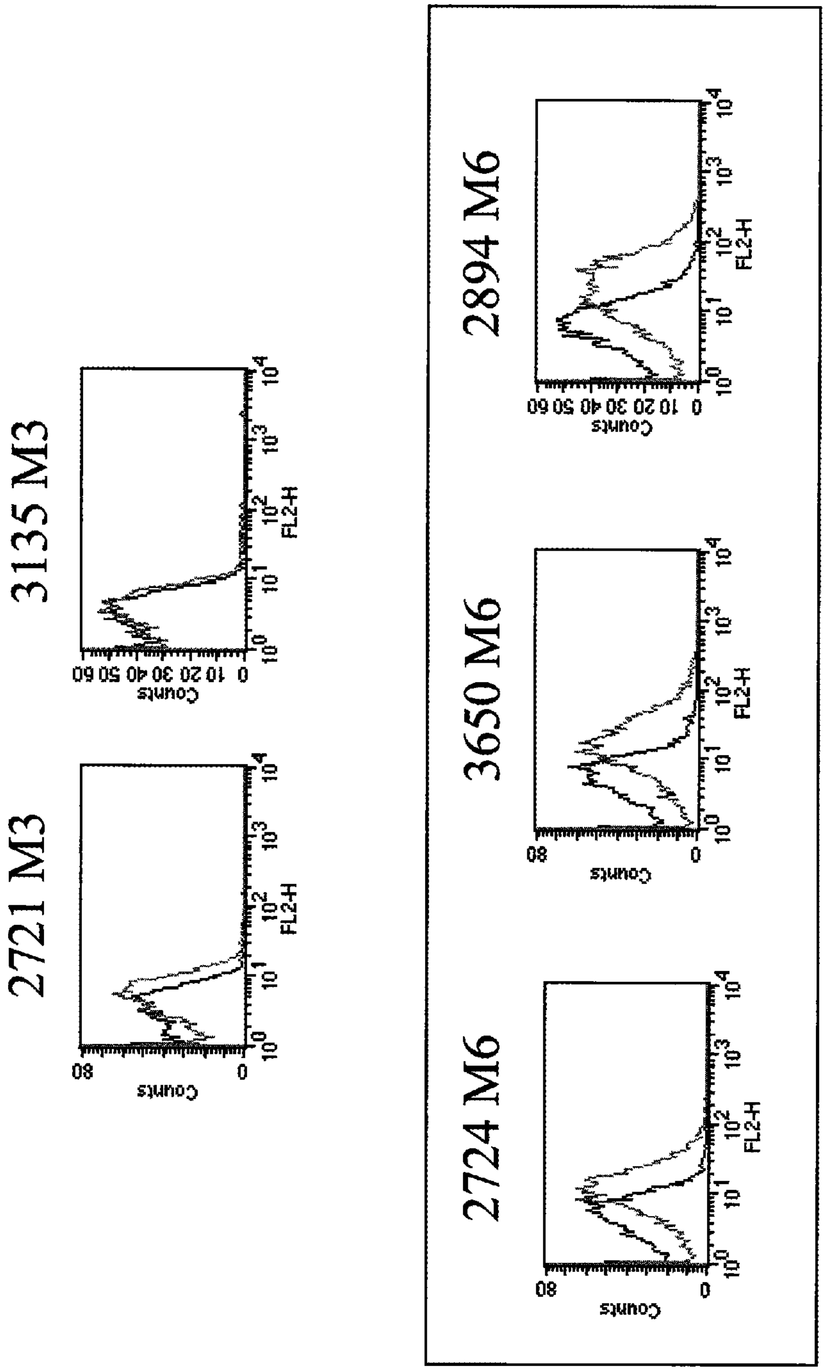
FIG. 82: FACS analysis of GAS serotype M3 for spyM3__0102 surface expression.

FIG. 82 provides the results of FACS analysis for surface expression of SpyM3_0102 on each of GAS serotypes M3 2721 and M3 3135. A shift in fluorescence is observed for each GAS serotype when anti-SpyM3_0102 antiserum is present, demonstrating cell surface expression. Table 27, below, quantitatively summarizes the FACS fluorescence values obtained for each GAS serotype in the presence of pre-immune antiserum, anti-SpyM3_0102 antiserum, and the difference in fluorescence value between the pre-immune and anti-SpyM3_0102 antiserum.

TABLE 27

Summary of FACS values for surface expression of SpyM3_0102 in M3 serotypes

| 2721 | | | 3135 | | |
|---|---|---|---|---|---|
| Pre-immune | Anti-spyM3_0102 | Change | Pre-immune | Anti-spyM3_0102 | Change |
| 109.86 | 155.26 | 45 | 100.02 | 112.58 | 13 |

FIG. 82 also provides the results of FACS analysis for surface expression of a pilin antigen that has homology to SpyM3_0102 identified in a different GAS serotype, M6. FACS analysis conducted with the SpyM3_0102 antisera was able to detect surface expression of the homologous SpyM3_0102 antigen on each of GAS serotypes M6 2724, M6 3650, and M6 2894. Table 28, below, quantitatively summarizes the FACS fluorescence values obtained for each GAS serotype in the presence of pre-immune antiserum, anti-SpyM3_0102 antiserum, and the difference in fluorescence value between the pre-immune and anti-SpyM3_0102 antiserum.

TABLE 28

Summary of FACS values for surface expression of SpyM3_0102 in M6 serotypes

| 2724 | | | 3650 | | | 2894 | | |
|---|---|---|---|---|---|---|---|---|
| Pre-immune | Anti-spyM3_0102 | Change | Pre-immune | Anti-spyM3_0102 | Change | Pre-immune | Anti-spyM3_0102 | Change |
| 146.59 | 254.03 | 107 | 162.56 | 294.03 | 131 | 175.49 | 313.69 | 138 |

Figure 109:
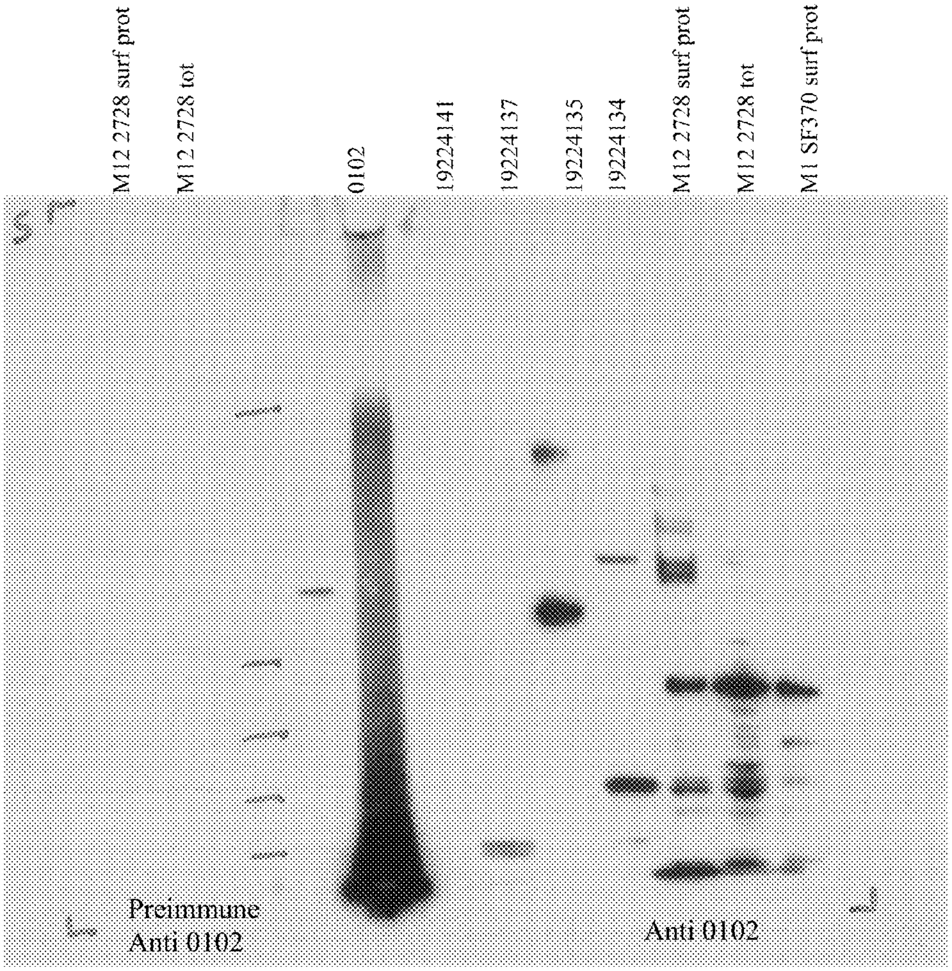
FIG. 109: Western blot analysis of 19224139 in GAS M12 strain 2728 using antisera raised against SpyM3__0102.

SpyM3_0102 is also homologous to pilin antigen 19224139 of GAS serotype M12. Antisera raised against SpyM3_0102 is able to detect high molecular weight structures in GAS serotype M12 strain 2728 protein fractions enriched for surface proteins, which would contain the 19224139 antigen. See FIG. 109 at the lane labelled M112 2728 surf prot.

Figure 83:
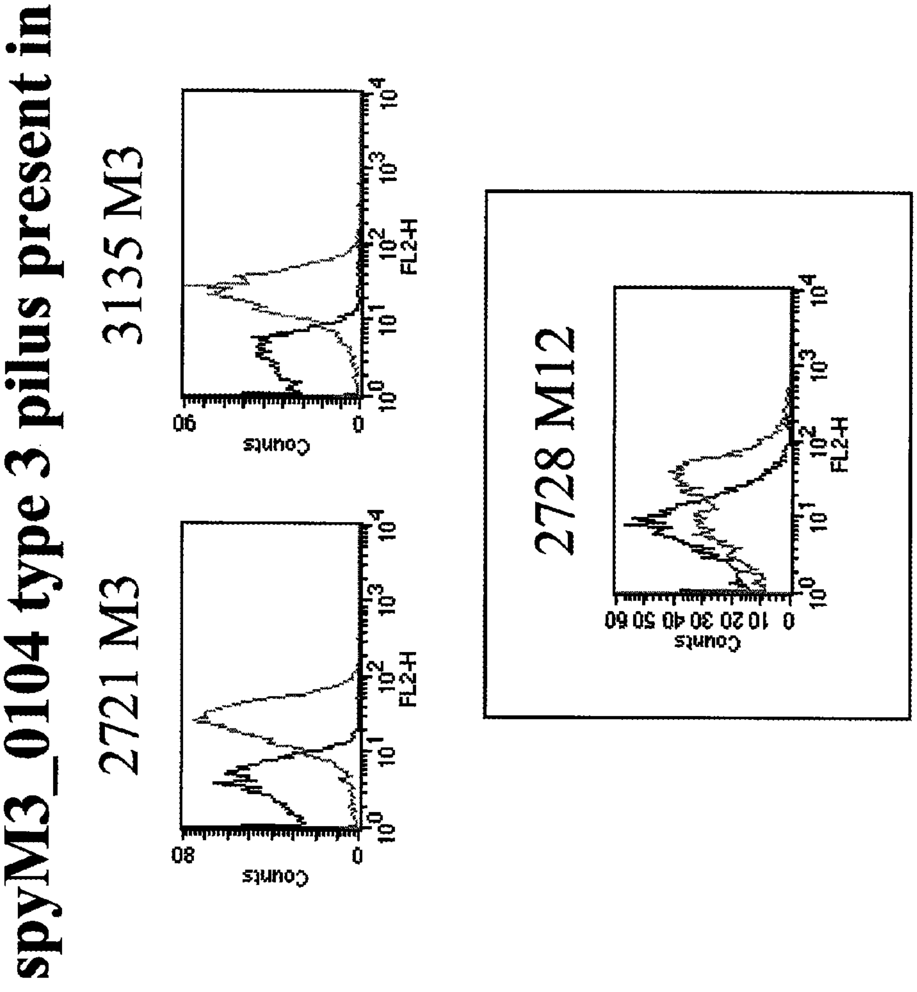
FIG. 83: FACS analysis of GAS serotype M3 for spyM3__0104 surface expression.

FIG. 83 provides the results of FACS analysis for surface expression of SpyM3_0104 on each of GAS serotypes M3 2721 and M3 3135. A shift in fluorescence is observed for each GAS serotype when anti-SpyM3_0104 antiserum is present, demonstrating cell surface expression. Table 29, below, quantitatively summarizes the FACS fluorescence values obtained for each GAS serotype in the presence of pre-immune antiserum, anti-SpyM3_0104 antiserum, and the difference in fluorescence value between the pre-immune and anti-SpyM3_0104 antiserum.

TABLE 29

Summary of FACS values for surface expression of SpyM3_0104 in M3 serotypes

| 2721 | | | 3135 | | |
|---|---|---|---|---|---|
| Pre-immune | Anti-spyM3_0104 | Change | Pre-immune | Anti-spyM3_0104 | Change |
| 128.45 | 351.65 | 223 | 105.1 | 339.88 | 235 |

FIG. 83 also provides the results of FACS analysis for surface expression of a pilin antigen that has homology to SpyM3_0104 identified in a different GAS serotype, M12. FACS analysis conducted with the SpyM3_0104 antisera was able to detect surface expression of the homologous SpyM3_0104 antigen on GAS serotype M12 2728. Table 30, below, quantitatively summarizes the FACS fluorescence values obtained for this GAS serotype in the presence of pre-immune antiserum, anti-SpyM3_0104 antiserum, and the difference in fluorescence value between the pre-immune and anti-SpyM3_0104 antiserum.

TABLE 30

Summary of FACS values for surface expression of SpyM3_0104 in an M12 serotype 2728

| Pre-immune | Anti-spyM3_0104 | Change |
|---|---|---|
| 198.57 | 288.75 | 90 |

Figure 84:
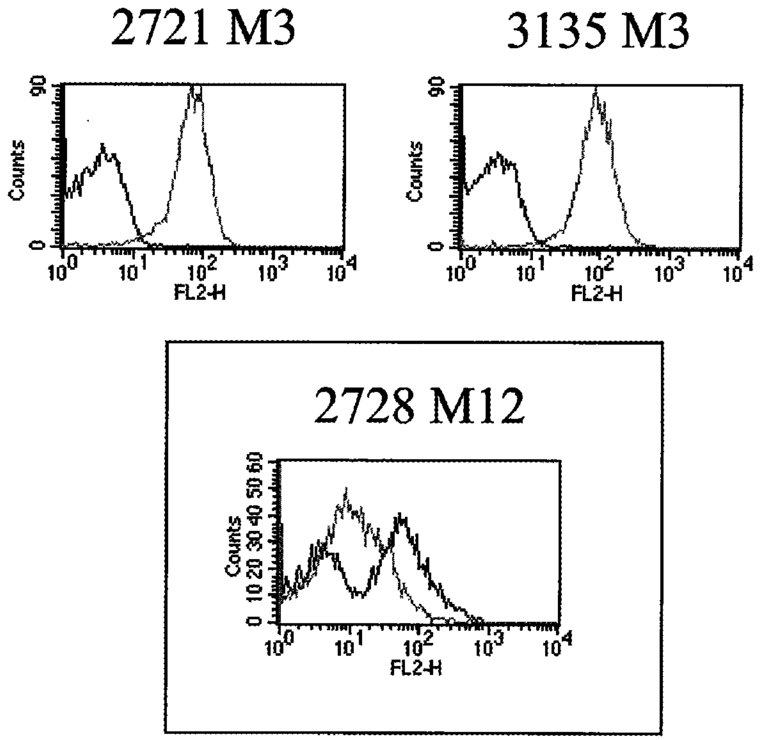
FIG. 84: FACS analysis of GAS serotype M3 for spyM3__0106 surface expression.

FIG. 84 provides the results of FACS analysis for surface expression of SPs_0106 on each of GAS serotypes M3 2721 and M3 3135. A shift in fluorescence is observed for each GAS serotype when anti-SPs_0106 antiserum is present, demonstrating cell surface expression. Table 31, below, quantitatively summarizes the FACS fluorescence values obtained for each GAS serotype in the presence of pre-immune antiserum, anti-SPs_0106 antiserum, and the difference in fluorescence value between the pre-immune and anti-SPs0106 antiserum.

TABLE 31

Summary of FACS values for surface expression of SPs_0106 in M3 serotypes

| 2721 | | | 3135 | | |
|---|---|---|---|---|---|
| Pre-immune | Anti-SPs_0106 | Change | Pre-immune | Anti-SPs_0106 | Change |
| 116 | 463.28 | 347 | 103.02 | 494.27 | 391 |

FIG. 84 also provides the results of FACS analysis for surface expression of a pilin antigen that has homology to SPs_0106 identified in a different GAS serotype, M12. FACS analysis conducted with the SPs_0106 antisera was able to detect surface expression of the homologous SPs_0106 antigen on GAS serotype M12 2728. Table 32, below, quantitatively summarizes the FACS fluorescence values obtained for each GAS serotype in the presence of pre-immune antiserum, anti-SPs_0106 antiserum, and the difference in fluorescence value between the pre-immune and anti-SPs_0106 antiserum.

TABLE 32

Summary of FACS values for surface expression of SPs_0106 in an M12 serotype 2728

| Pre-immune | Anti-SPs_0106 | Change |
|---|---|---|
| 304.01 | 254.64 | −49 |

(4) Adhesin Island Sequence within M12: GAS Adhesin Island 4 ("GAS Ai-4")

GAS Adhesin Island sequences within M12 serotype are outlined in Table 11 below. This GAS adhesin island 4 ("GAS AI-4") comprises surface proteins, a SrtC2 sortase, and a RofA regulatory protein.

GAS AI-4 surface proteins within may include a fimbrial protein, an F or F2 like fibronectin-binding protein, and a capsular polysaccharide adhesion protein (Cpa). GAS AI-4 surface proteins may also include a hypothetical surface protein in an open reading frame (orf). Preferably, each of the GAS AI-4 surface proteins include an LPXTG sortase substrate motif, such as LPXTG (SEQ ID NO:122), VPXTG (SEQ ID NO:137), QVXTG (SEQ ID NO:138) or LPXAG (SEQ ID NO:139).

GAS AI-4 includes a SrtC2 type sortase. GAS SrtC2 type sortases may preferably anchor surface proteins with a QVPTG (SEQ ID NO:140) motif, particularly when the motif is followed by a hydrophobic region and a charged C terminus tail.

GAS AI-4 may also include a LepA putative signal peptidase I protein and a MsmRL protein.

TABLE 11

GAS AI-4 sequences from M12 isolate (A735)

| AI-4 sequence identifier | Sortase substrate sequence or sortase type | Functional description |
|---|---|---|
| 19224133 | | RofA regulatory protein |
| 19224134 | LPXTG | protein F |
| | SrtB | SrtB (**stop codon***) |
| 19224135 | VPXTG | Cpa |
| 19224136 | | LepA |
| 19224137 | QVXTG | EftLSL.A (fimbrial) |
| 19224138 | SrtC2 | EftLSL.B |
| 19224139 | LPXAG | Orf2 |
| 19224140 | | MsmRL |
| 19224141 | LPXTG | protein F2 |

A schematic of AI-4 serotype M12 is shown in FIG. 51A. One of the open reading frames encodes a SrtC2-type sortase having an amino acid sequence nearly identical to the amino acid sequence of the SrtC2-type sortase of the AI-3 serotypes described above. See FIG. 52B for an amino acid sequence alignment for each of the SrtC2 amino acid sequences.

Other proteins encoded by the open reading frames of the AI-4 serotype M12 are homologous to proteins encoded by other known adhesin islands in *S. pyogenes*, as well as the GAS AI-3 serotype M5 (Manfredo). FIG. 52 is an amino acid alignment of the capsular polysaccharide adhesion protein (cpa) of AI-4 serotype M112 (19224135), GAS AI-3 serotype M5 (ORF78), *S. pyogenes* strain MGAS315 serotype M3 (21909634), *S. pyogenes* SSI-1 serotype M3 (28810257), *S. pyogenes* MGAS8232 serotype M3 (19745301), and GAS AI-2 serotype M1 (GAS15). The amino acid sequence of the AI-4 serotype M12 cpa shares a high degree of homology with other cpa proteins.

FIG. 53 shows that the F-like fibronectin-binding protein encoded by the AI-4 serotype M12 open frame (19224134) shares homology with a F-like fibronectin-binding protein found in *S. pyogenes* strain MGAS10394 serotype M6 (50913503).

FIG. 54 is an amino acid sequence alignment that illustrates that the F2-like fibronectin-binding protein of AI-4 serotype M12 (19224141) shares homology with the F2-like fibronectin-binding protein of *S. pyogenes* strain MGAS8232 serotype M3 (19745307), GAS AI-3 serotype M5 (ORF84), *S. pyogenes* strain SSI serotype M3 (28810263), and *S. pyogenes* strain MGAS315 serotype M3 (21909640).

FIG. 55 is an amino acid sequence alignment that illustrates that the fimbrial protein of AI-4 serotype M12 (19224137) shares homology with the fimbrial protein of GAS AI-3 serotype M5 (ORF80), and the hypothetical protein of *S. pyogenes* strain MGAS315 serotype M3 (21909636), *S. pyogenes* strain SSI serotype M3 (28810259), *S. pyogenes* strain MGAS8732 serotype M3 (19745303), and *S. pyogenes* strain M1 GAS serotype M1 (13621428).

FIG. 56 is an amino acid sequence alignment that illustrates that the hypothetical protein of GAS AI-4 serotype M12 (19224139) shares homology with the hypothetical protein of *S. pyogenes* strain MGAS315 serotype M3 (21909638), *S. pyogenes* strain SSI-1 serotype M3 (28810261), GAS AI-3 serotype M5 (ORF82), and *S. pyogenes* strain MGAS8232 serotype M3 (19745305).

The protein F2-like fibronectin-binding protein of the type 4 adhesin island also contains a highly conserved pilin motif and an E-box. FIG. 60 indicates the amino acid sequence of the pilin motif and E-box in AI-4 serotype M12.

Figure 85:
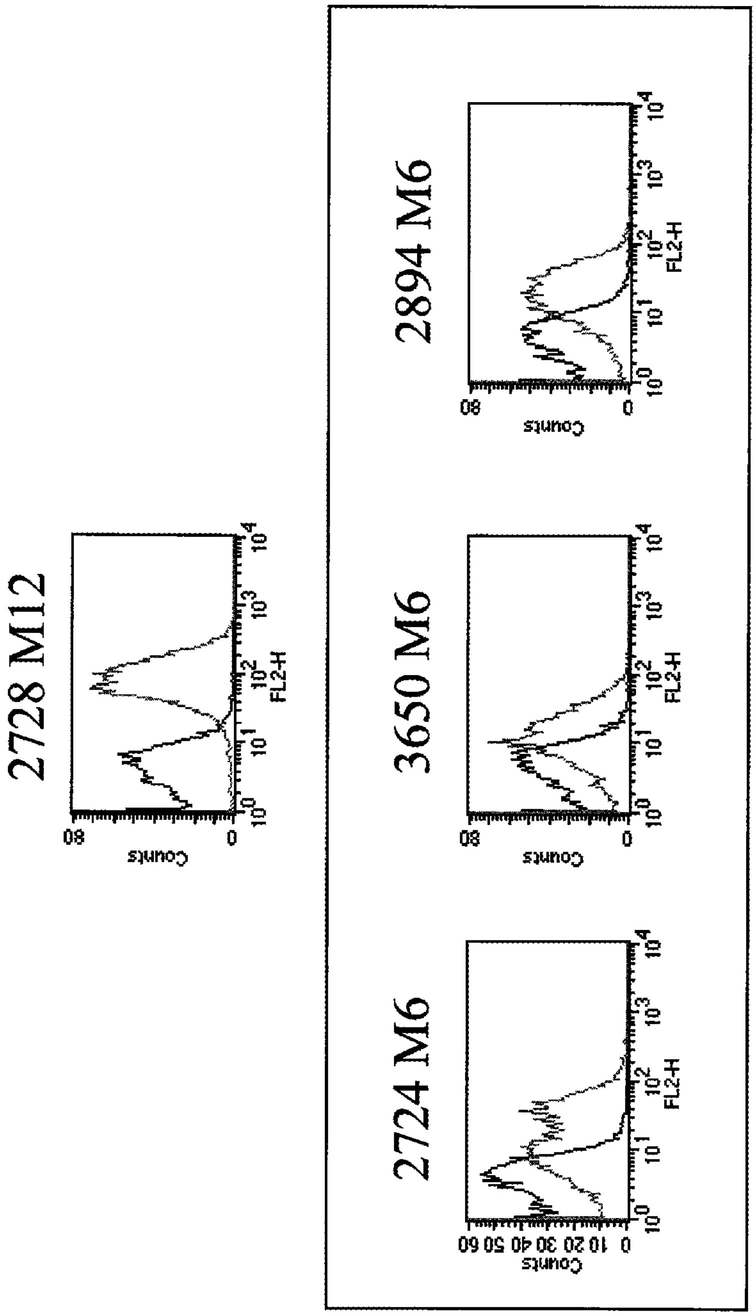
FIG. 85: FACS analysis of GAS serotype M12 for 19224134 surface expression.

FACS analysis has confirmed that the GAS AI-4 surface proteins 19224134, 19224135, 19224137, and 19224141 are expressed on the surface of GAs. FIG. 85 provides the results of FACS analysis for surface expression of 19224134 on GAS serotype M12 2728. A shift in fluorescence is observed when anti-19224134 antiserum is present, demonstrating cell surface expression. Table 33, below, quantitatively summarizes the FACS fluorescence values obtained for GAS serotype M12 2728 in the presence of pre-immune antiserum, anti-19224134 antiserum, and the difference in fluorescence value between the pre-immune and anti-19224134 antiserum.

TABLE 33

| Summary of FACS values for surface expression of 19224134 in an M12 serotype 2728 | | |
|---|---|---|
| Pre-immune | Anti-19224134 | Change |
| 137.8 | 485.32 | 348 |

FIG. 85 also provides the results of FACS analysis for surface expression of a pilin antigen that has homology to 19224134 identified in a different GAS serotype, M6. FACS analysis conducted with the 19224134 antisera was able to detect surface expression of the homologous 19224134 antigen on each of GAS serotypes M6 2724, M6 3650, and M6 2894. Table 34, below, quantitatively summarizes the FACS fluorescence values obtained for each GAS serotype in the presence of pre-immune antiserum, anti-19224134 antiserum, and the difference in fluorescence value between the pre-immune and anti-19224134 antiserum.

TABLE 34

| Summary of FACS values for surface expression of 19224134 in M6 serotypes | | | | | | | | |
|---|---|---|---|---|---|---|---|---|
| 2724 | | | 3650 | | | 2894 | | |
| Pre-immune | Anti-19224134 | Change | Pre-immune | Anti-19224134 | Change | Pre-immune | Anti-19224134 | Change |
| 123.58 | 264.59 | 141 | 140.82 | 262.64 | 122 | 135.4 | 307.25 | 172 |

Figure 86:
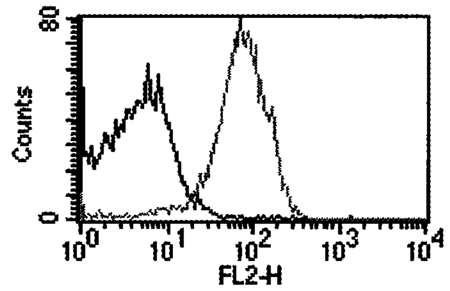
FIG. 86: FACS analysis of GAS serotype M12 for 19224135 surface expression.

FIG. 86 provides the results of FACS analysis for surface expression of 19224135 on GAS serotype M12 2728. A shift in fluorescence is observed when anti-19224135 antiserum is present, demonstrating cell surface expression. Table 35, below, quantitatively summarizes the FACS fluorescence values obtained for GAS serotype M12 2728 in the presence of pre-immune antiserum, anti-19224135 antiserum, and the difference in fluorescence value between the pre-immune and anti-19224135 antiserum.

TABLE 35

| Summary of FACS values for surface expression of 19224135 in an M12 serotype 2728 | | |
|---|---|---|
| Pre-immune | Anti-19224135 | Change |
| 151.38 | 471.95 | 321 |

Figure 87:
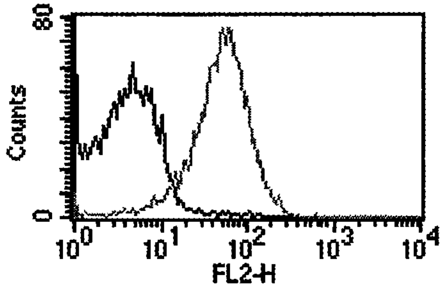
FIG. 87: FACS analysis of GAS serotype M12 for 19224137 surface expression.

FIG. 87 provides the results of FACS analysis for surface expression of 19224137 on GAS serotype M12 2728. A shift in fluorescence is observed when anti-19224137 antiserum is present, demonstrating cell surface expression. Table 36, below, quantitatively summarizes the FACS fluorescence values obtained for GAS serotype M12 2728 in the presence of pre-immune antiserum, anti-19224137 antiserum, and the difference in fluorescence value between the pre-immune and anti-19224137 antiserum.

TABLE 36

| Summary of FACS values for surface expression of 19224137 in an M12 serotype 2728 | | |
|---|---|---|
| Pre-immune | Anti-19224137 | Change |
| 140.44 | 433.25 | 293 |

Figure 88:
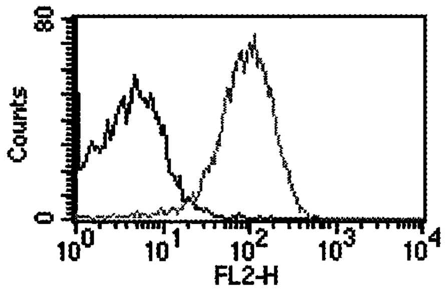
FIG. 88: FACS analysis of GAS serotype M12 for 19224141 surface expression.

FIG. 88 provides the results of FACS analysis for surface expression of 19224141 on GAS serotype M12 2728. A shift in fluorescence is observed when anti-19224141 antiserum is present, demonstrating cell surface expression. Table 37, below, quantitatively summarizes the FACS fluorescence values obtained for GAS serotype M12 2728 in the presence of pre-immune antiserum, anti-19224141 antiserum, and the difference in fluorescence value between the pre-immune and anti-19224141 antiserum.

TABLE 37

| Summary of FACS values for surface expression of 19224141 in an M12 serotype 2728 | | |
|---|---|---|
| Pre-immune | Anti-19224141 | Change |
| 147.02 | 498 | 351 |

19224139 (designated as orf2) may also be expressed on the surface of GAS serotype M12 bacteria. FIG. 175 shows the results of FACS analysis for surface expression of 19224139 on M12 strain 2728. A slight shift in fluorescence is observed, which demonstrates that some 19224139 may be expressed on the GAS cell surface.

Figure 99:
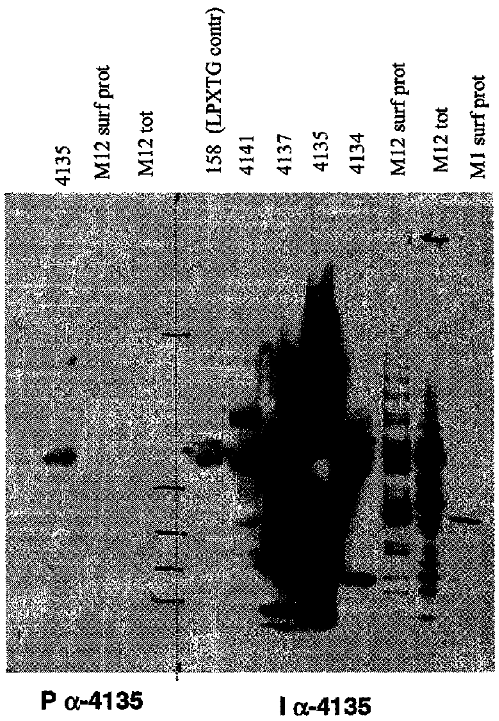
FIG. 99: Western blot analysis of 19224135 expression on M12 GAS bacteria.
Figure 108:
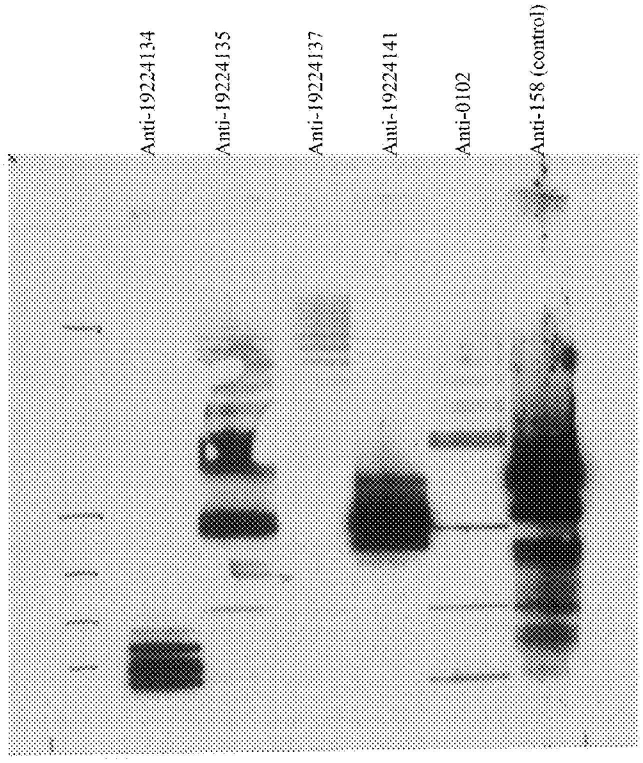
FIG. 108: Western blot analysis of 19224135 and 19224137 in GAS M12 strain 2728.

Surface expression of 19224135 on M12 serotype GAS has also been confirmed by Western blot analysis. FIG. 99 shows that while pre-immune sera (P $\alpha$-4135) does not detect GAS M12 expression of 19224135, anti-19224135 immune sera (I $\alpha$-4135) is able to detect 19224135 protein in both total GAS M12 extracts (M12 tot) and GAS M12 fractions enriched for cell surface proteins (M12 surf prot). The 19224135 proteins detected in the total GAS M12 extracts or the GAS M12 extracts enriched for surface proteins are also present as high molecular weight structures, indicating that 19224135 may be in an oligomeric (pilus) form. See also FIG. 108, which provides a further Western blot showing that anti-19224135 antiserum (Anti-19224135) immunoreacts with high molecular weight structures in GAS M12 strain 2728 protein extracts enriched for surface proteins.

Figure 100:
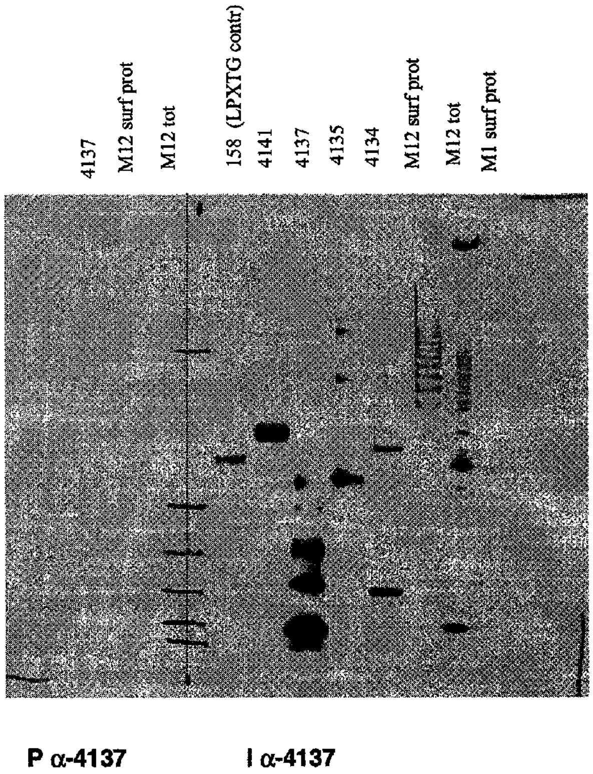
FIG. 100: Western blot analysis of 19224137 expression on M12 GAS bacteria.
Figure 102:
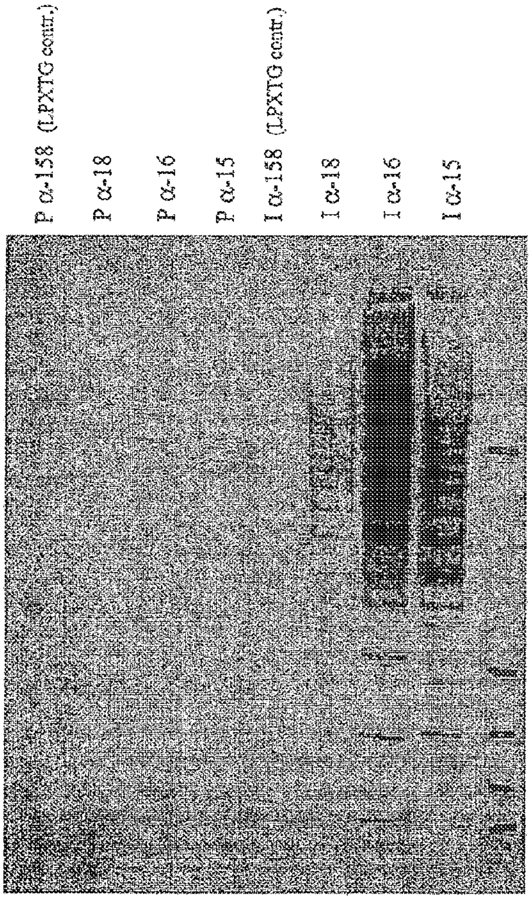
FIG. 102: Western blot analysis of GAS 15, GAS 16, and GAS 18 in GAS M1 strain 2580.
Figure 103:
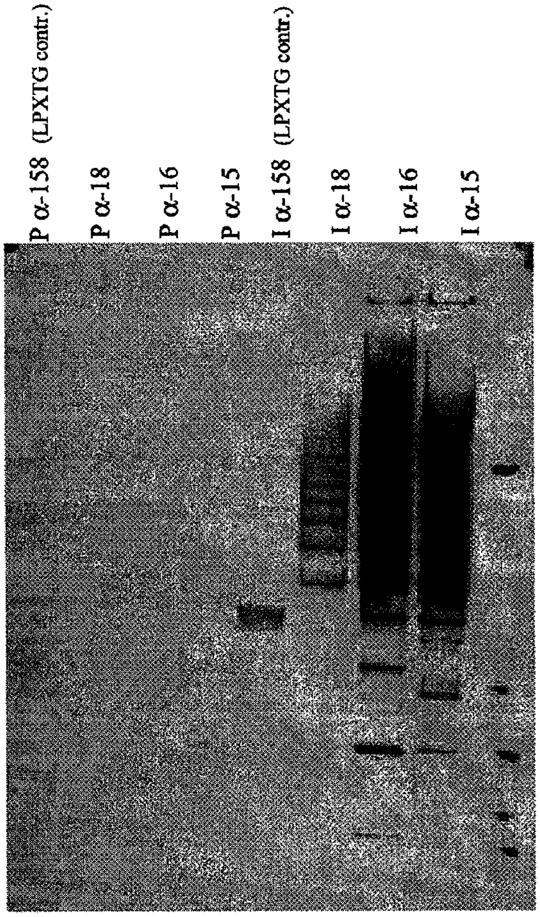
FIG. 103: Western blot analysis of GAS 15, GAS 16, and GAS 18 in GAS M1 strain 2913.
Figure 104:
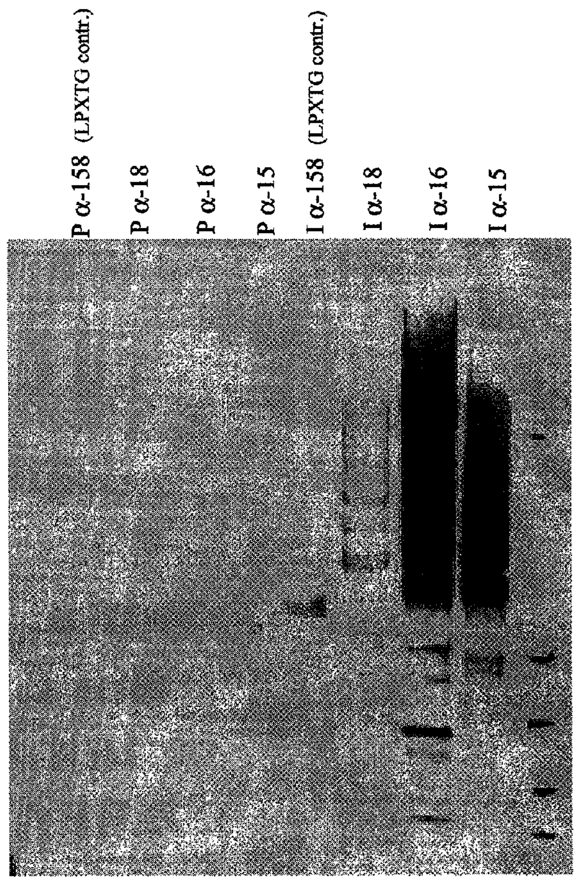
FIG. 104: Western blot analysis of GAS 15, GAS 16, and GAS 18 in GAS M1 strain 3280.
Figure 105:
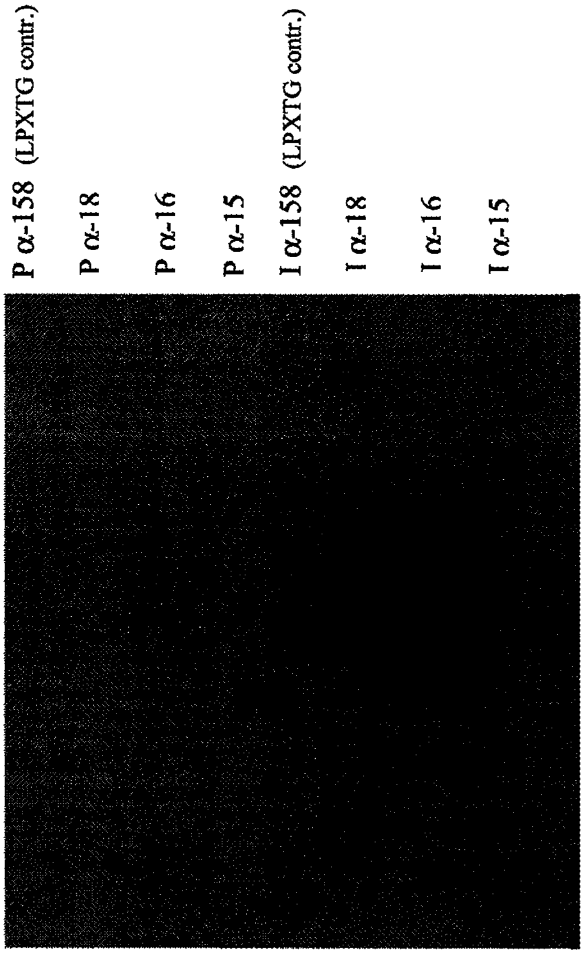
FIG. 105: Western blot analysis of GAS 15, GAS 16, and GAS 18 in GAS M1 strain 3348.
Figure 106:
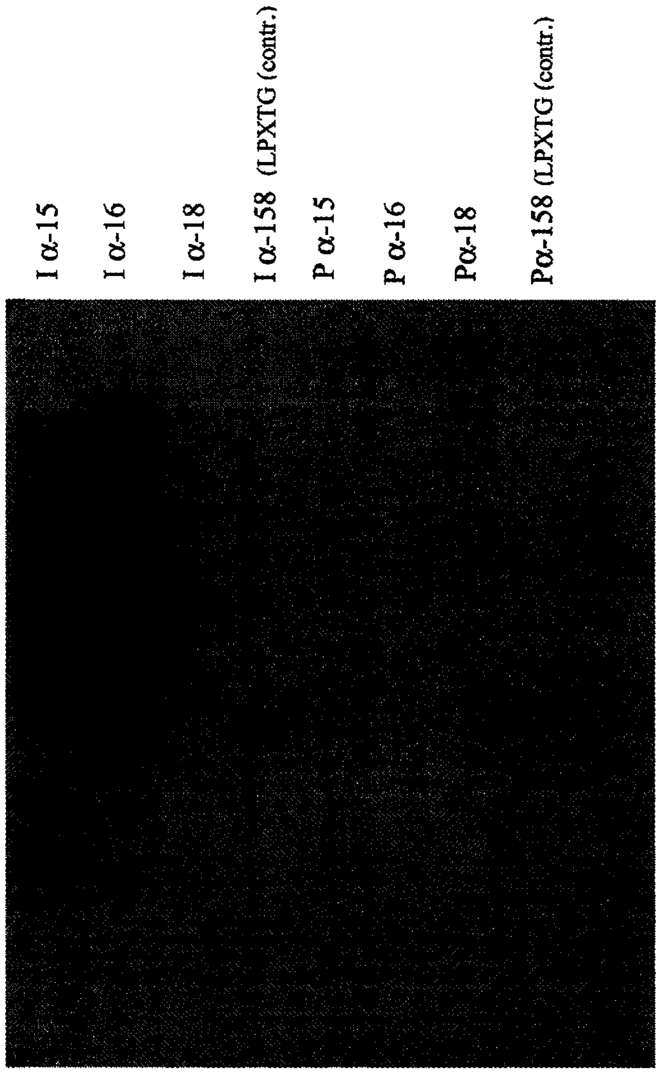
FIG. 106: Western blot analysis of GAS 15, GAS 16, and GAS 18 in GAS M1 strain 2719.

Surface expression of 19224137 on M12 serotype GAS has also been confirmed by Western blot analysis. FIG. 100 shows that while pre-immune sera (P α-4137) does not detect GAS M12 expression of 19224137, anti-19224137 immune sera (I α-4137) is able to detect 19224137 protein in both total GAS M12 extracts (M12 tot) and GAS M12 fractions enriched for cell surface proteins (M12 surf prot). The 19224137 proteins detected in the total GAS M12 extracts or the GAS M12 extracts enriched for surface proteins are also present as high molecular weight structures, indicating that 19224137 may be in an oligomeric (pilus) form. See also FIG. 108, which provides a further Western blot showing that anti-19224137 antiserum (Anti-19224137) immunoreacts with high molecular weight structures in GAS M12 strain 2728 protein extracts enriched for surface proteins.

*Streptococcus pneumoniae*

Adhesin island sequences can be identified in *Streptococcus pneumoniae* genomes. Several of these genomes include the publicly available *Streptococcus pneumoniae* TIGR4 genome or *Streptococcus pneumoniae* strain 670 genome. Examples of these *S. pneumoniae* AI sequence are discussed below.

*S. pneumoniae* Adhesin Islands generally include a series of open reading frames within a *S. pneumoniae* genome that encode for a collection of surface proteins and sortases. A *S. pneumoniae* Adhesin Island may encode for amino acid sequences comprising at least one surface protein. Alternatively, an *S. pneumoniae* Adhesin Island may encode for at least two surface proteins and at least one sortase. Preferably, a *S. pneumoniae* Adhesin Island encodes for at least three surface proteins and at least two sortases. One or more of the surface proteins may include an LPXTG motif (such as LPXTG (SEQ ID NO:122)) or other sortase substrate motif. One or more *S. pneumoniae* AI surface proteins may participate in the formation of a pilus structure on the surface of the *S. pneumoniae* bacteria.

*S. pneumoniae* Adhesin Islands of the invention preferably include a divergently transcribed transcriptional regulator. The transcriptional regulator may regulate the expression of the *S. pneumoniae* AI operon.

The *S. pneumoniae* AI surface proteins may bind or otherwise adhere to fibrinogen, fibronectin, or collagen.

A schematic of the organization of a *S. pneumoniae* AI locus is provided in FIG. 137. The locus comprises open reading frames encoding a transcriptional regulator (rlrA), cell wall surface proteins (rrgA, rrgB, rrgc), and sortases (srtB, srtC, srtD). FIG. 137 also indicates the *S. pneumoniae* strain TIGR4 gene name corresponding to each of these open reading frames.

Tables 9 and 38 identify the genomic location of each of these open reading frames in *S. pneumoniae* strains TIGR4 and 670, respectively.

TABLE 9

*S. pneumoniae* AI sequences from TIGR4

| Genomic Location | Strand | Length | PID | Synonym (AI Sequence Identifier) | Functional description |
|---|---|---|---|---|---|
| 436302 . . . 437831 | – | 509 | 15900377 | SP0461 | transcriptional regulator |
| 438326 . . . 441007 | + | 893 | 15900378 | SP0462 | cell wall surface anchor family protein |
| 441231 . . . 443228 | + | 665 | 15900379 | SP0463 | cell wall surface anchor family protein |
| 443275 . . . 444456 | + | 393 | 15900380 | SP0464 | cell wall surface anchor family protein |
| 444675 . . . 444806 | – | 43 | 15900381 | SP0465 | hypothetical protein |
| 444857 . . . 445696 | + | 279 | 15900382 | SP0466 | sortase |
| 445791 . . . 446576 | + | 261 | 15900383 | SP0467 | sortase |
| 446563 . . . 447414 | + | 283 | 15900384 | SP0468 | sortase |

TABLE 38

*S. pneumoniae* strain 670 AI sequences

| Genomic Location | Strand | AI Sequence Identifier\ | Functional description |
|---|---|---|---|
| 4383-5645 | – | Orf1_670 | IS1167, transposase |
| 5910-7439 | – | Orf2_670 | transcriptional regulator, putative |
| 7934-10606 | + | Orf3_670 | cell wall surface anchor family protein |
| 10839-12773 | + | Orf4_670 | cell wall surface anchor family protein |
| 12796-14001 | + | Orf5_670 | cell wall surface anchor family protein |
| 14327-15241 | + | Orf6_670 | sortase, putative |
| 15336-16121 | + | Orf7_670 | sortase, putative |
| 16108-16959 | + | Orf8_670 | sortase, putative |

The full-length nucleotide sequence of the *S. pneumoniae* strain 670 μl is also shown in FIG. 101, as is its translated amino acid sequence.

At least eight other *S. pneumoniae* strains contain an adhesin island locus described by the locus depicted in FIG. 137. These strains were identified by an amplification analysis. The genomes of different *S. pneumoniae* strains were amplified with eleven separate sets of primers. The sequence of each of these primers is provided below in Table 41.

TABLE 41

| Sequences of primers used to amplify AI locus | | |
|---|---|---|
| Primer Pair | Forward Primer Sequence | Reverse Primer Sequence |
| 1 | ACTTTCTAATGAGTTGTTTAGGCG (SEQ ID NO: 274) | AGCGACAAGCCACTGTATCATATT (SEQ ID NO: 285) |
| 2 | CTGGTCGATAACTCCTTCAATCTT (SEQ ID NO: 275) | GTACGACAAAAGTGTGGCTTGTT (SEQ ID NO: 286) |
| 3 | GAATGCGATATTCAGGACCAACTA (SEQ ID NO: 276) | ATCTCACTGAGTTAATCCGTTCAC (SEQ ID NO: 287) |
| 4 | TGTATACAAGTGTGTCATTGCCAG (SEQ ID NO: 277) | CATCTTCACCTGTTCTCACATTTT (SEQ ID NO: 288) |
| 5 | GCGGTCTTTAGTCTTCAAAAACA (SEQ ID NO: 278) | CAAGAGAAAAACACAGAGCCATAA (SEQ ID NO: 289) |
| 6 | TTGCTTAAGTAAGAGAGAAAGGAGC (SEQ ID NO: 279) | CAGGAGTATAGTGTCCGCTTTCTT (SEQ ID NO: 290) |
| 7 | GGCAATGTTGACTTTATGAAGGTG (SEQ ID NO: 280) | TATCAGCATCCCTTTATCTTCAAAC (SEQ ID NO: 291) |
| 8 | TGAGATTTTCTCGTTTCTCTTAGC (SEQ ID NO: 281) | AATAGACGATGGGTATTGATCATGT (SEQ ID NO: 292) |
| 9 | CCGACGAACTTTGATGATTTATTG (SEQ ID NO: 282) | ACCAACAGACGATGACTGTTAATC (SEQ ID NO: 293) |
| 10 | AATGACTTTGAGCCTGTCTTGAT (SEQ ID NO: 283) | TTCTACAATTTCCTGGCCATTATC (SEQ ID NO: 294) |
| 11 | GCCATTTGGATCAGCTAAAAGTT (SEQ ID NO: 284) | TTTTTCAACCCACTACAGTTGACA (SEQ ID NO: 295) |

These primers hybridized along the entire length of the AI locus to generate amplification products representative of sequences throughout the locus. See FIG. 138, which is a schematic of the location where each of these primers hybridizes to the *S. pneumoniae* AI locus. FIG. 139A provides the set of amplicons obtained from amplification of the AI locus in *S. pneumoniae* strain TIGR4. FIG. 139B provides the length, in base pairs, of each amplicon in *S. pneumoniae* strain TIGR4. Amplification of the genome of *S. pneumoniae* strains 19A Hungary 6, 6B Finland 12, 6B Spain 2, 9V Spain 3, 14 CSR 10, 19F Taiwan 14, 23F Taiwan 15, and 23F Poland 16 produced a set of eleven amplicons for the eleven primer pairs, indicating that each of these strains also contained the *S. pneumoniae* AI locus.

The *S. pneumoniae* strains were also identified as containing the AI locus by comparative genome hybridization (CGH) analysis. The genomes of sixteen *S. pneumoniae* strains were interrogated for the presence of the AI locus by comparison to unique open reading frames of strain TIGR4. The AI locus was detected by this method in strains 19A Hungary 6 (19AHUN), 6B Finland 12 (6BFIN12), 6B Spain 2 (6BSP2), 14CSR10 (14 CSR10), 9V Spain 3 (9VSP3), 19F Taiwan 14 (19FTW14), 23F Taiwan 15 (19FTW15), and 23F Poland 16 (23FP16). See FIG. 140.

The AI locus has been sequenced for each of these strains and the nucleotide and encoded amino acid sequence for each orf has been determined. An alignment of the complete nucleotide sequence of the adhesin island present in each of the ten strains is provided in FIG. 196. Aligning the amino acid sequences encoded by the orfs reveals conservation of many of the AI polypeptide amino acid sequences. For example, Table 39 provides a comparison of the percent identities of the polypeptides encoded within the *S. pneumoniae* strain 670 and TIGR4 adhesin islands.

TABLE 39

| Percent identity comparison of *S. pneumoniae* strains AI sequences | | |
|---|---|---|
| *S. pneumoniae* strain 670 polypeptide | *S. pneumoniae* from TIGR4 polypeptide | Shared identity of polypeptides |
| Orf1_670 | SP0460 | 99.3% identity in 422 aa overlap |
| Orf2_670 | SP0461 | 100.0% identity in 509 aa overlap |
| Orf3_670 | SP0462 | 83.2% identity in 895 aa overlap |
| Orf4_670 | SP0463 | 47.9% identity in 678 aa overlap |
| Orf5_670 | SP0464 | 99.7% identity in 393 aa overlap |
| Orf6_670 | SP0466 | 100.0% identity in 279 aa overlap |
| Orf7_670 | SP0467 | 94.2% identity in 260 aa overlap |
| Orf8_670 | SP0468 | 91.5% identity in 283 aa overlap |

FIGS. 141-147 each provide a multiple sequence alignment for the polypeptides encoded by one of the open reading frames in all ten AI-positive *S. pneumoniae* strains. In each of the sequence alignments, light shading indicates an LPXTG motif and dark shading indicates the presence of an E-box motif with the conserved glutamic acid residue of the E-box motif in bold.

The sequence alignments also revealed that the polypeptides encoded by most of the open reading frames may be divided into two groups of homology, *S. pneumoniae* AI-a and AI-b. *S. pneumoniae* strains that comprise AI-a include 14 CSR 10, 19A Hungary 6, 23F Poland 15, 670, 6B Finland 12, and 6B Spain 2. *S. pneumoniae* strains that comprise AI-b include 19F Taiwan 14, 9V Spain 3, 23F Taiwan 15, and TIGR4. An immunogenic composition of the invention may comprise one or more polypeptides from within each of *S. pneumoniae* AI-a and AI-b. For example, polypeptide RrgB, encoded by open reading frame 4, may be divided within two such groups of homology. One group contains the RrgB sequences of six *S. pneumoniae* strains and a second group contains the RrgB sequences of four *S. pneumoniae* strains. While the amino acid sequence of the strains within each individual group is 99-100 percent identical, the amino acid sequence identity of the strains in the first relative to the second group is only 48%. Table 41 provides the identity comparisons of the amino acid sequences encoded by each open reading frame for the ten *S. pneumoniae* strains.

TABLE 42

Conservation of amino acid sequences encoded by the *S. pneumoniae* AI locus

| Putative Role of Polypeptide | Encoded by Orf | Groups of Homology | % Identity in Group | % Identity Between Groups |
|---|---|---|---|---|
| RlrA, transcriptional regulator | 2 | 1 group (10 strains) | 100 | — |
| RrgA, cell wall surface protein | 3 | 2 groups (6 + 4) | 98-100 | 83 |
| RrgB, cell wall surface protein | 4 | 2 groups (6 + 4) | 99-100 | 48 |
| RrgC, cell wall surface protein | 5 | 2 groups (6 + 4) | 99-100 | 97 |
| SrtB, putative sortase | 6 | 2 groups (7 + 3) | 99-100 | 97 |
| SrtC, putative sortase | 7 | 2 groups (6 + 4) | 95-100 | 93 |
| SrtD, putative sortase | 8 | 2 groups (6 + 4) | 99-100 | 92 |

The division of homology between the RrgB polypeptide in the *S. pneumoniae* strains is due a lack of amino acid sequence identity in the central amino acid residues Amino acid residues 1-30 and 617-665 are identical for each of the ten *S. pneumoniae* strains. However, amino acid residues 31-616 share between 42 and 100 percent identity between strains. See FIG. 149. The shared N- and C-terminal regions of identity in the RrgB polypeptides may be preferred portions of the RrgB polypeptide for use in an immunogenic composition. Similarly, shared regions of identity in any of the polypeptides encoded by the *S. pneumoniae* AI locus may be preferable for use in immunogenic compositions. One of skill in the art, using the amino acid alignments provided in FIGS. 141-147, would readily be able to determine these regions of identity.

The *S. pneumoniae* comprising these AI loci do, in fact, express high molecular weight polymers on their surface, indicating the presence of pili. See FIG. 182, which shows detection of high molecular weight structures expressed by *S. pneumoniae* strains that comprise the adhesin island locus depicted in FIG. 137, these strains are indicated as rlrA+. Confirming these findings, electron microscopy and negative staining detects the presence of pili extending from the surface of *S. pneumoniae*. See FIG. 185. To demonstrate that the adhesin island locus was responsible for the pili, the rrgA-srtD region of TIGR 4 were deleted. Deletion of this region of the adhesin island resulted in a loss of pili expression. See FIG. 186. See also FIG. 235, which provides an electron micrograph of *S. pneumoniae* lacking the rrgA-srtD region immunogold stained using anti-RrgB and anti-RrgC antibodies. No pili can be seen. Similarly to that described above, a *S. pneumoniae* bacteria that lacks a transcriptional repressor, mgrA, of genes in the adhesin island expresses pili. See FIG. 187. However, and as expected, a *S. pneumoniae* bacteria that lacks both the mgrA and adhesin island genes in the rrgA-srtD region does not express pili. See FIG. 188.

These high molecular weight pili structures appear to play a role in adherence of *S. pneumoniae* to cells. *S. pneumoniae* TIGR4 that lack the pilus operon have significantly diminished ability to adhere to A549 Alveolar cells in vitro. See FIG. 184.

The Sp0463 (*S. pneumoniae* TIGR4 rrgB) adhesion island polypeptide is expressed in oligomeric form. Whole cell extracts were analyzed by Western blot using a Sp0463 antiserum. The antiserum cross-hybridized with high molecular weight Sp0463 polymers. See FIG. 156. The antiserum did not cross-hybridize with polypeptides from D39 or R6 strains of *S. pneumoniae*, which do not contain the AI locus depicted in FIG. 137. Immunogold labeling of *S. pneumoniae* TIGR 4 using RrgB antiserum confirms the presence of RrgB in pili. FIG. 189 shows double-labeling of *S. pneumoniae* TIGR 4 bacteria with immunolabeling for RrgB (5 nm gold particles) and RrgC (10 nm gold particles) protein. The RrgB protein is detected as present at intervals along the pilus structure. The RrgC protein is detected at the tips of the pili. See FIG. 234 at arrows; FIG. 234 is a close up of a pilus in FIG. 189 at the location indicated by *.

The RrgA protein appears to be present in and necessary for formation of high molecular weight structures on the surface of *S. pneumoniae* TIGR4. See FIG. 181 which provides the results of Western blot analysis of TIGR4 *S. pneumoniae* lacking the gene encoding RrgA. No high molecular weight structures are detected in *S. pneumoniae* that do not express RrgA using antiserum raised against RrgB. See also FIG. 183.

A detailed diagram of the amino acid sequence comparisons of the RrgA protein in the ten *S. pneumoniae* strains is shown in FIG. 148. The diagram reveals the division of the individual *S. pneumoniae* strains into the two different homology groups.

The cell surface polypeptides encoded by the *S. pneumoniae* TIGR4 AI, Sp0462 (rrgA), Sp0463 (rrgB), and Sp0464 (rrgC), have been cloned and expressed. See examples 15-17. A polyacrylamide gel showing successful recombinant expression of RrgA is provided in FIG. 190A. Detection of the RrgA protein, which is expressed in pET21b with a histidine tag, is also shown by Western blot analysis in FIG. 190B, using an anti-histidine tag antibody.

Antibodies that detect RrgB and RrgC antibodies have been produced in mice. See FIGS. 191 and 192, which show detection of RrgB and RrgC, respectively, using the raised antibodies.

In addition to the identification of these *S. pneumoniae* adhesion islands, coding sequences for SrtB type sortases have been identified in several *S. pneumoniae* clinical isolates, demonstrating conservation of a SrtB type sortase across these isolates.

Recombinantly Produced AI polypeptides

It is also an aspect of the invention to alter a non-AI polypeptide to be expressed as an AI polypeptide. The non-AI polypeptide may be genetically manipulated to additionally contain AI polypeptide sequences, e.g., a sortase substrate, pilin, or E-box motif, which may cause expression of the non-AI polypeptide as an AI polypeptide. Alternatively the non-AI polypeptide may be genetically manipulated to replace an amino acid sequence within the non-AI polypeptide for AI polypeptide sequences, e.g., a sortase substrate, pilin, or E-box motif, which may cause expression of the non-AI polypeptide as an AI polypeptide. Any number of amino acid residues may be added to the non-AI polypeptide or may be replaced within the non-AI polypeptide to cause its expression as an AI polypeptide. At least 5, 6, 7, 8, 9, 10, 15, 20, 25, 30, 35, 50, 75, 100, 150, 200, or 250 amino acid residues may be replaced or added to the non-AI polypeptide amino acid sequence. GBS 322 may be one such non-AI polypeptide that may be expressed as an AI polypeptide.

GBS Adhesin Island Sequences

The GBS AI polypeptides of the invention can, of course, be prepared by various means (e.g. recombinant expression, purification from GBS, chemical synthesis etc.) and in various forms (e.g. native, fusions, glycosylated, non-glycosylated etc.). They are preferably prepared in substantially pure form (i.e. substantially free from other streptococcal or host cell proteins) or substantially isolated form.

The GBS AI proteins of the invention may include polypeptide sequences having sequence identity to the identified GBS proteins. The degree of sequence identity may vary depending on the amino acid sequence (a) in question, but is preferably greater than 50% (e.g. 60%, 65%, 70%, 75%, 80%, 85%, 90%, 91%, 92%, 93%, 94%, 95%, 96%, 97%, 98%, 99%, 99.5% or more). Polypeptides having sequence identity include homologs, orthologs, allelic variants and functional mutants of the identified GBS proteins. Typically, 50% identity or more between two proteins is considered to be an indication of functional equivalence. Identity between proteins is preferably determined by the Smith-Waterman homology search algorithm as implemented in the MPSRCH program (Oxford Molecular), using an affinity gap search with parameters gap open penalty=12 and gap extension penalty=1.

The GBS adhesin island polynucleotide sequences may include polynucleotide sequences having sequence identity to the identified GBS adhesin island polynucleotide sequences. The degree of sequence identity may vary depending on the polynucleotide sequence in question, but is preferably greater than 50% (e.g. 60%, 65%, 70%, 75%, 80%, 85%, 90%, 91%, 92%, 93%, 94%, 95%, 96%, 97%, 98%, 99%, 99.5% or more).

The GBS adhesin island polynucleotide sequences of the invention may include polynucleotide fragments of the identified adhesin island sequences. The length of the fragment may vary depending on the polynucleotide sequence of the specific adhesin island sequence, but the fragment is preferably at least 10 consecutive polynucleotides, (e.g. at least 10, 12, 14, 16, 18, 20, 25, 30, 35, 40, 50, 60, 70, 80, 90, 100, 150, 200 or more).

The GBS adhesin island amino acid sequences of the invention may include polypeptide fragments of the identified GBS proteins. The length of the fragment may vary depending on the amino acid sequence of the specific GBS antigen, but the fragment is preferably at least 7 consecutive amino acids, (e.g. 8, 10, 12, 14, 16, 18, 20, 25, 30, 35, 40, 50, 60, 70, 80, 90, 100, 150, 200 or more). Preferably the fragment comprises one or more epitopes from the sequence. Other preferred fragments include (1) the N-terminal signal peptides of each identified GBS protein, (2) the identified GBS protein without their N-terminal signal peptides, and (3) each identified GBS protein wherein up to 10 amino acid residues (e.g. 1, 2, 3, 4, 5, 6, 7, 8, 9, 10, 15, 20, 25 or more) are deleted from the N-terminus and/or the C-terminus e.g. the N-terminal amino acid residue may be deleted. Other fragments omit one or more domains of the protein (e.g. omission of a signal peptide, of a cytoplasmic domain, of a transmembrane domain, or of an extracellular domain).

GBS 80

Examples of preferred GBS 80 fragments are discussed below. Polynucleotide and polypeptide sequences of GBS 80 from a variety of GBS serotypes and strain isolates are set forth in FIGS. 18 and 22. The polynucleotide and polypeptide sequences for GBS 80 from GBS serotype V, strain isolate 2603 are also included below as SEQ ID NOS 1 and 2:

```
                                       SEQ ID NO. 1
ATGAAATTATCGAAGAAGTTATTGTTTTCGGCTGCTGTTTTAACAATG

GTGGCGGGGTCAACTGTTGAACCAGTAGCTCAGTTTGCGACTGGAATG

AGTATTGTAAGAGCTGCAGAAGTGTCACAAGAACGCCCAGCGAAAACA

ACAGTAAATATCTATAAATTACAAGCTGATAGTTATAAATCGGAAATT

ACTTCTAATGGTGGTATCGAGAATAAAGACGGCGAAGTAATATCTAAC

TATGCTAAACTTGGTGACAATGTAAAAGGTTTGCAAGGTGTACAGTTT

AAACGTTATAAAGTCAAGACGGATATTTCTGTTGATGAATTGAAAAAA

TTGACAACAGTTGAAGCAGCAGATGCAAAAGTTGGAACGATTCTTGAA

GAAGGTGTCAGTCTACCTCAAAAAACTAATGCTCAAGGTTTGGTCGTC

GATGCTCTGGATTCAAAAAGTAATGTGAGATACTTGTATGTAGAAGAT

TTAAAGAATTCACCTTCAAACATTACCAAAGCTTATGCTGTACCGTTT

GTGTTGGAATTACCAGTTGCTAACTCTACAGGTACAGGTTTCCTTTCT

GAAATTAATATTTACCCTAAAAACGTTGTAACTGATGAACCAAAAACA

GATAAAGATGTTAAAAAATTAGGTCAGGACGATGCAGGTTATACGATT

GGTGAAGAATTCAAATGGTTCTTGAAATCTACAATCCCTGCCAATTTA

GGTGACTATGAAAAATTTGAAATTACTGATAAATTTGCAGATGGCTTG

ACTTATAAATCTGTTGGAAAAATCaAGATTGGTTCGAAAACACTGAAT

AGAGATGAGCACTACACTATTGATGAACCAACAGTTGATAACCAAAAT

ACATTAAAAATTACGTTTAAACCAGAGAAATTTAAAGAAATTGCTGAG

CTACTTAAAGGAATGACCCTTGTTAAAAATCAAGATGCTCTTGATAAA

GCTACTGCAAATACAGATGATGCGGCATTTTTGGAAATTCCAGTTGCA

TCAACTATTAATGAAAAAGCAGTTTTAGGAAAAGCAATTGAAAATACT

TTTGAACTTCAATATGACCATACTCCTGATAAAGCTGACAATCCAAAA

CCATCTAATCCTCCAAGAAAACCAGAAGTTCATACTGGTGGGAAACGA

TTTGTAAAGAAAGACTCAACAGAAACACAAACACTAGGTGGTGCTGAG

TTTGATTTGTTGGCTTCTGATGGGACAGCAGTAAAATGGACAGATGCT

CTTATTAAAGCGAATACTAATAAAAACTATATTGCTGGAGAAGCTGTT

ACTGGGCaACCAATCAAATTGAAATCACATACAGACGGTACGTTTGAG

ATTAAAGGTTTGGCTTATGCAGTTGATGCGAATGCAGAGGGTACAGCA

GTAACTTACAAATTAAAAGAAACAAAAGCACCAGAAGGTTATGTAATC

CCTGATAAAGAAATCGAGTTTACAGTATCACAAACATCTTATAATACA

AAACCAACTGACATCACGGTTGATAGTGCTGATGCAACACCTGATACA

ATTAAAAACAACAAACGTCCTTCAATCCCTAATACTGGTGGTATTGGT

ACGGCTATCTTTGTCGCTATCGGTGCTGCGGTGATGGCTTTTGCTGTT

AAGGGGATGAAGCGTCGTACAAAAGATAAC
```

-continued

SEQ ID NO: 2

```
MKLSKKLLFSAAVLTMVAGSTVEPVAQFATGMSIVRAAEVSQERPAKT

TVNIYKLQADSYKSEITSNGGIENKDGEVISNYAKLGDNVKGLQGVQF

KRYKVKTDISVDELKKLTTVEAADAKVGTILEEGVSLPQKTNAQGLVV

DALDSKSNVRYLYVEDLKNSPSNITKAYAVPFVLELPVANSTGTGFLS

EINIYPKNVVTDEPKTDKDVKKLGQDDAGYTIGEEFKWFLKSTIPANL

GDYEKFEITDKFADGLTYKSVGKIKIGSKTLNRDEHYTIDEPTVDNQN

TLKITFKPEKFKEIAELLKGMTLVKNQDALDKATANTDDAAFLEIPVA

STINEKAVLGKAIENTFELQYDHTPDKADNPKPSNPPRKPEVHTGGKR

FVKKDSTETQTLGGAEFDLLASDGTAVKWTDALIKANTNKNYIAGEAV

TGQPIKLKSHTDGTFEIKGLAYAVDANAEGTAVTYKLKETKAPEGYVI

PDKEIEFTVSQTSYNTKPTDITVDSADATPDTIKNNKRPSIPNTGGIG

TAIFVAIGAAVMAFAVKGMKRRTKDN
```

As described above, the compositions of the invention may include fragments of AI proteins. In some instances, removal of one or more domains, such as a leader or signal sequence region, a transmembrane region, a cytoplasmic region or a cell wall anchoring motif, may facilitate cloning of the gene encoding the protein and/or recombinant expression of the GBS AI protein. In addition, fragments comprising immunogenic epitopes of the cited GBS AI proteins may be used in the compositions of the invention.

For example, GBS 80 contains an N-terminal leader or signal sequence region which is indicated by the underlined sequence at the beginning of SEQ ID NO:2 above. In one embodiment, one or more amino acids from the leader or signal sequence region of GBS 80 are removed. An example of such a GBS 80 fragment is set forth below as SEQ ID NO:3:

SEQ ID NO: 3

```
AEVSQERPAKTTVNIYKLQADSYKSEITSNGGIENKDGEVISNYAKLG

DNVKGLQGVQFKRYKVKTDISVDELKKLTTVEAADAKVGTILEEGVSL

PQKTNAQGLVVDALDSKSNVRYLYVEDLKNSPSNITKAYAVPFVLELP

VANSTGTGFLSEINIYPKNVVTDEPKTDKDVKKLGQDDAGYTIGEEFK

WFLKSTIPANLGDYEKFEITDKFADGLTYKSVGKIKIGSKTLNRDEHY

TIDEPTVDNQNTLKITFKPEKFKEIAELLKGMTLVKNQDALDKATANT

DDAAFLEIPVASTINEKAVLGKAIENTFELQYDHTPDKADNPKPSNPP

RKPEVHTGGKRFVKKDSTETQTLGGAEFDLLASDGTAVKWTDALIKAN

TNKNYIAGEAVTGQPIKLKSHTDGTFEIKGLAYAVDANAEGTAVTYKL

KETKAPEGYVIPDKEIEFTVSQTSYNTKPTDITVDSADATPDTIKNNK

RPSIPNTGGIGTAIFVAIGAAVMAFAVKGMKRRTKDN
```

GBS 80 contains a C-terminal transmembrane region which is indicated by the underlined sequence near the end of SEQ ID NO:2 above. In one embodiment, one or more amino acids from the transmembrane region and/or a cytoplasmic region are removed. An example of such a GBS 80 fragment is set forth below as SEQ ID NO:4:

SEQ ID NO: 4

```
MKLSKKLLFSAAVLTMVAGSTVEPVAQFATGMSIVRAAEVSQERPAKT

TVNIYKLQADSYKSEITSNGGIENKDGEVISNYAKLGDNVKGLQGVQF
```

-continued

```
KRYKVKTDISVDELKKLTTVEAADAKVGTILEEGVSLPQKTNAQGLVV

DALDSKSNVRYLYVEDLKNSPSNITKAYAVPFVLELPVANSTGTGFLS

EINIYPKNVVTDEPKTDKDVKKLGQDDAGYTIGEEFKWFLKSTIPANL

GDYEKFEITDKFADGLTYKSVGKIKIGSKTLNRDEHYTIDEPTVDNQN

TLKITFKPEKFKEIAELLKGMTLVKNQDALDKATANTDDAAFLEIPVA

STINEKAVLGKAIENTFELQYDHTPDKADNPKPSNPPRKPEVHTGGKR

FVKKDSTETQTLGGAEFDLLASDGTAVKWTDALIKANTNKNYIAGEAV

TGQPIKLKSHTDGTFEIKGLAYAVDANAEGTAVTYKLKETKAPEGYVI

PDKEIEFTVSQTSYNTKPTDITVDSADATPDTIKNNKRPSIPNTG
```

GBS 80 contains an amino acid motif indicative of a cell wall anchor: SEQ ID NO:5 IPNTG (shown in italics in SEQ ID NO:2 above). In some recombinant host cell systems, it may be preferable to remove this motif to facilitate secretion of a recombinant GBS 80 protein from the host cell. Accordingly, in one preferred fragment of GBS 80 for use in the invention, the transmembrane and/or cytoplasmic regions and the cell wall anchor motif are removed from GBS 80. An example of such a GBS 80 fragment is set forth below as SEQ ID

SEQ ID NO: 6

```
MKLSKKLLFSAAVLTMVAGSTVEPVAQFATGMSIVRAAEVSQERPAKT

TVNIYKLQADSYKSEITSNGGIENKDGEVISNYAKLGDNVKGLQGVQF

KRYKVKTDISVDELKKLTTVEAADAKVGTILEEGVSLPQKTNAQGLVV

DALDSKSNVRYLYVEDLKNSPSNITKAYAVPFVLELPVANSTGTGFLS

EINIYPKNVVTDEPKTDKDVKKLGQDDAGYTTGEEFKWFLKSTTPANL

GDYEKFEITDKFADGLTYKSVGKIKIGSKTLNRDEHYTIDEPTVDNQN

TLKTTFKPEKFKEIAELLKGMTLVKNQDALDKATANTDDAAELEIPVA

STLNEKAVLGKAIENTFELQYDHTPDKADNPKPSNPPRKPEVHTGGKR

FVKKDSTETQTLGGAEFDLLASDGTAVKWTDALIKANTNKNYIAGEAV

TGQPIKLKSHTDGTFEIKGLAYAVDANAEGTAVTYKLKETKAPEGYVI

PDKEIEFTVSQTSYNTKPTDITVDSADATPDTIKNNKRPS
```

Alternatively, in some recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

In one embodiment, the leader or signal sequence region, the transmembrane and cytoplasmic regions and the cell wall anchor motif are removed from the GBS sequence. An example of such a GBS 80 fragment is set forth below as SEQ ID NO:7.

SEQ ID NO: 7

```
AEVSQERPAKTTVNIYKLQADSYKSEITSNGGIENKDGEVISNYAKLG

DNVKGLQGVQFKRYKVKTDISVDELKKLTTVEAADAKVGTILEEGVSL

PQKTNAQGLVVDALDSKSNVRYLYVEDLKNSPSNITKAYAVPFVLELP

VANSTGTGFLSEINIYPKNVVTDEPKTDKDVKKLGQDDAGYTIGEEFK
```

-continued

WFLKSTIPANLGDYEKFEITDKFADGLTYKSVGKIKIGSKTLNRDEHY

TIDEPTVDNQNTLKITFKPEKFKEIAELLKGMTLVKNQDALDKATANT

DDAAFLEIPVASTINEKAVLGKAIENTFELQYDHTPDKADNPKPSNPP

RKPEVHTGGKRFVKKDSTETQTLGGAEFDLLASDGTAVKWTDALIKAN

TNKNYIAGEAVTGQPIKLKSHTDGTFEIKGLAYAVDANAEGTAVTYKL

KETKAPEGYVIPDKEIEF TVSQTSYNTKPTDITVDSADATPDTIKNN

KRPS

Applicants have identified a particularly immunogenic fragment of the GBS 80 protein. This immunogenic fragment is located towards the N-terminus of the protein and is underlined in the GBS SEQ ID NO:sequence below. The underlined fragment is set forth below as SEQ ID NO:8.

SEQ ID NO: 2

MKLSKKLLFSAAVLTMVAGSTVEPVAQFATGMSIVRAAEVSQERPAKT

TVNIYKLQADSYKSEITSNGGIENKDGEVISNYAKLGDNVKGLQGVQF

KRYKVKTDISVDELKKLTTVEAADAKVGTILEEGVSLPQKTNAQGLVV

DALDSKSNVRYLYVEDLKNSPSNITKAYAVPFVLELPVANSTTDKFAD

GLTYKSVGKIKIGSKTLNRDEHYTIDEPTVDNQNTLKITFKPEKFKEI

AELLKGMTLVKNQDALDKATANTDDAAFLEIPVASTINEKAVLGKAIE

NTFELQYDHTPDKADNPKPSNPPRKPEVHTGGKRFVKKDSTETQTLGG

AEFDLLASDGTAVKWTDALIKANTNKNYIAGEAVTGQPIKLKSHTDGT

FEIKGLAYAVDANAEGTAVTYKLKETKAPEGYVIPDKEIEFTVSQTSY

NTKPTDITVDSADATPDTIKNNKRPSIPWTGGIGTAIFVAIGAAVMAF

AVKGMKRRTKDN

SEQ ID NO: 8

AEVSQERPAKTTVNIYKLQADSYKSEITSNGGIENKDGEVISNYAKLG

DNVKGLQGVQFKRYKVKTDISVDELKKLTTVEAADAKVGTILEEGVSL

PQKTNAQGLVVDALDSKSNVRYLYVEDLKNSPSNITKAYAVPFVLELP

VANSTGTGFLSEINIYPKNVVTDEPKTDKDVKKLGQDDAGYTIGEEFK

WFLKSTIPANLGDYEKFEITDKFADGLTYKSVGKIKIGSKTLNRDEHY

TIDEPTVDNQNTLKITFKPEKFKEIAELLKG

The immunogenicity of the protein encoded by SEQ ID NO:7 was compared against PBS, GBS whole cell, GBS 80 (full length) and another fragment of GBS 80, located closer to the C-terminus of the peptide (SEQ ID NO:9, below).

SEQ ID NO: 9

MTLVKNQDALDKATANTDDAAFLEIPVASTINEKAVLGKAIENTFELQ

YDHTPDKADNPKPSNPPRKPEVHTGGKREVKKDSTETQTLGGAEFDLL

ASDGTAVKWTDALIKANTNKNYIAGEAVTGQPIKLKSHTDGTFEIKGL

AYAVDANAEGTAVTYKLKETKAPEGYVIPDKEIEFTVSQTSYNTKPTD

ITVDSADATPDTIKNNKRPS

Both an Active Maternal Immunization Assay and a Passive Maternal Immunization Assay were conducted on this collection of proteins.

As used herein, an Active Maternal Immunization assay refers to an in vivo protection assay where female mice are immunized with the test antigen composition. The female mice are then bred and their pups are challenged with a lethal dose of GBs. Serum titers of the female mice during the immunization schedule are measured as well as the survival time of the pups after challenge.

Specifically, the Active Maternal Immunization assays referred to herein used groups of four CD-1 female mice (Charles River Laboratories, Calco Italy). These mice were immunized intraperitoneally with the selected proteins in Freund's adjuvant at days 1, 21 and 35, prior to breeding. 6-8 weeks old mice received 20 μg protein/dose when immunized with a single antigen, 30-45 μg protein/dose (15 μg each antigen) when immunized with combination of antigens. The immune response of the dams was monitored by using serum samples taken on day 0 and 49. The female mice were bred 2-7 days after the last immunization (at approximately t=36-37), and typically had a gestation period of 21 days. Within 48 hours of birth, the pups were challenged via I.P. with GBS in a dose approximately equal to a amount which would be sufficient to kill 70-90% of unimmunized pups (as determined by empirical data gathered from PBS control groups). The GBS challenge dose is preferably administered in 50 μl of THB medium. Preferably, the pup challenge takes place at 56 to 61 days after the first immunization. The challenge inocula were prepared starting from frozen cultures diluted to the appropriate concentration with THB prior to use. Survival of pups was monitored for 5 days after challenge.

As used herein, the Passive Maternal Immunization Assay refers to an in vivo protection assay where pregnant mice are passively immunized by injecting rabbit immune sera (or control sera) approximately 2 days before delivery. The pups are then challenged with a lethal dose of GBs.

Specifically, the Passive Maternal Immunization Assay referred to herein used groups of pregnant CD1 mice which were passively immunized by injecting 1 ml of rabbit immune sera or control sera via I.P., 2 days before delivery. Newborn mice (24-48 hrs after birth) are challenged via I.P. with a 70-90% lethal dose of GBS serotype II COH1. The challenge dose, obtained by diluting a frozen mid log phase culture, was administered in 50 μl of THB medium.

For both assays, the number of pups surviving GBS infection was assessed every 12 hrs for 4 days. Statistical significance was estimated by Fisher's exact test.

The results of each assay for immunization with SEQ ID NO:7, SEQ ID NO:8, PBS and GBS whole cell are set forth in Tables 1 and 2 below.

TABLE 1

| Immunization | | | |
|---|---|---|---|
| Antigen | Alive/ total | % Survival | Fisher's exact test |
| PBS (neg control) | 13/80 | 16% | |
| GBS (whole cell) | 54/65 | 83% | P < 0.00000001 |
| GBS80 (intact) | 62/70 | 88% | P < 0.00000001 |
| GBS80 (fragment) SEQ ID 7 | 35/64 | 55% | P = 0.0000013 |
| GBS80 (fragment) SEQ ID 8 | 13/67 | 19% | P = 0.66 |

TABLE 2

| Passive Maternal Immunization | | | |
|---|---|---|---|
| Antigen | Alive/total | % Survival | Fisher's exact test |
| PBS (neg control) | 12/42 | 28% | |
| GBS (whole cell) | 48/52 | 92% | P < 0.00000001 |
| GBS80 (intact) | 48/55 | 87% | P < 0.00000001 |
| GBS80 (fragment) SEQ ID 7 | 45/57 | 79% | P < 0.0000006 |
| GBS80 (fragment) SEQ ID 8 | 13/54 | 24% | P = 1 |

As shown in Tables 1 and 2, immunization with the SEQ ID NO:7 GBS 80 fragment provided a substantially improved survival rate for the challenged pups than the comparison SEQ ID NO:8 GBS 80 fragment. These results indicate that the SEQ ID NO:7 GBS 80 fragment may comprise an important immunogenic epitope of GBS 80.

As discussed above, pilin motifs, containing conserved lysine (K) residues have been identified in GBS 80. The pilin motif sequences are underlined in SEQ ID NO:2, below. Conserved lysine (K) residues are marked in bold, at amino acid residues 199 and 207 and at amino acid residues 368 and 375. The pilin sequences, in particular the conserved lysine residues, are thought to be important for the formation of oligomeric, pilus-like structures of GBS 80. Preferred fragments of GBS 80 include at least one conserved lysine residue. Preferably, fragments include at least one pilin sequence.

SEQ ID NO: 2

```
MKLSKKLLFSAAVLTMVAGSTVEPVAQFATGMSIVRAAEVSQERPAKT
TVNIYKLQADSYKSEITSNGGIENKDGEVISNYAKLGDNVKGLQGVQF
KRYKVKTDISVDELKKLTTVEAADAKVGTILEEGVSLPQKTNAQGLVV
DALDSKSNVRYLYVEDLKNSPSNITKAYAVPFVLELPVANSTGTGFLS
EINIYPKNVVTDEPKTDKDVKKLGQDDAGYTIGEEFKWFLKSTIPANL
GDYEKFEITDKFADGLTYKSVGKIKIGSKTLNRDEHYTIDEPTVDNQN
TLKITFKPEKFKEIAELLKGMTLVKNQDALDKATANTDDAAFLEIPVA
STINEKAVLGKAIENTFELQYDHTPDKADNPKPSNPPRKPEVHTGGKR
FVKKDSTETQTLGGAEFDLLASDGTAVKWTDALIKANTNKNYIAGEAV
TGQPIKLKSHTDGTFEIKGLAYAVDANAEGTAVTYKLKETKAPEGYVI
PDKEIEFTVSQTSYNTKPTDITVDSADATPDTIKNNKRPSIPNTGGIG
TAIFVAIGAAVMAFAVKGMKRRTKDN
```

E boxes containing conserved glutamic residues have also been identified in GBS 80. The E box motifs are underlined in SEQ ID NO:2 below. The conserved glutamic acid (E) residues, at amino acid residues 392 and 471, are marked in bold. The E box motifs, in particular the conserved glutamic acid residues, are thought to be important for the formation of oligomeric pilus-like structures of GBS 80. Preferred fragments of GBS 80 include at least one conserved glutamic acid residue. Preferably, fragments include at least one E box motif

SEQ ID NO: 2

```
MKLSKKLLFSAAVLTMVAGSTVEPVAQFATGMSIVRAAEVSQERPAKT
TVNIYKLQADSYKSEITSNGGIENKDGEVISNYAKLGDNVKGLQGVQF
KRYKVKTDISVDELKKLTTVEAADAKVGTILEEGVSLPQKTNAQGLVV
```

-continued

```
DALDSKSNVRYLYVEDLKNSPSNITKAYAVPFVLELPVANSTGTGFLS
EINIYPKNVVTDEPKTDKDVKKLGQDDAGYTIGEEFKWFLKSTIPANL
GDYEKFEITDKFADGLTYKSVGKIKIGSKTLNRDEHYTIDEPTVDNQN
TLKITFKPEKFKEIAELLKGMTLVKNQDALDKATANTDDAAFLEIPVA
STINEKAVLGKAIENTFELQYDHTPDKADNPKPSNPPRKPEVHTGGKR
FVKKDSTETQTLGGAEFDLLASDGTAVKWTDALIKANTNKNYIAGEAV
TGQPIKLKSHTDGTFEIKGLAYAVDANAEGTAVTYKLKETKAPEGYVI
PDKEIEFTVSQTSYNTKPTDITVDSADATPDTIKNNKRPSIPNTGGIG
TAIFVAIGAAVMAFAVKGMKRRTKDN
```

GBS 104

Similarly, the following offers examples of preferred GBS 104 fragments. Nucleotide and amino acid sequences of GBS 1 sequenced from serotype V isolated strain 2603 are set forth below as SEQ ID NOS 10 and 11:

SEQ ID NO. 10

```
ATGAAAAAGAGACAAAAAATATGGAGAGGGTTATCAGTTACTTTACTA
ATCCTGTCCCAAATTCCATTTGGTATATTGGTACAAGGTGAAACCCAA
GATACCAATCAAGCACTTGGAAAAGTAATTGTTAAAAAAACGGGAGAC
AATGCTACACCATTAGGCAAAGCGACTTTTGTGTTAAAAAATGACAAT
GATAAGTCAGAAACAAGTCACGAAACGGTAGAGGGTTCTGGAGAAGCA
ACCTTTGAAAACATAAAACCTGGAGACTACACATTAAGAGAAGAAACA
GCACCAATTGGTTATAAAAAAACTGATAAAACCTGGAAAGTTAAAGTT
GCAGATAACGGAGCAACAATAATCGAGGGTATGGATGCAGATAAAGCA
GAGAAACGAAAAGAAGTTTTGAATGCCCAATATCCAAAATCAGCTATT
TATGAGGATACAAAAGAAAATTACCCATTAGTTAATGTAGAGGGTTCC
AAAGTTGGTGAACAATACAAAGCATTGAATCCAATAAATGGAAAAGAT
GGTCGAAGAGAGATTGCTGAAGGTTGGTTATCAAAAAAAATTACAGGG
GTCAATGATCTCGATAAGAATAAATATAAAATTGAATTAACTGTTGAG
GGTAAAACCACTGTTGAAACGAAAGAACTTAATCAACCACTAGATGTC
GTTGTGCTATTAGATAATTCAAATAGTATGAATAATGAAAGAGCCAAT
ATATTCTCAAAGAGCATTAAAAGCTGGGAAGCAGTTGAAAAGCTGATT
GATAAAATTACATCAAATAAAGACAATAGAGTAGCTCTTGTGACATAT
GCCTCAACCATTTTTGATGGTACTGAAGCGACCGTATCAAAGGGAGTT
GCCGATCAAAATGGTAAAGCGCTGAATGATAGTGTATCATGGGATTAT
CATAAAACTACTTTTACAGCAACTACACATAATTACAGTTATTTAAAT
TTAACAAATGATGCTAACGAAGTTAATATTCTAAAGTCAAGAATTCCA
AAGGAAGCGGAGCATATAAATGGGGATCGCACGCTCTATCAATTTGGT
GCGACATTTACTCAAAAAGCTCTAATGAAAGCAAATGAAATTTTAGAG
ACACAAAGTTCTAATGCTAGAAAAAAACTTATTTTTCACGTAACTGAT
GGTGTCCCTACGATGTCTTATGCCATAAATTTTAATCCTTATATATCA
ACATCTTACCAAAACCAGTTTAATTCTTTTTTAAATAAAATACCAGAT
AGAAGTGGTATTCTCCAAGAGGATTTTATAATCAATGGTGATGATTAT
```

CAAATAGTAAAAGGAGATGGAGAGAGTTTTAAACTGTTTTCGGATAGA

AAAGTTCCTGTTACTGGAGGAACGACACAAGCAGCTTATCGAGTACCG

CAAAATCAACTCTCTGTAATGAGTAATGAGGGATATGCAATTAATAGT

GGATATATTTATCTCTATTGGAGAGATTACAACTGGGTCTATCCATTT

GATCCTAAGACAAAGAAAGTTTCTGCAACGAAACAAATCAAAACTCAT

GGTGAGCCAACAACATTATACTTTAATGGAAATATAAGACCTAAAGGT

TATGACATTTTTACTGTTGGGATTGGTGTAAACGGAGATCCTGGTGCA

ACTCCTCTTGAAGCTGAGAAATTTATGCAATCAATATCAAGTAAAACA

GAAAATTATACTAATGTTGATGATACAAATAAAATTTATGATGAGCTA

AATAAATACTTTAAAACAATTGTTGAGGAAAAACATTCTATTGTTGAT

GGAAATGTGACTGATCCTATGGGAGAGATGATTGAATTCCAATTAAAA

AATGGTCAAAGTTTTACACATGATGATTACGTTTTGGTTGGAAATGAT

GGCAGTCAATTAAAAAATGGTGTGGCTCTTGGTGGACCAAACAGTGAT

GGGGGAATTTTAAAAGATGTTACAGTGACTTATGATAAGACATCTCAA

ACCATCAAAATCAATCATTTGAACTTAGGAAGTGGACAAAAAGTAGTT

CTTACCTATGATGTACGTTTAAAAGATAACTATATAAGTAACAAATTT

TACAATACAAATAATCGTACAACGCTAAGTCCGAAGAGTGAAAAAGAA

CCAAATACTATTCGTGATTTCCCAATTCCCAAAATTCGTGATGTTCGT

GAGTTTCCGGTACTAACCATCAGTAATCAGAAGAAAATGGGTGAGGTT

GAATTTATTAAAGTTAATAAAGACAAACATTCAGAATCGCTTTTGGGA

GCTAAGTTTCAACTTCAGATAGAAAAAGATTTTTCTGGGTATAAGCAA

TTTGTTCCAGAGGGAAGTGATGTTACAACAAAGAATGATGGTAAAATT

TATTTTAAAGCACTTCAAGATGGTAACTATAAATTATATGAAATTTCA

AGTCCAGATGGCTATATAGAGGTTAAAACGAAACCTGTTGTGACATTT

ACAATTCAAAATGGAGAAGTTACGAACCTGAAAGCAGATCCAAATGCT

AATAAAAATCAAATCGGGTATCTTGAAGGAAATGGTAAACATCTTATT

ACCAACACTCCCAAACGCCCACCAGGTGTTTTTCCTAAAACAGGGGGA

ATTGGTACAATTGTCTATATATTAGTTGGTTCTACTTTTATGATACTT

ACCATTTGTTCTTTCCGTCGTAAACAATTG

SEQ ID NO. 11
MKKRQKIWRGLSVTLLILSQIPFGILVQGETQDTNQALGKVIVKKTGD

NATPLGKATFVLKNMKKRQKIWRGLSVTLLILSQIPFGILVQGETQDT

NQALGKVIVKKTGDNATPLGKATFVLKNDNDKSETSHETVEGSGEATF

ENIKPGDYTLREETAPIGYKKTDKTWKVKVADNGATIIEGMDADKAEK

RKEVLNAQYPKSAIYEDTKENYPLVNVEGSKVGEQYKALNPINGKDGR

REIAEGWLSKKITGVNDLDKNKYKIELTVEGKTTVETKELNQPLDVVV

LLDNSNSMNNERANNSQRALKAGEAVEKLIDKITSNKDNRVALVTYAS

TIFDGTEATVSKGVADQNGKALNDSVSWDYHKTTFTATTHNYSYLNLT

NDANEVNILKSRIPKEAEHINGDRTLYQFGATFTQKALMKANEILETQ

SSNARKKLIFHVTDGVPTMSYAINFNPYISTSYQNQFNSFLNKIPDRS

GILQEDFIINGDDYQIVKGDGESFKLFSDRKVPVTGGTTQAAYRVPQN

QLSVMSNEGYAINSGYIYLYWRDYNWVYPFDPKTKKVSATKQIKTHGE

PTTLYFNGNIRPKGYDIFTVGIGVNGDPGATPLEAEKFMQSISSKTEN

YTNVDDTNKIYDELNKYFKTIVEEKHSIVDGNVTDPMGEMIEFQLKNG

QSFTHDDYVLVGNDGSQLKNGVALGGPNSDGGILKDVTVTYDKTSQTI

KINHLNLGSGQKVVLTYDVRLKDNYISNKFYNTNNRTTLSPKSEKEPN

TIRDFPIPKIRDVREFPVLTISNQKKMGEVEFIKVNKDKHSESLLGAK

FQLQIEKDFSGYKQFVPEGSDVTTKNDGKIYFKALQDGNYKLYEISSP

DGYIEVKTKPVVTFTIQNGEVTNLKADPNANKNQIGYLEGNGKHLITN

TPKRPPGV*FPKTG*GIGTIVYILVGSTFMILTICSFRRKQL

GBS 104 contains an N-terminal leader or signal sequence region which is indicated by the underlined sequence at the beginning of SEQ ID NO 11 above. In one embodiment, one or more amino acid sequences from the leader or signal sequence region of GBS 104 are removed. An example of such a GBS 104 fragment is set forth below as SEQ ID NO 12.

SEQ ID NO: 12
GETQDTNQALGKVIVKKTGDNATPLGKATFVLKNDNDKSETSHETVEG

SGEATFENIKPGDYTLREETAPIGYKKTDKTWKVKVADNGATIIEGMD

ADKAEKRKEVLNAQYPKSAIYEDTKENYPLVNVEGSKVGEQYKALNPI

NGKDGRREIAEGWLSKKITGVNDLDKNKYKIELTVEGKTTVETKELNQ

PLDVVVLLDNSNSMNNERANNSQPALKAGEAVEKLIDKITSNKDNRVA

LVTYASTIFDGTEATVSKGVADQNGKALNDSVSWDYHKTTFTATTHNY

SYLNLTNDANEVNILKSRIPKEAEHINGDRTLYQFGATFTQKALMIAN

EILETQSSNARKKLIFHVTDGVPTMSYAINFNPYISTSYQNQFNSFLN

KIPDRSGILQEDFIINGDDYQIVKQDGESFKLFSDRKVPVTGGTTQAA

YRVPQNQLSVMSNEGYATNSGYIYLYWRDYNWVYPFDPKTKKVSATKQ

IKTHGEPTTLYPNGNTRPKGYDIFTVGIGVNGDPGATPLEAEKFMQSI

SSKTENYTNVDDTNKIYDELNKYEKTIVEEKHSIVDGNVTDPMGEMIE

FQLKNGQSPTHDDYVLVGNDGSQLKNGVALGGPNSDGGILKDVTVTYD

KTSQTIKINHLNLGSGQKVVLTYDVRLKDNYISNKFYNTNNRTTLSPK

SEKEPNTIRDFPIPKIRDVREFPVLTISNQKKMGEVEFIKVNKDKHSE

SLLGAKFQLQIEKDESGYKQFVPEGSDVTTKNDGKIYFKALQDGNYKL

YEISSPDGYIEVKTKPVVTFTIQNGEVTNLKADPNANKNQIGYLEGNG

KHLITNTPKRPPGVFPKTGGIGTIVYILVGSTFMILTICSFRRKQL

GBS 104 contains a C-terminal transmembrane and/or cytoplasmic region which is indicated by the underlined region near the end of SEQ ID NO 11 above. In one embodiment, one or more amino acids from the transmembrane or cytomplasmic regions are removed. An example of such a GBS 104 fragment is set forth below as SEQ ID NO 13.

SEQ ID NO: 13
MKKRQKIWRGLSVTLLILSQIPFGILVQGETQDTNQALGKVIVKKTGD

NATPLGKATFVLKNDNDKSETSHETVEGSGEATFENIKPGDYTLREET

-continued

APIGYKKTDKTWKVKVADNGATIIEGMDADKAEKRKEVLNAQYPKSAI

YEDTKENYPLVNVEGSKVGEQYKALNPINGKDGRREIAEGWLSKKITG

VNDLDKNKYKIELTVEGKTTVETKELNQPLDVVVLLDNSNSMNNERAN

NSQRALKAGEAVEKLIDKITSNKDNRVALVTYASTIFDGTEATVSKGV

ADQNGKALNDSVSWDYHKTTFTATTHNYSYLNLTNDANEVNILKSRIP

KEAEHINGDRTLYQFGATFTQKALMKANEILETQSSNARKKLIFHVTD

GVPTMSYAINFNPYISTSYQNQFNSFLNKIPDRSGTLQEDFIINGDDY

QIVKGDGESFKLFSDRKVPVTGGTTQAAYRVPQNQLSVMSNEGYAINS

GYIYLYWRDYNWVYPFDPKTKKVSATKQIKTHGEPTTLYFNGNTRPKG

YDIFTVGIGVNGDPGATPLEAEKFMQSISSKTENYTNVDDTNKIYDEL

NKYFKTIVEEKHSIVDGNVTDPMGEMIEFQLKNGQSFTHDDYVLVGND

GSQLKNGVALGGPNSDGGILKDVTVTYDKTSQTIKINHLNLGSGQKVV

LTYDVRLKDNYISNKFYNTNNRTTLSPKSEKEPNTIRDFPIPKIRDVR

EFPVLTISNQKKMGEVEFIKVNKDKHSESLLGAKFQLQIEKDFSGYKQ

FVPEGSDVTTKNDGKTYFKALQDGNYKLYEISSPDGYIEVKTKPWTFT

IQNGEVTNLKADPNANKNQIGYLEGNGKHLITNT

In one embodiment, one or more amino acids from the leader or signal sequence region and one or more amino acids from the transmembrane or cytoplasmic regions are removed. An example of such a GBS 104 fragment is set forth below as SEQ ID NO 14.

SEQ ID NO: 14

GETQDTNQALGKVIVKKTGDNATPLGKATFVLKNDNDKSETSHETVEG

SGEATFENIKPGDYTLREETAPIGYKKTDKTKKVKVADNGATIIEGMD

ADKAEKRKEVLNAQYPKSAIYEDTKENYPLVNVEGSKVGEQYKALNPI

NGKDGRREIAEGWLSKKITGVNDLDKNKYKIELTVEGKTTVETKELNQ

PLDVVVLLDNSNSMNNERANNSQRALKAGEAVEKLIDKITSNKDNRVA

LVTYASTIFDGTEATVSKGVADQNGKALNDSVSWDYHKTTFTATTHNY

SYLNLTNDANEVNILKSRIPKEAEHINGDRTLYQFGATFTQKALMKAN

EILETQSSNARKKLIFHVTDGVPTMSYAINFNPYISTSYQNQFNSFLN

KIPDRSGILQEDFIINGDDYQIVKGDGESFKLFSDRKVPVTGGTTQAA

YRVPQNQLSVMSNEGYAINSGYIYLYWRDYNKVYPFDPKTKKVSATKQ

IKTHGEPTTLYFNGNIRPKGYDIFTVGIGVNGDPGATPLEAEKFMQSI

SSKTENYTNVDDTOKIYDELNKYFKTIVEEKHSIVDGNVTDPMGEMTE

FQLKNGQSFTHDDYVLVGNDGSQLKNGVALGGPNSDGGILKDVTVTYD

KTSQTIKINHLNLGSGQKVVLTYDVRLKDNYISNKFYNTNNRTTLSPK

SEKEPNTIRDFPIPKIRDVREFPVLTISNQKKMGEVEFIKVNKDKHSE

SLLGAKFQLQIEKDFSGYKQFVPEGSDVTTKNDGKIYEKALQDGNYKL

YEISSPDGYIEVKTKPVVTFTTQNGEVTNLKADPNANKNQIGYLEGNG

KHLITNT

GBS 104, like GBS 80, contains an amino acid motif indicative of a cell wall anchor: SEQ ID NO:123 FPKTG (shown in italics in SEQ ID NO:11 above). In some recombinant host cell systems, it may be preferable to remove this motif to facilitate secretion of a recombinant GBS 104 protein from the host cell. Accordingly, in one preferred fragment of GBS 104 for use in the invention, only the transmembrane and/or cytoplasmic regions and the cell wall anchor motif are removed from GBS 104. Alternatively, in some recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

Two pilin motifs, containing conserved lysine (K) residues, have been identified in GBS 104. The pilin motif sequences are underlined in SEQ ID NO:11, below. Conserved lysine (K) residues are marked in bold, at amino acid residues 141 and 149 and at amino acid residues 499 and 507. The pilin sequence, in particular the conserved lysine residues, are thought to be important for the formation of oligomeric, pilus-like structures of GBS 104. Preferred fragments of GBS 104 include at least one conserved lysine residue. Preferably, fragments include at least one pilin sequence.

SEQ ID NO. 11

MKKRQKIWRGLSVTLLILSQIPFGILVQGETQDTNQALGKVIVKKTGD

NATPLGKATFVLKNDNDKSETSHETVEGSGEATFENIKPGDYTLREET

APIGYKKTDKTWKVKVADNGATIIEGMDADKAEKR<u>KEVLNAQYPKSAI</u>

<u>YEDTK</u>ENYPLVNVEGSKVGEQYKALNPINGKDGRREIAEGWLSKKITG

VNDLDKNKYKIELTVEGKTTVETKELNQPLDVVVLLDNSNSMNNERAN

NSQRALKAGEAVEKLIDKITSNKDNRVALVTYASTIFDGTEATVSKGV

ADQNGKALNDSVSWDYHKTTFTATTHNYSYLNLTNDANEVNILKSRIP

KEAEHINGDRTLYQFGATFTQKALMKANEILETQSSNARKKLIFHVTD

GVPTMSYAINFNPYISTSYQNQFNSFLNKIPDRSGILQEDFIINGDDY

QIVKGDGESFKLFSDRKVPVTGGTTQAAYRVPQNQLSVMSNEGYAINS

GYIYLYWRD<u>YNWVYPFDPKTKKVSATK</u>QIKTHGEPTTLYFNGNIRPKG

YDIFTVGIGVNGDPGATPLEAEKFMQSISSKTENYTNVDDTNKIYDEL

NKYFKTIVEEKHSIVDGNVTDPMGEMIEFQLKNGQSFTHDDYVLVGND

GSQLKNGVALGGPNSDGGILKDVTVTYDKTSQTIKINHLNLGSGQKVV

LTYDVRLKDNYISNKFYNTNNRTTLSPKSEKEPNTIRDFPIPKIRDVR

EFPVLTISNQKKMGEVEFIKVNKDKHSESLLGAKFQLQIEKDFSGYKQ

FVPEGSDVTTKNDGKIYFKALQDGNYKLYEISSPDGYIEVKTKPWTFT

IQNGEVTNLKADPNANKNQIGYLEGNGKHLITNTPKRPPGVFPKTGGI

GTIVYILVGSTFMILTICSFRRKQL

Two E boxes containing a conserved glutamic residues have also been identified in GBS 104. The E box motifs are underlined in SEQ ID NO:11 below. The conserved glutamic acid (E) residues, at amino acid residues 94 and 798, are marked in bold. The E box motifs, in particular the conserved glutamic acid residues, are thought to be important for the formation of oligomeric pilus-like structures of GBS 104. Preferred fragments of GBS 104 include at least one conserved glutamic acid residue. Preferably, fragments include at least one E box motif

SEQ ID NO. 11

MKKRQKIWRGLSVTLLILSQIPFGILVQGETQDTNQALGKVIVKKTGD
NATPLGKATFVLKNDNDKSETSHETVEGSGEATFENIKPGDYTLREET
APIGYKKTDKTWKVKVADNGATIIEGMDADKAEKRKEVLNAQYPKSAI
YEDTKENYPLVNVEGSKVGEQYKALNPINGKDGRREIAEGWLSKKITG
VNDLDKNKYKIELTVEGKTTVETKELNQPLDVVVLLDNSNSMNNERAN
NSQRALKAGEAVEKLIDKITSNKDNRVALVTYASTIFDGTEATVSKGV
ADQNGKALNDSVSWDYHKTTFTATTHNYSYLNLTNDANEVNILKSRIP
KEAEHINGDRTLYQFGATFTQKALMKANEILETQSSNARKKLIFHVTD
GVPTMSYAINFNPYISTSYQNQFNSFLNKIPDRSGILQEDFIINGDDY
QIVKGDGESFKLFSDRKVPVTGGTTQAAYRVPQNQLSVMSNEGYAINS
GYIYLYWRDYNWVYPFDPKTKKVSATKQIKTHGEPTTLYFNGNIRPKG
YDIFTVGIGVNGDPGATPLEAEKFMQSISSKTENYTNVDDTNKIYDEL
NKYFKTIVEEKHSIVDGNVTDPMGEMIEFQLKNGQSFTHDDYVLVGND
GSQLKNGVALGGPNSDGGILKDVTVTYDKTSQTIKINHLNLGSGQKVV
LTYDVRLKDNYISNKFYNTNNRTTLSPKSEKEPNTIRDFPIPKIRDVR
EFPVLTISNQKKMGEVEFIKVNKDKHSESLLGAKFQLQIEKDFSGYKQ
FVPEGSDVTTKNDGKIYFKALQDGNYKLYEISSPDGYIEVKTKPVVTF
TIQNGEVTNLKADPNANKNQIGYLEGNGKHLITNTPKRPPGV*FPKTG*G
IGTIVYILVGSTFMILTICSFRRKQL

GBS 067

The following offers examples of preferred GBS 067 fragments. Nucleotide and amino acid sequence of GBS sequences from serotype V isolated strain 2603 are set forth below as SEQ ID NOS:15 and 16.

SEQ ID NO: 15

ATGAGAAAATACCAAAAATTTTCTAAAATATTGACGTTAAGTCTTTTT
TGTTTGTCGCAAATACCGCTTAATACCAATGTTTTAGGGGAAAGTACC
GTACCGGAAAATGGTGCTAAAGGAAAGTTAGTTGTTAAAAAGACAGAT
GACCAGAACAAACCACTTTCAAAAGCTACCTTTGTTTTAAAAACTACT
GCTCATCCAGAAAGTAAAATAGAAAAAGTAACTGCTGAGCTAACAGGT
GAAGCTACTTTTGATAATCTCATACCTGGAGATTATACTTTATCAGAA
GAAACAGCGCCCGAAGGTTATAAAAAGACTAACCAGACTTGGCAAGTT
AAGGTTGAGAGTAATGGAAAAACTACGATACAAAATAGTGGTGATAAA
AATTCCACAATTGGACAAAATCAGGAAGAACTAGATAAGCAGTATCCC
CCCACAGGAATTTATGAAGATACAAAGGAATCTTATAAACTTGAGCAT
GTTAAAGGTTCAGTTCCAAATGGAAAGTCAGAGGCAAAAGCAGTTAAC
CCATATTCAAGTGAAGGTGAGCATATAAGAGAAATTCCAGAGGGAACA
TTATCTAAACGTATTTCAGAAGTAGGTGATTTAGCTCATAATAAATAT
AAAATTGAGTTAACTGTCAGTGGAAAAACCATAGTAAAACCAGTGGAC
AAACAAAAGCCGTTAGATGTTGTCTTCGTACTCGATAATTCTAACTCA
ATGAATAACGATGGCCCAAATTTTCAAAGGCATAATAAAGCCAAGAAA

-continued

GCTGCCGAAGCTCTTGGGACCGCAGTAAAAGATATTTTAGGAGCAAAC
AGTGATAATAGGGTTGCATTAGTTACCTATGGTTCAGATATTTTTGAT
GGTAGGAGTGTAGATGTCGTAAAAGGATTTAAAGAAGATGATAAATAT
TATGGCCTTCAAACTAAGTTCACAATTCAGACAGAGAATTATAGTCAT
AAACAATTAACAAATAATGCTGAAGAGATTATAAAAAGGATTCCGACA
GAAGCTCCTAAAGCTAAGTGGGGATCTACTACCAATGGATTAACTCCA
GAGCAACAAAAGGAGTACTATCTTAGTAAAGTAGGAGAAACATTTACT
ATGAAAGCCTTCATGGAGGCAGATGATATTTTGAGTCAAGTAAATCGA
AATAGTCAAAAAATTATTGTTCATGTAACTGATGGTGTTCCTACGAGA
TCATATGCTATTAATAATTTTAAACTGGGTGCATCATATGAAAGCCAA
TTTGAACAAATGAAAAAAAATGGATATCTAAATAAAAGTAATTTTCTA
CTTACTGATAAGCCCGAGGATATAAAAGGAAATGGGGAGAGTTACTTT
TTGTTTCCCTTAGATAGTTATCAAACACAGATAATCTCTGGAAACTTA
CAAAAACTTCATTATTTAGATTTAAATCTTAATTACCCTAAAGGTACA
ATTTATCGAAATGGACCAGTGAAAGAACATGGAACACCAACCAAACTT
TATATAAATAGTTTAAAACAGAAAAATTATGACATTTTTAATTTTGGT
ATCGATATATCTGGTTTTAGACAAGTTTATAATGAGGAGTATAAGAAA
AATCAAGATGGTACTTTTCAAAAATTGAAAGAGGAAGCTTTTAAACTT
TCAGATGGAGAAATCACAGAACTAATGAGGTCGTTCTCTTCCAAACCT
GAGTACTACACCCCTATCGTAACTTCAGCCGATACATCTAACAATGAA
ATTTTATCTAAAATTCAGCAACAATTTGAAACGATTTTAACAAAAGAA
AACTCAATTGTTAATGGAACTATCGAAGATCCTATGGGTGATAAAATC
AATTTACAGCTTGGTAATGGACAAACATTACAGCCAAGTGATTATACT
TTACAGGGAAATGATGGAAGTGTAATGAAGGATGGTATTGCAACTGGT
GGGCCTAATAATGATGGTGGAATACTTAAGGGGGTTAAATTAGAATAC
ATCGGAAATAAACTCTATGTTAGAGGTTTGAATTTAGGAGAAGGTCAA
AAAGTAACACTCACATATGATGTGAAACTAGATGACAGTTTTATAAGT
AACAAATTCTATGACACTAATGGTAGAACAACATTGAATCCTAAGTCA
GAGGATCCTAATACACTTAGAGATTTTCCAATCCCTAAAATTCGTGAT
GTGAGAGAATATCCTACAATAACGATTAAAAACGAGAAGAAGTTAGGT
GAAATTGAATTTATAAAAGTTGATAAAGATAATAATAAGTTGCTTCTC
AAAGGAGCTACGTTTGAACTTCAAGAATTTAATGAAGATTATAAACTT
TATTTACCAATAAAAAATAATAATTCAAAAGTAGTGACGGGAGAAAAC
GGCAAAATTTCTTACAAAGATTTGAAAGATGGCAAATATCAGTTAATA
GAAGCAGTTTCGCCGGAGGATTATCAAAAAATTACTAATAAACCAATT
TTAACTTTTGAAGTGGTTAAAGGATCGATAAAAAATATAATAGCTGTT
AATAAACAGATTTCTGAATATCATGAGGAAGGTGACAAGCATTTAATT
ACCAACACGCATATTCCACCAAAAGGAATTATTCCTATGACAGGTGGG
AAAGGAATTCTATCTTTCATTTTAATAGGTGGAGCTATGATGTCTATT
GCAGGTGGAATTTATATTTGGAAAAGGTATAAGAAATCTAGTGATATG
TCCATCAAAAAAGAT

-continued

SEQ ID NO:16

MRKYQKFSKILTLSLFCLSQIPLNTNVLGESTVPENGAKGKLVVKKTD

DQNKPLSKATFVLKTTAHPESKIEKVTAELTGEATFDNLIPGDYTLSE

ETAPEGYKKTNQTWQVKVESNGKTTIQNSGDKNSTIGQNQEELDKQYP

PTGIYEDTKESYKLEHVKGSVPNGKSEAKAVNPYSSEGEHIREIPEGT

LSKRISEVGDLAHNKYKIELTVSGKTIVKPVDKQKPLDVVFVLDNSNS

MNNDGPNFQRHNKAKKAAEALGTAVKDILGANSDNRVALVTYGSDIFD

GRSVDVVKGFKEDDKYYGLQTKFTIQTENYSHKQLTNNAEEIIKRIPT

EAPKAKWGSTTNGLTPEQQKEYYLSKVGETFTMKAFMEADDILSQVNR

NSQKIIVHVTDGVPTRSYAINNFKLGASYESQFEQMKKNGYLNKSNFL

LTDKPEDIKGNGESYFLFPLDSYQTQIISGNLQKLHYLDLNLNYPKGT

IYRNGPVKEHGTPTKLYINSLKQKNYDIFNFGIDISGFRQVYNEEYKK

NQDGTFQKLKEEAFKLSDGEITELMRSFSSKPEYYTPIVTSADTSNNE

ILSKIQQQFETILTKENSIVNGTIEDPMGDKINLQLGNGQTLQPSDYT

LQGNDGSVMKDGIATGGPNNDGGILKGVKLEYIGNKLYVRGLNLGEGQ

KVTLTYDVKLDDSFISNKFYDTNGRTTLNPKSEDPNTLRDFPIPKIRD

VREYPTITIKNEKKLGEIEFIKVDKDNNKLLLKGATFELQEFNEDYKL

YLPIKNNNSKVVTGENGKISYKDLKDGKYQLIEAVSPEDYQKITNKPI

LTFEVVKGSIKNIIAVNKQISEYHEEGDKHLITNTHIPPKGI*IPMTG*G

KGILSFILIGGAMMSIAGGIYIWKRYKKSSDMSIKKD

GBS 067 contains a C-terminus transmembrane region which is indicated by the underlined region closest to the C-terminus of SEQ ID NO:16 above. In one embodiment, one or more amino acids from the transmembrane region is removed and or the amino acid is truncated before the transmembrane region. An example of such a GBS 067 fragment is set forth below as SEQ ID NO:17.

SEQ ID NO: 17

MRKYQKFSKILTLSLFCLSQIPLNTNVLGESTVPENGAKGKLVVKKTD

DQNKPLSKATFVLKTTAHPESKIEKVTAELTGEATPDNLIPGDYTLSE

ETAPEGYKKTNQTWQVKVESNGKTTIQNSGDKNSTIGQNQEELDKQYP

PTGIYEDTKESYKLEHVKGSVPNGKSEAKAVNPYSSEGEHIRETPEGT

LSKRISEVGDLAHNKYKTELTVSGKTIVKPVDKPKPLDVVFVLDNSNS

MNNDGPNFQRHNKAKKAAEALGTAVKDILGANSDNRVALVTYGSDIFD

GRSVDVVKGFKEDDKYYGLQTKETIQTENYSHKQLTNNAEEIIKRIPT

EAPKAKWGSTTNGLTPEQQKEYYLSKVGETFTMKAFMEADDILSQVNR

NSQKIIVHVTDGVPTRSYAINNFKLGASYESQFEQMKKNGYLNKSNFL

LTDKPEDIKGNGESYFLFPLDSYQTQIISGNLQKLHYLDLNLNYPKGT

IYRNGPVKEHGTPTKLYINSLKQKNYDIFNFGTDISGFRQVYNEEYKK

NQDGTFQKLKEEAFKLSDGEITELMRSESSKPEYYTPIVTSADTSNNE

ILSKIQQQFETILTKENSIVNGTIEDPMGDKINLQLGNGQTLQPSDYT

LQGNDGSVMKDGIATGGPNNDGGILKGVKLEYIGNKLYVRGLNLGEGQ

KVTLTYDVKLDDSFISNKFYDTNGRTTLNPKSEDPNTLRDFPIPKIRD

VREYPTITIKNEKKLGEIEFIKVDKDNNKLLLKGATFELQEFNEDYKL

YLPIKNNNSKVVTGENGKISYKDLKDGKYQLIEAVSPEDYQKITNKPI

LTFEVVKGSIKNIIAVNKQISEYHEEGDKHLITNTHIPPKGI*IPMTG*G

KGILS

GBS 067 contains an amino acid motif indicative of a cell wall anchor (an LPXTG (SEQ ID NO:122) motif): SEQ ID NO:18 IPMTG (shown in italics in SEQ ID NO:16 above). In some recombinant host cell systems, it may be preferable to remove this motif to facilitate secretion of a recombinant GBS 067 protein from the host cell. Accordingly, in one preferred fragment of GBS 067 for use in the invention, the transmembrane and the cell wall anchor motif are removed from GBS 67. An example of such a GBS 067 fragment is set forth below as SEQ ID NO:19.

SEQ ID NO: 19

MRKYQKFSKILTLSLFCLSQIPLNTNVLGESTVPENGAKGKLVVKKTD

DQNKPLSKATFVLKTTAHPESKIEKVTAELTGEATFDNLIPGDYTLSE

ETAPEGYKKTNQTWQVKVESNGKTTIQNSGDKNSTIGQNQEELDKQYP

PTGIYEDTKESYKLEHVKGSVPNGKSEAKAVNPYSSEGEHIREIPEGT

LSKRTSEVGDLAHNKYKIELTVSGKTIVKPVDKQKPLDVVFVLDNSNS

MNNDGPNFQRHNKAKKPAEALGTAVKDILGANSDNRVALVTYGSDIFD

GRSVDVVKGFKEDDKYYGLQTKFTIQTENYSHKQLTNNAEEIIKRIPT

EAPKAKWGSTTNGLTPEQQKEYYLSKVGETFTMKAFMEADDILSQVNR

NSQKIIVHVTDGVPTRSYAINNFKLGASYESQFEQMKKNGYLNKSNFL

LTDKPEDIKGNGESYFLFPLDSYQTQIISGNLQKLHYLDLNLNYPKGT

IYRNGPVKEHGTPTKLYINSLKQKNYDIFNFGIDISGERQVYNEEYKK

NQDGTFQKLKEEAFKLSDGEITELMRSFSSKPEYYTPIVTSADTSNNE

ILSKIQQQFETILTKENSIVNGTIEDPMGDKINLQLGNGQTLQPSDYT

LQGNDGSVMKDGIATGGPNNDGGILKGVKLEYIGNKLYVRGLNLGEGQ

KVTLTYDVKLDDSFTSNKFYDTNGRTTLNPKSEDPNTLRDFPIPKIRD

VREYPTITIKNEKKLGEIEFIKVDKDNNKLLLKGATFELQEFNEDYKL

YLPIKNNNSKVVTGENGKISYKDLKDGKYQLIEAVSPEDYQKITNKPI

LTFEWKGSIKNIIAVNKQISEYHEEGDKHLITNTHIPPKGI

Alternatively, in some recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

Three pilin motifs, containing conserved lysine (K) residues have been identified in GBS 67. The pilin motif sequences are underlined in SEQ ID NO:16, below. Conserved lysine (K) residues are marked in bold, at amino acid residues 478 and 488, at amino acid residues 340 and 342, and at amino acid residues 703 and 717. The pilin sequences, in particular the conserved lysine residues, are thought to be important for the formation of oligomeric, pilus-like structures of GBS 67. Preferred fragments of GBS 67 include at least one conserved lysine residue. Preferably, fragments include at least one pilin sequence.

SEQ ID NO: 16

```
MRKYQKFSKILTLSLFCLSQIPLNTNVLGESTVPENGAKGKLVVKKTD
DQNKPLSKATFVLKTTAHPESKIEKVTAELTGEATFDNLIPGDYTLSE
ETAPEGYKKTNQTWQVKVESNGKTTIQNSGDKNSTIGQNQEELDKQYP
PTGIYEDTKESYKLEHVKGSVPNGKSEAKAVNPYSSEGEHIREIPEGT
LSKRISEVGDLAHNKYKIELTVSGKTIVKPVDKQKPLDVVFVLDNSNS
MNNDGPNFQRHNKAKKAAEALGTAVKDILGANSDNRVALVTYGSDIFD
GRSVDVVKGFKEDDKYYGLQTKFTIQTENYSHKQLTNNAEEIIKRIPT
EAPKAKWGSTINGLIPEQQKEYYLSKVGETFTMKAFMEADDILSQVNR
NSQKIIVHVTDGVPTRSYAINNFKLGASYESQFEQMKKNGYLNKSNFL
LTDKPEDIKGNGESYFLFPLDSYQTQIISGNLQKLHYLDLNLNYPKGT
IYRNGPVKEHGTPTKLYINSLKQKNYDIFNFGIDISGFRQVYNEEYKK
NQDGTFQKLKEEAFKLSDGEITELMRSFSSKPEYYTPIVTSADTSNNE
ILSKIQQQFETILTKENSIVNGTIEDPMGDKINLQLGNGQTLQPSDYT
LQGNDGSVMKDGIATGGPNNDGGILKGVKLEYIGNKLYVRGLNLGEGQ
KVILTYDVKLDDSFISNKFYDTNGRTTLNPKSEDPNTLRDFPIPKIRD
VREYPTITIKNEKKLGEIEFIKVDKDNNKLLLKGATFELQEFNEDYKL
YLPIKNNNSKVVTGENGKISYKDLKDGKYQLIEAVSPEDYQKITNKPI
LTFEVVKGSIKNIIAVNKQISEYHEEGDKHLITNTHIPPKGIIPMTGG
KGILSFILIGGAMMSIAGGIYIWKRYKKSSDMSIKKD
```

Two E boxes containing conserved glutamic residues have also been identified in GBS 67. The E box motifs are underlined in SEQ ID NO:16 below. The conserved glutamic acid (E) residues, at amino acid residues 96 and 801, are marked in bold. The E box motifs, in particular the conserved glutamic acid residues, are thought to be important for the formation of oligomeric pilus-like structures of GBS 67. Preferred fragments of GBS 67 include at least one conserved glutamic acid residue. Preferably, fragments include at least one E box motif

SEQ ID NO: 16

```
MRKYQKFSKILTLSLFCLSQIPLNTNVLGESTVPENGAKGKLVVKKTD
DQNKPLSKATFVLKTTAHPESKIEKVTAELTGEATFDNLIPGDYTLSE
ETAPEGYKKTNQTWQVKVESNGKTTIQNSGDKNSTIGQNQEELDKQYP
PTGIYEDTKESYKLEHVKGSVPNGKSEAKAVNPYSSEGEHIREIPEGT
LSKRISEVGDLAHNKYKIELTVSGKTIVKPVDKQKPLDVVFVLDNSNS
MNNDGPNFQRHNKAKKAAEALGTAVKDILGANSDNRVALVTYGSDIFD
GRSVDVVKGFKEDDKYYGLQTKFTIQTENYSHKQLTNNAEEIIKRIPT
EAPKAKWGSTTNGLTPEQQKEYYLSKVGETFTMKAFMEADDILSQVNR
NSQKIIVHVTDGVPIRSYAINNFKLGASYESQFEQMKKNGYLNKSNFL
LTDKPEDIKGNGESYFLFPLDSYQTQIISGNLQKLHYLDLNLNYPKGT
IYRNGPVKEHGTPTKLYINSLKQKNYDIFNFGIDISGFRQVYNEEYKK
NQDGTFQKLKEEAFKLSDGEITELMRSFSSKPEYYTPIVTSADTSNNE
ILSKIQQQFETILTKENSIVNGTIEDPMGDKINLQLGNGQTLQPSDYT
```

-continued

```
LQGNDGSVMKDGIATGGPNNDGGILKGVKLEYIGNKLYVRGLNLGEGQ
KVTLTYDVKLDDSFISNKFYDTNGRTTLNPKSEDPNTLRDFPIPKIRD
VREYPTITIKNEKKLGEIEFIKVDKDNNKLLLKGATFELQEFNEDYKL
YLPIKNNNSKVVTGENGKISYKDLKDGKYQLIEAVSPEDYQKITNKPI
LTFEVVKGSIKNIIAVNKQISEYHEEGDKHLITNTHIPPKGIIPMTGG
KGILSFILIGGAMMSIAGGIYIWKRYKKSSDMSIKKD
```

Figure 33:
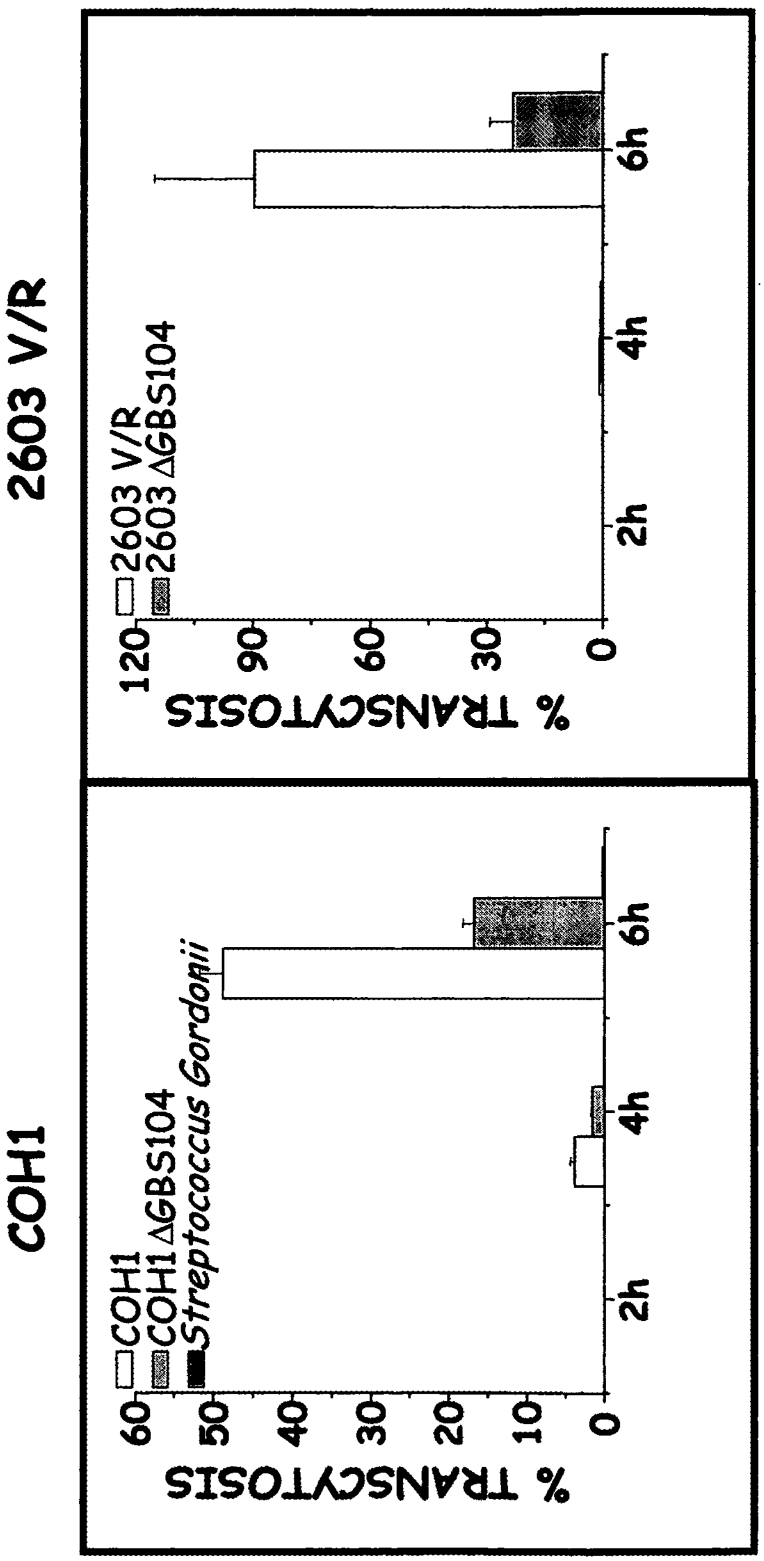
FIG. 33: Illustrates that GBS 104 knockout mutant strain translocates through an epithelial monolayer less efficiently than the isogenic wild type.

Predicted secondary structure for the GBS 067 amino acid sequence is set forth in FIG. 33. As shown in this FIG., GBS 067 contains several regions predicted to form alpha helical structures. Such alpha helical regions are likely to form coiled-coil structures and may be involved in oligomerization of GBS 067.

The amino acid sequence for GBS 067 also contains a region which is homologous to the Cna_B domain of the *Staphylococcus aureus* collagen-binding surface protein (pfam05738). Although the Cna_B region is not thought to mediate collagen binding, it is predicted to form a beta sandwich structure. In the *Staph aureus* protein, this beta sandwich structure is through to form a stalk that presents the ligand binding domain away from the bacterial cell surface. This same amino acid sequence region is also predicted to be an outer membrane protein involved in cell envelope biogenesis.

The amino acid sequence for GBS 067 contains a region which is homologous to a von Willebrand factor (vWF) type A domain. The vWF type A domain is present at amino acid residues 229-402 of GBS 067 as shown in SEQ ID NO:16. This type of sequence is typically found in extracellular proteins such as integrins and it thought to mediate adhesion, including adhesion to collagen, fibronectin, and fibrinogen, discussed above.

Because applicants have identified GBS 67 as a surface exposed protein on GBS and because GBS 67 may be involved in GBS adhesion, the immunogenicity of the GBS 67 protein was examined in mice. The results of an immunization assay with GBS 67 are set forth in Table 48, below.

TABLE 48

GBS 67 Protects Mice in an Immunization Assay

| Challenge | GBS 67 immungen | | PBS immunogen | | |
|---|---|---|---|---|---|
| GBS strain (serotype) | dead/ treated | % survival | dead/ treated | % survival | FACS Δmean |
| 3050 (II) | 0/30 | 100 | 29/49 | 41 | 460 |
| CJB111 (V) | 76/185 | 59 | 143/189 | 24 | 481 |
| 7357 b (Ib) | 34/56 | 39 | 65/74 | 12 | 316 |

As shown in Table 48, immunization with GBS 67 provides a substantially improved survival rate for challenged mice relative to negative control, PBS, immunized mice. These results indicate that GBS 67 may comprise an immunogenic composition of the invention.

GBS 59

The following offers examples of GBS 59 fragments. Nucleotide and amino acid sequences of GBS sequenced from serotype V isolated strain 2603 are set forth below as SEQ ID NOS:125 and 126. The GBS 59 polypeptide of SEQ ID NO:126 is referred to as SAG1407.

SEQ ID NO: 125
ttaagcttcctttgattggcgtcttttcatgataactactgctccaag
cataatgcttaaaccaataattgtgaaaagaattgtaccaataccacc
tgtttgtgggattgttaccttttttatttctacacgtgtcgcatcttt
ttggttgctgttagcaacgtagtcaatgttaccacctgttatgtatga
cccttgattaactacaaacttaatattacctgccaacttagcaaatcc
tgctggagcaagtgtttcttcaaggttgtaagtaccgtctgcaagacc
tgtaacttcaaattgaccttgatcgtttgaagtgtaggtaatggctct
agccttatctgttatccactcataagctgtacgagcctcaatgaaggc
tgcatcgtaatctgcttgtttagttttgataagttcttttgcagtaat
tcctttttcacctttttggtctgttgcagacaacttgttataagcagc
gatagcttcatctaaagctatttcttagcagctaaagtttttttgacc
ttctgattgatctgctttaagagcaaggtatttacctgctgagttttt
cacaacgaattgtgcaccagccaaacggtcaccttgttcattagtttt
gacaaatttcttaccatgagtttcaacttttggttcagttgggttcaa
tggtgttgggttatcagaatctttggtattggtaatggttactttacc
attttctagatttattgcacttccgtaaccagaaacacgttctgagat
catgtatgatttgttttctagaccagtgaatttacccgagaagttacc
agatacttcaaatttgataccatttccaaggtcgattgtacctttaga
tgtttttgtcaatgatactgaagcaacagttttatctttatctttcaa
tgtgtaaacaacgtttacaccatcaggtgcaattccgtcagaccaagt
tttagcaactgttacttcaccctttgaaggtgtaacaggaagttcagt
caagtctttacctggtttgttaccatacgacaatttgatatcattgga
ttctggattatcaataattgcttgaccattaacagtagcactataagt
caatgtaaattcaatatcagctgttttagctgcttttttccaatttgcc
caatccatcagctgtgaattttaatgtgaaaccacgggcatcaatgct
aagttcatagtctgtatccttagcaaaagtttctgtagttcctgaagc
tttaaggctaacagttgaacccattgtcaaaccatttgacattatatc
tgtccaaaccaagttttcgtatttagaacctttgtgaatttttgtttt
aacttcataaggaacaactttaccgatttcagcagtagcagttgcttt
gtcacgtgcataattaccataatttgcgccagctgtcaaaagtctatt
aacatctgtcaatgctgtcaaatcgtttgttttagcaaagtttttatc
aatttctggtttttcttcagtgttctttggataaacatgggcatcagc
aacaacaccatcttcatttaccaatggaagagtgatgttaactggaac
cgcttttgaagcagccaggagggaaccattattgttgtaagtagattt
tgatttaacttcaacaattttaaactcgcctttcaatcctttggtgtt
gaaaacaagtccagtatctccctctggtgtcaatccagacacggcctc
atcaatatttactgttatttcaggagtaccatctttattaattaaggc
tggtgttaatttgttaccttcttttgccttaacatattgcactttacc
acttttatcttctttcaaagctaaagcaaagaacgcaccttcgatttc
tttagatccctcgccaaagtaaccagcaaggtcagaaatagctccacc -continued tttgtagtcttttccgttaagacctgtagttcctgggaagttactttt
gttaagatttgattcggtttgcaaaatcttgtgcaaagtcactgtatt
agttgttgcttcatccgcaaacgctggtgcaactgagagcaatgacgt
taaagtcagtaacaatgccgagaacattgcaaaatatttgttgattct
tttcat SEQ ID NO: 126
MKRINKYFAMFSALLLTLTSLLSVAPAFADEATTNTVTLHKILQTESN
LNKSNFPGTTGLNGKDYKGGAISDLAGYFGEGSKEIEGAFFALALKED
KSGKVQYVKAKEGNKLTPALINKDGTPEITVNIDEAVSGLTPEGDTGL
VFNTKGLKGEFKIVEVKSKSTYNNNGSLLAASKAVPVNITLPLVNEDG
VVADAHVYPKNTEEKPEIDKNFAKTNDLTALTDVNRLLTAGANYGNYA
RDKATATAEIGKVVPYEVKTKIHKGSKYENLVWTDIMSNGLTMGSTVS
LKASGTTETFAKDTDYELSIDARGFTLKFTADGLGKLEKAAKTADIEF
TLTYSATVNGQAIIDNPESNDIKLSYGNKPGKDLTELPVTPSKGEVTV
AKTWSDGIAPDGVNVVYTLKDKDKTVASVSLTKTSKGTIDLGNGIKPE
VSGNFSGKETGLENKSYMISERVSGYGSAINLENGKVTITNTKDSDNP
TPLNPTEPKVETHGKKFVKTNEQGDRLAGAQFVVKNSAGKYLALKADQ
SEGQKTLAAKKIALDEAIAAYNKLSATDQKGEKGITAKELIKTKQADY
DAAFIEARTAYEWITDKARAITYTSNDQGQFEVTGLADGTYNLEETLA
PAGFAKLAGNIKFVVNQGSYITGGNIDYVANSNQKDATRVENKKVT*IP*
*QTG*GIGTILETIIGLSIMLGAVVIMKRR QSKEA Nucleotide and amino acid sequences of GBS sequenced from serotype V isolated strain CJB111 are set forth below as SEQ ID NOS:127 and 128. The GBS 59 polypeptide of SEQ ID NO:128 is referred to as BO1575.

SEQ ID NO: 127
ATGAAAAAAATCAACAAATGTCTTACAATGTTCTCGACACTGCTATTG
ATCTTAACGTCACTATTCTCAGTTGCACCAGCGTTTGCGGACGACGCA
ACAACTGATACTGTGACCTTGCACAAGATTGTCATGCCACAAGCTGCA
TTTGATAACTTTACTGAAGGTACAAAAGGTAAGAATGATAGCGATTAT
GTTGGTAAACAAATTAATGACCTTAAATCTTATTTTGGCTCAACCGAT
GCTAAAGAAATCAAGGGTGCTTTCTTTGTTTTCAAAAATGAAACTGGT
ACAAAATTCATTACTGAAAATGGTAAGGAAGTCGATACTTTGGAAGCT
AAAGATGCTGAAGGTGGTGCTGTTCTTTCAGGGTTAACAAAAGACAAT
GGTTTTGTTTTTAACACTGCTAAGTTAAAAGGAATTTACCAAATCGTT
GAATTGAAAGAAAAAATCAAACTACGATAACAACGGTTCTATCTTGGCT
GATTCAAAAGCAGTTCCAGTTAAAATCACTCTGCCATTGGTAAACAAC
CAAGGTGTTGTTAAAGATGCTCACATTTATCCAAAGAATACTGAAACA
AAACCACAAGTAGATAAGAACTTTGCAGATAAAGATCTTGATTATACT
GACAACCGAAAAGACAAAGGTGTTGTCTCAGCGACAGTTGGTGACAAA
AAAGAATACATAGTTGGAACAAAAAATTCTTAAAGGCTCAGACTATAAG
AAACTGGTTTGGACTGATAGCATGACTAAAGGTTTGACGTTCAACAAC

-continued

AACGTTAAAGTAACATTGGATGGTGAAGATTTTCCTGTTTTAAACTAC

AAACTCGTAACAGATGACCAAGGTTTCCGTCTTGCCTTGAATGCAACA

GGTCTTGCAGCAGTAGCAGCAGCTGCAAAAGACAAAGATGTTGAAATC

AAGATCACTTACTCAGCTACGGTGAACGGCTCCACTACTGTTGAAATT

CCAGAAACCAATGATGTTAAATTGGACTATGGTAATAACCCAACGGAA

GAAAGTGAACCACAAGAAGGTACTCCAGCTAACCAAGAAATTAAAGTC

ATTAAAGACTGGGCAGTAGATGGTACAATTACTGATGCTAATGTTGCA

GTTAAAGCTATCTTTACCTTGCAAGAAAAACAAACGGATGGTACATGG

GTGAACGTTGCTTCACACGAAGCAACAAAACCATCACGCTTTGAACAT

ACTTTCACAGGTTTGGATAATGCTAAAACTTACCGCGTTGTCGAACGT

GTTAGCGGCTACACTCCAGAATACGTATCATTTAAAAATGGTGTTGTG

ACTATCAAGAACAACAAAAACTCAAATGATCCAACTCCAATCAACCCA

TCAGAACCAAAAGTGGTGACTTATGGACGTAAATTTGTGAAAACAAAT

CAAGCTAACACTGAACGCTTGGCAGGAGCTACCTTCCTCGTTAAGAAA

GAAGGCAAATACTTGGCACGTAAAGCAGGTGCAGCAACTGCTGAAGCA

AAGGCAGCTGTAAAAACTGCTAAACTAGCATTGGATGAAGCTGTTAAA

GCTTATAACGACTTGACTAAAGAAAAACAAGAAGGCCAAGAAGGTAAA

ACAGCATTGGCTACTGTTGATCAAAAACAAAAAGCTTACAATGACGCT

TTTGTTAAAGCTAACTACTCATATGAATGGGTTGCAGATAAAAAGGCT

GATAATGTTGTTAAATTGATCTCTAACGCCGGTGGTCAATTTGAAATT

ACTGGTTTGGATAAAGGCACTTATGGCTTGGAAGAAACTCAAGCACCA

GCAGGTTATGCGACATTGTCAGGTGATGTAAACTTTGAAGTAACTGCC

ACATCATATAGCAAAGGGGCTACAACTGACATCGCATATGATAAAGGC

TCTGTAAAAAAAGATGCCCAAGAAGTTCAAAACAAAAAAGTAACCATC

CCACAAACAGGTGGTATTGGTACAATTCTTTTCACAATTATTGGTTTA

AGCATTATGCTTGGAGCAGTAGTTATCATGAAAAAACGTCAATCAGAG

GAAGCTTAA

SEQ ID NO: 128

MKKINKCLTMFSTLLLILTSLFSVAPAFADDATTDTVTLHKIVMPQAA

FDNFTEGTKGKNDSDYVGKQINDLKSYFGSTDAKEIKGAFFVFKNETG

TKEITENGKEVDTLEAKDAEGGAVLSGLTKDNGFVFNTAKLKGIYQIV

ELKEKSNYDNNGSILADSKAVPVKITLPLVNNQGVVKDAHIYPKNTET

KPQVDKNFADKDLDYTDNRKDKGVVSATVGDKKEYIVGTKILKGSDYK

KLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTE

ESEPQEGTPANQEIKVIKDWAVDGTITDANVAVKAIFTLQEKQTDGTW

VNVASHEATKPSRFEHTFTGLDNAKTYRVVERVSGYTPEYVSFKNGVV

TIKNNKNSNDPTPINPSEPKVVTYGRKFVKTNQANTERLAGATFLVKK

EGKYLARKAGAATAEAKAAVKTAKLALDEAVKAYNDLTKEKQEGQEGK

TALATVDQKQKAYNDAFVKANYSYEWVADKKADNVVKLISNAGGQFEI

TGLDKGTYGLEETQAPAGYATLSGDVNFEVTATSYSKGATTDIAYDKG

-continued

SVKKDAQQVQNKKVT*IPQTG*GIGTILFTIIGLSIMLGAVVIMKKRQSE

EA

The GBS 59 polypeptides contain an amino acid motif indicative of a cell wall anchor: SEQ ID NO:129 IPQTG (shown in italics in SEQ ID NOS:126 and 128 above). In some recombinant host cell systems, it may be preferable to remove this motif to facilitate secretion of a recombinant GBS 59 protein from the host cell. Alternatively, in some recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

Pilin motifs, containing conserved lysine (K) residues have been identified in the GBS 59 polypeptides. The pilin motif sequences are underlined in each of SEQ ID NOS:126 and 128, below. Conserved lysine (K) residues are marked in bold. The conserved lysine (K) residues are located at amino acid residues 202 and 212 and amino acid residues 489 and 495 of SEQ ID NO:126 and at amino acid residues 188 and 198 of SEQ ID NO:128. The pilin sequences, in particular the conserved lysine residues, are thought to be important for the formation of oligomeric, pilus-like structures of GBS 59. Preferred fragments of GBS 59 include at least one conserved lysine residue. Preferably, fragments include at least one pilin sequence.

SEQ ID NO: 126

MKRINKYFAMFSALLLTLTSLLSVAPAFADEATTNTVTLHKILQTESN

LNKSNFPGTTGLNGKDYKGGAISDLAGYFGEGSKEIEGAFFALALKED

KSGKVQYVKAKEGNKLTPALINKDGTPEITVNIDEAVSGLTPEGDTGL

VFNTKGLKGEFKIVEVKSKSTYNNNGSLLAASKAVPVNITLPLVNEDG

VVADAHVYPKNTEEKPEIDKNFAKTNDLTALTDVNRLLTAGANYGNYA

RDKATATAEIGKVVPYEVKTKIHKGSKYENLVWTDIMSNGLTMGSTVS

LKASGTTETFAKDTDYELSIDARGFTLKFTADGLGKLEKAAKTADIEF

TLTYSATVNGQAIIDNPESNDIKLSYGNKPGKDLTELPVTPSKGEVTV

AKTWSDGIAPDGVNVVYTLKDKDKTVASVSLTKTSKGTIDLGNGIKFE

VSGNFSGKFTGLENKSYMISERVSGYGSAINLENGKVTITNTKDSDNP

TPLNPTEPKVETHGKKFVKTNEQGDRLAGAQFVVKNSAGKYLALKADQ

SEGQKTLAAKKIALDEAIAAYNKLSATDQKGEKGITAKELIKTKQADY

DAAFIEARTAYEWITDKARAITYTSNDQGQFEVTGLADGTYNLEETLA

PAGFAKLAGNIKFVVNQGSYITGGNIDYVANSNQKDATRVENKKVTIP

QTGGIGTILETIIGLSIMLGAVVIMKRRQSKEA

SEQ ID NO: 128

MKKINKCLTMFSTLLLILTSLFSVAPAFADDATTDTVTLHKIVMPQAA

FDNFTEGTKGKNDSDYVGKQINDLKSYFGSTDAKEIKGAFFVFKNETG

TKEITENGKEVDTLEAKDAEGGAVLSGLTKDNGFVFNTAKLKGIYQIV

ELKEKSNYDNNGSILADSKAVPVKITLPLVNNQGVVKDAHIYPKNTET

KPQVDKNFADKDLDYTDNRKDKGVVSATVGDKKEYIVGTKILKGSDYK

-continued

KLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTE

ESEPQEGTPANQEIKVIKDWAVDGTITDANVAVKAIFTLQEKQTDGTW

VNVASHEATKPSRFEHTFTGLDNAKTYRVVERVSGYTPEYVSFKNGVV

TIKNNKNSNDPTPINPSEPKVVTYGRKFVKTNQANTERLAGATFLVKK

EGKYLARKAGAATAEAKAAVKTAKLALDEAVKAYNDLTKEKQEGQEGK

TALATVDQKQKAYNDAFVKANYSYEWVADKKADNVVKLISNAGGQFEI

TGLDKGTYGLEETQAPAGYATLSGDVNFEVTATSYSKGATTDIAYDKG

SVKKDAQQVQNKKVTIPQTGGIGTILFTIIGLSIMLGAVVIMKKRQSE

EA

An E box containing a conserved glutamic residue has also been identified in each of the GBS 59 polypeptides. The E box motif is underlined in each of SEQ ID NOS:126 and 128 below. The conserved glutamic acid (E) is marked in bold at amino acid residue 621 in SEQ ID NO:126 and at amino acid residue 588 in SEQ ID NO:128. The E box motif, in particular the conserved glutamic acid residue, is thought to be important for the formation of oligomeric pilus-like structures of GBS 59. Preferred fragments of GBS 59 include the conserved glutamic acid residue. Preferably, fragments include the E box motif

SEQ ID NO: 126

MKRINKYFAMFSALLLTLTSLLSVAPAFADEATTNTVTLHKILQTESN

LNKSNFPGTTGLNGKDYKGGAISDLAGYFGEGSKEIEGAFFALALKED

KSGKVQYVKAKEGNKLTPALINKDGTPEITVNIDEAVSGLTPEGDTGL

VFNTKGLKGEFKIVEVKSKSTYNNNGSLLAASKAVPVNITLPLVNEDG

VVADAHVYPKNTEEKPEIDKNFAKTNDLTALTDVNRLLTAGANYGNYA

RDKATATAEIGKVVPYEVKTKIHKGSKYENLVWTDIMSNGLTMGSTVS

LKASGTTETFAKDTDYELSIDARGFTLKFTADGLGKLEKAAKTADIEF

TLTYSATVNGQAIIDNPESNDIKLSYGNKPGKDLTELPVTPSKGEVTV

AKTWSDGIAPDGVNVVYTLKDKDKTVASVSLTKTSKGTIDLGNGIKFE

VSGNFSGKFTGLENKSYMISERVSGYGSAINLENGKVTITNTKDSDNP

TPLNPTEPKVETHGKKFVKTNEQGDRLAGAQFVVKNSAGKYLALKADQ

SEGQKTLAAKKIALDEAIAAYNKLSATDQKGEKGITAKELIKTKQADY

DAAFIEARTAYEWITDKARAITYTSNDQGQFEVTGLADGTYNLEETLA

PAGFAKLAGNIKFVVNQGSYITGGNIDYVANSNQKDATRVENKKVTIP

QTGGIGTILETIIGLSIMLGAVVIMKRRQSKEA

SEQ ID NO: 128

MKKINKCLTMFSTLLLILTSLFSVAPAFADDATTDTVTLHKIVMPQAA

FDNFTEGTKGKNDSDYVGKQINDLKSYFGSTDAKEIKGAFFVFKNETG

TKFITENGKEVDTLEAKDAEGGAVLSGLTKDNGFVFNTAKLKGIYQIV

ELKEKSNYDNNGSILADSKAVPVKITLPLVNNQGVVKDAHIYPKNTET

KPQVDKNFADKDLDYTDNRKDKGVVSATVGDKKEYIVGTKILKGSDYK

KLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTE

-continued

ESEPQEGTPANQEIKVIKDWAVDGTITDANVAVKAIFTLQEKQTDGTW

VNVASHEATKPSRFEHTFTGLDNAKTYRVVERVSGYTPEYVSFKNGVV

TIKNNKNSNDPTPINPSEPKVVTYGRKFVKTNQANTERLAGATFLVKK

EGKYLARKAGAATAEAKAAVKTAKLALDEAVKAYNDLTKEKQEGQEGK

TALATVDQKQKAYNDAFVKANYSYEWVADKKADNVVKLISNAGGQFEI

TGLDKGTYGLEETQAPAGYATLSGDVNFEVTATSYSKGATTDIAYDKG

SVKKDAQQVQNKKVTIPQTGGIGTILFTIIGLSIMLGAVVIMKKRQSE

EA

Female mice were immunized with either SAG1407 (SEQ ID NO:126) or BO1575 (SEQ ID NO:128) in an active maternal immunization assay. Pups bred from the immunized female mice survived GBS challenge better than control (PBS) treated mice. Results of the active maternal immunization assay using the GBS 59 immunogenic compositions are shown in Table 17, below.

TABLE 17

GBS 67 Protects Mice in an Immunization Assay

| Challenge | GBS 67 immungen | | PBS immunogen | | |
|---|---|---|---|---|---|
| GBS strain (serotype) | dead/ treated | % survival | dead/ treated | % survival | FACS Δmean |
| 3050 (II) | 0/30 | 100 | 29/49 | 41 | 460 |
| CJB111 (V) | 76/185 | 59 | 143/189 | 24 | 481 |
| 7357 b (Ib) | 34/56 | 39 | 65/74 | 12 | 316 |

Figure 67:
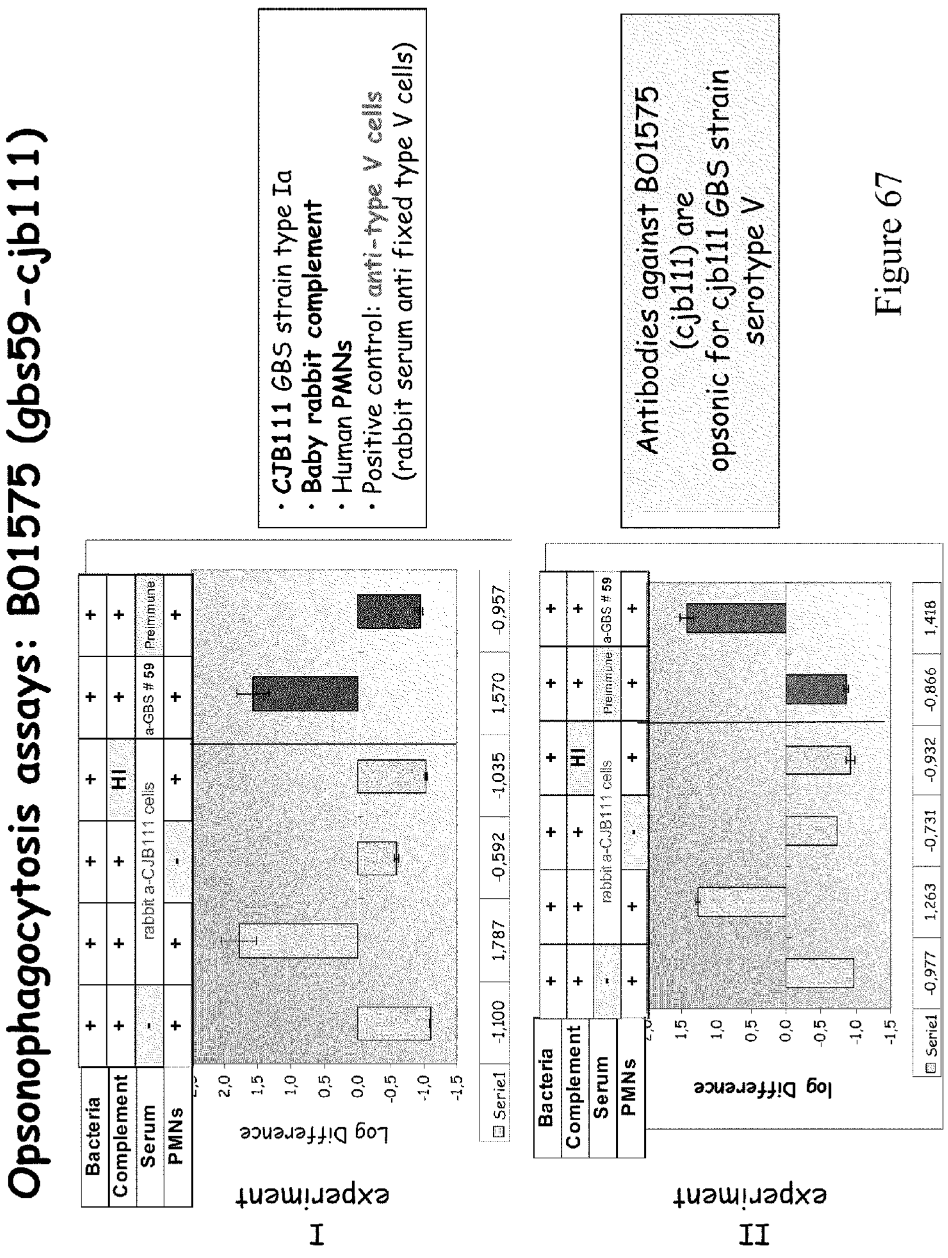
FIG. 67: Illustrates that anti-GBS 59 antibodies are opsonic for CJB111 GBS strain serotype V.

Opsonophagocytosis assays also demonstrated that antibodies against BO 1575 are opsonic for GBS serotype V, strain CJB111. See FIG. 67.

GBS 52

Examples of polynucleotide and amino acid sequences for GBS 52 are set forth below. SEQ ID NO:20 and 21 represent GBS sequences from GBS serotype V, strain isolate 2603.

SEQ ID NO: 20

ATGAAACAAACATTAAAACTTATGTTTTCTTTTCTGTTGATGTTAGGG

ACTATGTTTGGAATTAGCCAAACTGTTTTAGCGCAAGAAACTCATCAG

TTGACGATTGTTGATCTTGAAGCAAGGGATATTGATCGTCCAAATCCA

CAGTTGGAGATTGCCCCTAAAGAAGGGACTCCAATTGAAGGAGTACTC

TATCAGTTGTACCAATTAAAATCAACTGAAGATGGGGATTTGTTGGCA

GATTGGAATTCCCTAACTATCACAGAATTGAAAAAACAGGCGCAGCAG

GTTTTTGAAGCGACTACTAATCAACAAGGAAAGGCTACATTTAACCAA

CTACCAGATGGAATTTATTATGGTCTGGCGGTTAAAGCCGGTGAAAAA

AATCGTAATGTCTCAGCTTTCTTGGTTGACTTGTCTGAGGATAAAGTG

ATTTATCCTAAAATCATCTGGTCCACAGGTGAGTTGGACTTGCTTAAA

GTTGGTGTGGATGGTGATACCAAAAAACCACTAGCAGGCGTTGTCTTT

GAACTTTATGAAAAGAATGGTAGGACTCCTATTCGTGTGAAAAATGGG

GTGCATTCTCAAGATATTGACGCTGCAAAACATTTAGAAACAGATTCA

TCAGGGCATATCAGAATTTCCGGGCTCATCCATGGGGACTATGTCTTA

-continued

AAAGAAATCGAGACACAGTCAGGATATCAGATCGGACAGGCAGAGACT

GCTGTGACTATTGAAAAATCAAAAACAGTAACAGTAACGATTGAAAAT

AAAAAAGTTCCGACACCTAAAGTGCCATCTCGAGGAGGTCTTATTCCC

AAAACAGGTGAGCAACAGGCAATGGCACTTGTAATTATTGGTGGTATT

TTAATTGCTTTAGCCTTACGATTACTATCAAAACATCGGAAACATCAA

AATAAGGAT

SEQ ID NO: 21

MKQTLKLMFSFLLMLGTMFGISQTVLAQETHQLTIVHLEARDIDRPNP

QLEIAPKEGTPIEGVLYQLYQLKSTEDGDLLAHWNSLTITELKKQAQQ

VFEATTNQQGKATFNQLPDGIYYGLAVKAGEKNRNVSAFLVDLSEDKV

IYPKIIWSTGELDLLKVGVDGDTKKPLAGVVFELYEKNGRTPIRVKNG

VHSQDIDAAKHLETDSSGHIRISGLIHGDYVLKEIETQSGYQIGQAET

AVTIEKSKTVTVTIENKKVPTPKVPSRGGL*IPKTG*EQQAMALVIIGGI

LIALALRLLSKHRKHQNKD

GBS 52 contains an amino acid motif indicative of a cell wall anchor: SEQ ID NO:124 IPKTG (shown in italics in SEQ ID NO:21, above). In some recombinant host cell systems, it may be preferable to remove this motif to facilitate secretion of a recombinant GBS 52 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in GBS 52. The pilin motif sequence is underlined in SEQ ID NO:21, below. Conserved lysine (K) residues are also marked in bold, at amino acid residues 148 and 160. The pilin sequence, in particular the conserved lysine residues, are thought to be important for the formation of oligomeric, pilus-like structures. Preferred fragments of GBS 52 include at least one conserved lysine residue. Preferably, fragments include the pilin sequence.

SEQ ID NO: 21

MKQTLKLMESELLMLGTMEGISQTVLAQETHQLTIVHLEARDIDRPNP

QLEIAPKEGTPIEGVLYQLYQLKSTEDGDLLAHWNSLTITELKKQAQQ

VFEATTNQQGKATFNQLPDGIYYGLAVKAGEKNRNVSAFLVDLSEDKV

IYPKIIWSTGELDLLKVGVDGDTKKPLAGVVFELYEKNGRTPIRVKNG

VHSQDIDAAKHLETDSSGHIRISGLIHGDYVLKEIETQSGYQIGQAET

AVTIEKSKTVTVTIENKKVPTPKVPSRGGLIPKTGEQQAMALVIIGGI

LIALALRLLSKHRKHQNKD

An E box containing a conserved glutamic residue has been identified in GBS 52. The E-box motif is underlined in SEQ ID NO:21, below. The conserved glutamic acid (E), at amino acid residue 226, is marked in bold. The E box motif, in particular the conserved glutamic acid residue, is thought to be important for the formation of oligomeric pilus-like structures of GBS 52. Preferred fragments of GBS 52 include the conserved glutamic acid residue. Preferably, fragments include the E box motif

SEQ ID NO: 21

MKQTLKLMESFLLMLGTMEGISQTVLAQETHQLTIVHLEARDIDRPNP

QLEIAPKEGTPIEGVLYQLYQLKSTEDGDLLAHWNSLTITELKKQAQQ

VFEATTNQQGKATFNQLPDGIYYGLAVKAGEKNRNVSAFLVDLSEDKV

IYPKIIWSTGELDLLKVGVDGDTKKPLAGVVFELYEKNGRTPIRVKNG

VHSQDIDAAKHLETDSSGHIRISGLIHGDYVLKEIETQSGYQIGQAET

AVTIEKSKTVTVTIENKKVPTPKVPSRGGLIPKTGEQQAMALVIIGGI

LIALALRLLSKHRKHQNKD

SAG0647

Examples of polynucleotide and amino acid sequences for SAG0647 are set forth below. SEQ ID NO:22 and 23 represent SAG sequences from GBS serotype V, strain isolate 2603.

SEQ ID NO: 22

ATGGGACAAAAATCAAAAATATCTCTAGCTACGAATATTCGTATATGG

ATTTTTCGTTTAATTTTCTTAGCGGGTTTCCTTGTTTTGGCATTTCCC

ATCGTTAGTCAGGTCATGTACTTTCAAGCCTCTCACGCCAATATTAAT

GCTTTTAAAGAAGGTGTTACCAAGATTGACCGGGTGGAGATTAATCGG

CGTTTAGAACTTGCTTATGCTTATAAGGCCAGTATAGCAGGTGCCAAA

ACTAATGGCGAATATCCAGCGCTTAAAGACCCCTACTCTGGTGAACAA

AAGCAGGCAGGGGTCGTTGAGTACGCCCGCATGCTTGAAGTCAAAGAA

CAAATAGGTCATGTGATTATTCCAAGAATTAATCAGGATATCCCTATT

TACGCTGGCTCTGCTGAAGAAAATCTTCAGAGGGGCGTTGGACATTTA

GAGGGGACCAGTCTTCCAGTCGGTGGTGAGTCAACTCATGCCGTTGTA

ACTGCCCATCGAGGGCTACCAACGGCCAAGCTATTTACGAATTTAGAC

AAGGTAACAGTAGGTGACCGTTTTTACATTGAAGACATCGGCGGAAAG

ATTGCTTATCAGGTAGACCAAATCAAAGTTATCGGCCCTGATCAGTTA

GAGGATTTGTACGTGATTCAAGGAGAAGATCACGTCACCCTATTAACT

TGCACAGCTTATATGATAAATAGTCATCGCCTCCTCGTTCGAGGCAAG

CGAATTCCTTATGTGGAAAAAACAGTGCAGAAAGATTCAAAGACCTTC

AGGCAACAACAATACCTAACCTATGCTATGTGGGTAGTCGTTGGACTT

ATGTTGCTGTCGCTTCTCATTTGGTTTAAAAAGACGAAACAGAAAAAG

CGGAGAAAGAATGAAAAAGCGGCTAGTCAAAATAGTCACAATAATTCG

AAATAA

SEQ ID NO: 23

MGQKSKISLATNIRIWIERLIFLAGFLVLAFPIVSQVMYFQASHANIN

AFKEAVTKIDRVEINRRLELAYAYNASIAGAKTNGEYPALKDPYSAEQ

KQAGVVEYARMLEVKEQIGHVIIPRINQDIPIYAGSAEENLQRGVGHL

EGTSLPVGGESTHAVLTAHRGLPTAKLFTNLDKVTVGDRFYIEHIGGK

IAYQVDQIKVIAPDQLEDLYVIQGEDHVTLLTCTPYMINSHRLLVRGK

RIPYVEKTVQKDSKTFRQQQYLTYAMWVVVGLILLSLLIWFKKTKQKK

RRKNEKAASQNSHNNSK

SAG0648

Examples of polynucleotide and amino acid sequences for SAG0648 are set forth below. SEQ ID NO:24 and 25 represent SAG sequences from GBS serotype V, strain isolate 2603.

SEQ ID NO: 24

ATGGGAAGTCTGATTCTCTTATTTCCGATTGTGAGCCAGGTAAGTTAC

TACCTTGCTTCGCATCAAAATATTAATCAATTTAAGCGGGAAGTCGCT

AAGATTGATACTAATACGGTTGAACGACGCATCGCTTTAGCTAATGCT

TACAATGAGACGTTATCAAGGAATCCCTTGCTTATAGACCCTTTTACC

AGTAAGCAAAAAGAAGGTTTGAGAGAGTATGCTCGTATGCTTGAAGTT

CATGAGCAAATAGGTCATGTGGCAATCCCAAGTATTGGGGTTGATATT

CCAATTTATGCTGGAACATCCGAAACTGTGCTTCAGAAAGGTAGTGGG

CATTTGGAGGGAACCAGTCTTCCAGTGGGAGGTTTGTCAACCCATTCA

GTACTAACTGCCCACCGTGGCTTGCCAACAGCTAGGCTATTTACCGAC

TTAAATAAAGTTAAAAAAGGCCAGATTTTCTATGTGACGAACATCAAG

GAAACACTTGCCTACAAAGTCGTGTCTATCAAAGTTGTGGATCCAACA

GCTTTAAGTGAGGTTAAGATTGTCAATGGTAAGGATTATATAACCTTG

CTGACTTGCACACCTTACATGATCAATAGTCATGGTCTCTTGGTAAAA

GGAGAGCGTATTCCTTATGATTCTACCGAGGCGGAAAAGCACAAAGAA

CAAACGGTACAAGATTATCGTTTGTCACTAGTGTTGAAGATACTACTA

GTATTATTAATTGGACTCTTCATCGTGATAATGATGAGAAGATGGATG

GAACATCGTCAATAA

SEQ ID NO: 25

MGSLILLFPIVSQVSYYLASHQNINQFKREVAKIDTNTVERRIALANA

YNETLSRNPLLIDPFTSKQKEGLREYARMLEVHEQTGHVATPSIGVDI

PIYAGTSETVLQKGSGHLEGTSLPVGGLSTHSVLTAHRGLPTARLFTD

LNKVKKGQIFYVTNIKETLAYKVVSIKVVDPTALSEVKIVNGKDYITL

LTCTPYMINSHRLLVKGERIPYDSTEAEKHKEQTVQDYRLSLVLKILL

VLLIGLFIVIMMRRWMQHRQ

GBS 150

Examples of polynucleotide and amino acid sequences for GBS 150 are set forth below. SEQ ID NO:26 and 27 represent GBS 1 sequences from GBS serotype V, strain isolate 2603.

SEQ ID NO: 26

ATGAAAAAGATTAGAAAAAGTTTAGGACTTCTAGTATGTTGGTTTTTA

GGATTGGTACAATTAGCGTTTTTTTCGGTAGGCAGTGTAAATGCTGAT

ACCCCTAATCAACTAACAATCACAGAGATAGGACTTCAGCGAAATACT

ACAGAGGAGGGGATTTCTTATGGTTTATGGACTGTGACTGACAAGTTA

AAAGTTGATTTATTGAGGCAAATGACAGATAGCGAATTGAAGGAGAAG

TATAAGAGTATGTTGACTTCTCCTAGTGATACTAATGGTCAGACAAAG

ATAGGACTGGGAAATGGTTCGTACTTTGGTCGTGCTTATAAAGCTGAT

GAAAGGGTTTCAACAATAGTACCTTTTTATATTGAATTAGGAGATGAT

AAGTTATGAAATCAATTACAGATAAATCGTAAGCGAAAAGTTGAAACA

-continued

GGCGGATTAAAACTTATTAAATATACAAAAGAAGGAAAGATAAAGAAA

AGGCTATCCGGAGTAATATTTGTATTATACGATAACCAGAATGAGGGA

GTTCGCTTTAAAAATGGACGATTTACGACGGATCAAGATGGGATTAGT

TGATTAGTAACTGATGATAAGGGAGAAATTGAGGTTGAAGGTTTATTA

CGTGGTAAGTATATTTTTCGAGAAGCAAAAGCACTAACTGGTTACCGT

ATATGTATGAAGGATGGTGTAGTTGCTGTAGTTGCTAATAAAACACAG

GAAGTAGAGGTAGAAAACGAAAAAGAAACTCCTCCACCAACAAATCCT

AAACCATCACAACCGCTTTTTGCACAATCATTTCTTCCTAAAACAGGA

ATGATTATTGGTGGAGGACTGACAATTCTTGGTTGTATTATTTTGGGA

ATTTTGTTTATCTTTTTAAGAAAAACTAAAAATAGCAAATCTGAAAGA

AACGATACAGTA

SEQ ID NO: 27

MKKIRKSLGLLLCCFLGLVQLAFESVASVNADTPNQLTITQIGLQPNT

TEEGISYRLWTVTDNLKVDLLSQMTDSELNQKYKSILTSPTDTNGQTK

IALPNGSYFGRAYKADQSVSTIVPEYIELPDDKLSNQLQINPKRKVET

GRLKLIKYTKEGKIKKRLSGVIFVLYDNQNQPVRFKNGRFTTDQDGIT

SLVTDDKGEIEVEGLLPGKYIFREAKALTGYRISMKDAVVAVVANKTQ

EVEVENEKETPPPTNPKPSQPLFPQSF*LPKTG*MIIGGGLTILGCIILG

ILFIFLRKTKNSKSERNDTV

GBS 150 contains an amino acid motif indicative of a cell wall anchor: SEQ ID NO:130 LPKTG (shown in italics in SEQ ID NO:27 above). In some recombinant host cell systems, it may be preferable to remove this motif to facilitate secretion of a recombinant GBS 150 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

As discussed above, a pilin motif, containing a conserved lysine (K) residue has been identified in GBS 150. The pilin motif sequence is underlined in SEQ ID NO:27, below. Conserved lysine (K) residues are marked in bold, at amino acid residues 139 and 148. The pilin sequence, in particular the conserved lysine residues, are thought to be important for the formation of oligomeric, pilus-like structures of GBS 150. Preferred fragments of GBS 150 include a conserved lysine residue. Preferably, fragments include the pilin sequence.

SEQ ID NO: 27

MKKIRKSLGLLLCCFLGLVQLAFFSVASVNADTPNQLTITQIGLQPNT

TEEGISYRLWTVTDNLKVDLLSQMTDSELNQKYKSILTSPTDTNGQTK

IALPNGSYFGRAYKADQSVSTIVPFYIELPDDKLSNQLQINPKRKVET

GRLKLIKYTKEGKIKKRLSGVIFVLYDNQNQPVRFKNGRFTTDQDGIT

SLVTDDKGEIEVEGLLPGKYIEREAKALTGYRISMKDAVVAVVANKTQ

EVEVENEKETPPPINPKPSQPLEPQSFLPKTGMIIGGGLTILGCIILG

ILFIFLRKTKNSKSERNDTV

An E box containing a conserved glutamic residue has also been identified in GBS 150. The E box motif is underlined in SEQ ID NO: 27 below. The conserved glutamic acid (E), at amino acid residue 216, is marked in bold. The E box motif, in particular the conserved glutamic acid residue, is thought to be important for the formation of oligomeric pilus-like structures of GBS 150. Preferred fragments of GBS 150 include the conserved glutamic acid residue. Preferably, fragments include the E box motif

SEQ ID NO: 27
MKKIRKSLGLLLCCFLGLVQLAFFSVASVNADTPNQLTITQIGLQPNT

TEEGISYRLWTVTDNLKVDLLSQMTDSELNQKYKSILTSPTDTNGQTK

IALPNGSYFGRAYKADQSVSTIVPFYIELPDDKLSNQLQINPKRKVET

GRLKLIKYTKEGKIKKRLSGVIFVLYDNQNQPVRFKNGRFTTDQDGIT

SLVTDDKGEIEVEGLLPGKYIFREAKALTGYRISMKDAVVAVVANKTQ

EVEVENEKETPPPTNPKPSQPLFPQSFLPKTGMTIGGGLTILGCIILG

ILFIFLRKTKNSKSERNDTV

SAG 1405

Examples of polynucleotide and amino acid sequences for SAG1405 are set forth below. SEQ ID NO:28 and 29 represent SAG14 sequences from GBS serotype V, strain isolate 2603.

SEQ ID NO: 28
ATGGGAGGAAAATTTCAGAAAAACCTTAAGAAATCGGTCGTTTTAAAT

CGATGGATGAATGTAGGCTTGATACTATTGTTCTTAGTTGGTCTTTTG

ATAACCTCATATCCTTTTATTTCAAATTGGTACTATAATATTAAAGCT

AATAATCAAGTAACTAACTTTGATAATCAAACCCAAAAATTAAATACT

AAAGAGATTAATAGACGATTTGAGTTAGCAAAAGCTTATAATAGAACA

CTGGACCCAAGCCGCCTATCAGATCCCTATACTGAAAAAGAAAAAAAA

GGTATTGCTGAATACGCCCACATGCTTGAGATTGCTGAAATGATTGGA

TATATTGATATACCGTCTATCAAGCAAAAATTACCTATCTATGCGGGG

ACTACCAGTAGTGTTCTTGAAAAAGGAGCAGGACACCTTGAAGGAACC

TCCTTGCCAATTGGTGGAAAAAGTTCACATACTGTTATCACAGCTCAT

CGCGGCTTACCTAAAGCTAAGTTATTTACAGATTTAGATAAACTTAAA

AAAGGAAAAATTTTTTATATTCATAATATCAAAGAAGTTTTAGCCTAT

AAGGTTGATCAAATAAGTGTTGTAAAGCCAGATAATTTTTCTAAATTA

TTGGTTGTTAAAGGTAAGGATTATGCGACTTTGCTAACATGTACACCT

TATTCGATTAATTCACATCGTTTACTAGTTAGAGGGCATCGAATCAAG

TATGTACCTCCTGTTAAAGAAAAGAACTATTTAATGAAAGAATTGCAA

ACACACTATAAACTTTATTTCCTCTTATCAATCCTAGTTATTCTTATA

TTAGTCGCTTTACTATTATATTTAAAACGAAAATTTAAAGAGAGAAAG

AGAAAGGGAAATCAAAAATGA

SEQ ID NO: 29
MGGKFQKNLKKSVVLNRWMNVGLILLFLVGLLITSYPPFISNWYYNIKA

NNQVTNFDNQTQKLNTKEINRRFELAKAYNRTLDPSRLSDPYTEKEKK

GIAEYAHMLEIAEMIGYIDIPSIKQKLPIYAGTTSSVLEKGAGHLEGT

SLPIGGKSSHTVITAHRGLPKAKLFTDLDKLKKGKIFYIHNIKEVLAY

KVDQISVVKPDNFSKLLVVKGKDYATLLTCTPYSINSHRLLVRGHRIK

YVPPVKEKNYLMKELQTRYKLYFLLSILVILILVALLLYLKRKPKERK

RKGNQK

SAG 1406

Examples of polynucleotide and amino acid sequences for SAG1405 are set forth below. SEQ ID NO:30 and 31 represent SAG14 sequences from GBS serotype V, strain isolate 2603.

SEQ ID NO: 30
GTGAAGACTAAAAAAATCATCAAAAAAACAAAAAAAAAGAAGAAGTCA
AATCTTCCTTTTATCATTCTTTTTCTAATAGGTCTATCTATTTTATTG
TATCCAGTGGTATCACGTTTTTACTATACGATAGAATCTAATAATCAA
ACACAGGATTTTGAGAGAGCTGCTAAAAAACTTAGTCAGAAAGAAATC
AATCGACGTATGGCTCTAGCACAAGCTTATAATGATTCTTTAAATAAT
GTCCATCTTGAAGATCCTTATGAGAAAAAACGAATTCAAAAGGGGGTA
GCAGAGTACGCCCGTATGTTAGAGGTAAGTGAAAAAATCGGAACAATT
TCAGTTCCTAAGATAGGTCAAAAACTCCCTATATTTGCAGGTTCAAGT
CAAGAAGTTCTATCTAAAGGAGCAGGGCATTTAGAAGGTACCTCTCTT
CCAATTGGGGGCAATAGTACACATACTGTTATAACAGCGCATTCAGGA
ATTCCAGATAAAGAACTCTTTTCTAACCTTAAAAAGTTAAAAAAAGGA
GATAAGTTTTATATTCAAAACATAAAAGAAACGATAGCATATCAAGTA
GATCAGATAAAAGTCGTTACACCCGATAACTTTTCAGATTTGTTGGTT
GTTCCTGGACATGATTATGCAACCTTATTGACTTGCACCCCGATTATG
ATCAATACACACAGACTTTTAGTAAGGGGACATCGTATCCCTTATAAA
GGTCCTATTGATGAAAAATTAATAAAAGACGGTCATTTAAACACGATT
TATAGATATCTATTCTATATATCTTTAGTTATTATTGCTTGGTTACTT
TGGTTAATAAAACGTCAACGTCAAAAAAATCGTTTAGCAAGTGTTAGA
AAAGGAATTGAATCATAA

SEQ ID NO: 31
MKTKKIIKKTKKKKKSNLPFIILFLIGLSILLYPVVSRFYYTIESNNQ
TQDFERAAKKLSQKEINRRMALAQAYNDSLNNVHLEDPYEKKRIQKGV
AEYARMLEVSEKIGTISVPKIGQKLPIFAGSSQEVLSKGAGHLEGTSL
PIGGNSTHTVITAHSGIPDKELFSNLKKLKKGDKFYIQNIKETIAYQV
DQIKVVTPDNFSDLLVVPGHDYATLLTCTPTMINTHRLLVRGHRIPYK
GPIDEKLIKDGHLNTIYRYLFYISLVIIAWLLWLIKRQRQKNRLASVR
KGIES

An example of an amino acid sequence for 01520 is set forth below. SEQ ID NO:32 represents a sequence from GBS serotype III, strain isolate COH1.

SEQ ID NO: 32
MIRRYSANFLAILGIILVSSGIYWGWYNINQAHQADLTSQHIVKVLDK

SITHQVKGSENGELPVKKLDKTDYLGTLDIPNLKLHLPVAANYSFEQL

SKTPTRYYGSYLTNNMVICAHNFPYHFDALKNVDMGTDVYFTTTTGQI

YHYKISNREIIEPTAIEKVYKTATSDNDWDLSLFTCTKAGVARVLVRC

QLIDVKN

An example of an amino acid sequence for 01521 is set forth below. SEQ ID NO:33 represents a 01 sequence from GBS serotype III, strain isolate COH1.

SEQ ID NO: 33
MIYKKILKITLLLLFSLSTQLVSADTNDQMKTGSITIQNKYNNQGIAG

GNLLVYQVAQAKDVDGNQVFTLTTPFQGIGIKDDDLTQVNLDSNQAKY

VNLLTKAVHKTQPLQTFDNLPAEGIVANNLPQGIYLFIQTKTAQGYEL

MSPFILSIPKDGKYDITAFEKMSPLNAKPKKEETITPTVTHQTKGK*LP*

*FTGQVWWPIPILIMSGLLCLIIALKWRRRRD*

01521 contains an amino acid motif indicative of a cell wall anchor: SEQ ID NO:132 LPFTG (shown in italics in SEQ ID NO:33 above). In some recombinant host cell systems, it may be preferable to remove this motif to facilitate secretion of a recombinant 01521 protein from the host cell. Alternatively, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

Two pilin motifs, containing conserved lysine (K) residues have been identified in 01521. The pilin motif sequences are underlined in SEQ ID NO:33, below. Conserved lysine (K) residues are marked in bold, at amino acid residues 154 and 165 and at amino acid residues 174 and 188. The pilin sequences, in particular the conserved lysine residues, are thought to be important for the formation of oligomeric, pilus-like structures of 01521. Preferred fragments of 01521 include at least one conserved lysine residue. Preferably, fragments include at least one pilin sequence.

SEQ ID NO: 33

MIYKKILKITLLLLFSLSTQLVSADTNDQMKTGSITIQNKYNNQGIAG

GNLLVYQVAQAKDVDGNQVFTLTTPFQGIGIKDDDLTQVNLDSNQAKY

VNLLTKAVHKTQPLQTFDNLPAEGIVANNLPQGIYLFIQTKTAQGYEL

MSPFILSIPKDGKYDITAFEKMSPLNAKPKKEETITPTVTHQTKGKLP

FTGQVWWPIPILIMSGLLCLIIALKWRRRRD

An E box containing a conserved glutamic residue has also been identified in 01521. The E box motif is underlined in SEQ ID NO:33 below. The conserved glutamic acid (E), at amino acid residue 177, is marked in bold. The E box motif, in particular the conserved glutamic acid residue, is thought to be important for the formation of oligomeric pilus-like structures of 01521. Preferred fragments of 01521 include the conserved glutamic acid residue. Preferably, fragments include the E box motif

SEQ ID NO: 33

MIYKKILKITLLLLFSLSTQLVSADTNDQMKTGSITIQNKYNNQGIAG

GNLLVYQVAQAKDVDGNQVFTLTTPFQGIGIKDDDLTQVNLDSNQAKY

VNLLTKAVHKTQPLQTFDNLPAEGIVANNLPQGIYLFIQTKTAQGYEL

MSPFILSIPKDGKYDITAFEKMSPLNAKPKKEETITPTVTHQTKGKLP

FTGQVWWPIPILIMSGLLCLIIALKWRRRRD

An example of an amino acid sequence for 01522 is set forth below. SEQ ID NO:34 represents a 01 sequence from GBS serotype III, strain isolate COH1.

SEQ ID NO: 34

MAYPSLANYWNSFHQSRAIMDYQDRVTHMDENDYKKITNRAKEYNKQF

KTSGMKWHMTSQERLDYNSQLAIDKTGNMGYISIPKINIKLPLYHGTS

EKVLQTSIGHLEGSSLPIGGDSTHSILSGHRGLPSSRLFSDLDKLKVG

DHWTVSILNETYTYQVDQIRTVKPDDLRDLQIVKGKDYQTLVTCTPYG

VNTHRLLVRGHRVPNDNGNALVVAEAIQIEPIYIAPFIAIFLTLILLL

ISLEVTRRARQRKKILKQAMRKEENNDL

An example of an amino acid sequence for 01523 is set forth below. SEQ ID NO:35 represents a 01 sequence from GBS serotype III, strain isolate COH1.

SEQ ID NO: 35

MKKKMIQSLLVASLAFGMAVSPVTPIAFAAETGTITVQDTQKGATYKA

YKVFDAEIDNANVSDSNKDGASYLIPQGKEAEYKASTDFNSLFTTTTN

GGRTYVTKKDTASANEIATWAKSISANTTPVSTVTESNNDGTEVINVS

QYGYYYVSSTVNNGAVIMVTSVTPNATIHEKNTDATWGDGGGKTVDQK

TYSVGDTVKYTITYKNAVNYHGTEKVYQYVIKDTMPSASVVDLNEGSY

EVTITDGSGNITTLTQGSEKATGKYNLLEENNNFTITIPWAATNTPTG

NTQNGANDDFFYKGINTITVTYTGVLKSGAKPGSADLPENTNIATINP

NTSNDDPGQKVTVRDGQITIKKIDGSTKASLQGAIFVLKNATGQFLNF

NDTNNVEWGTEANATEYTTGADGIITITGLKEGTYYLVEKKAPLGYNL

LDNSQKVILGDGATDTTNSDNLLVNPTVENNKGTE*LPSTG*GIGTTIEY

IIGAILVIGAGIVLVARRRLRS 01523 contains an amino acid motif indicative of a cell wall anchor: SEQ ID NO:131 LPSTG (shown in italics in SEQ ID NO:35 above). In some recombinant host cell systems, it may be preferable to remove this motif to facilitate secretion of a recombinant 01523 protein from the host cell. Alternatively, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

An E box containing a conserved glutamic residue has also been identified in 01523. The E box motif is underlined in SEQ ID NO:35 below. The conserved glutamic acid (E), at amino acid residue 423, is marked in bold. The E box motif, in particular the conserved glutamic acid residue, is thought to be important for the formation of oligomeric pilus-like structures of 01523. Preferred fragments of 01523 include the conserved glutamic acid residue. Preferably, fragments include the E box motif

SEQ ID NO: 35

MKKKMIQSLLVASLAFGMAVSPVTPIAFAAETGTITVQDTQKGATYKA

YKVFDAEIDNANVSDSNKDGASYLIPQGKEAEYKASTDFNSLFTTTTN

GGRTYVTKKDTASANEIATWAKSISANTTPVSTVTESNNDGTEVINVS

QYGYYYVSSTVNNGAVIMVTSVTPNATIHEKNTDATWGDGGGKTVDQK

TYSVGDTVKYTITYKNAVNYHGTEKVYQYVIKDTMPSASVVDLNEGSY

EVTITDGSGNITTLTQGSEKATGKYNLLEENNNFTITIPWAATNTPTG

NTQNGANDDFFYKGINTITVTYTGVLKSGAKPGSADLPENTNIATINP

NTSNDDPGQKVTVRDGQITIKKIDGSTKASLQGAIFVLKNATGQFLNF

NDTNNVEWGTEANATEYTTGADGIITITGLKEGTYYLVEKKAPLGYNL

LDNSQKVILGDGATDTTNSDNLLVNPTVENNKGTELPSTGGIGTTIFY

IIGAILVIGAGIVLVARRRLRS

01524

An example of an amino acid sequence for 01524 is set forth below. SEQ ID NO:36 represents a 01 sequence from GBS serotype m, strain isolate COH1.

SEQ ID NO: 36

MLKKCQTFIIESLKKKKHPKEWKIIMWSLMILTTFLTTYFLILPAITV
EETKTDDVGITLENKNSSQVTSSTSSSQSSVEQSKPQTPASSVTETSS
SEEAAYREEPLMFRGADYTVTVTLTKEAKIPKNADLKVTELKDNSATF
KDYKKKALTEVAKQDSEIKNFKLYDITIESNGKEAEPQAPVKVEVNYD
KPLEASDENLKVVHFKDDGQTEVLKSKDTAETKNTSSDVAFKTDSFST
YAIVQEDNTEVPRLTYHFQNNDGTDYDPLTASGMQVHHQIIKDGESLG
EVGIPTIKAGEHFNGWYTYDPTTGKYGDPVKEGEPITVTETKEICVRP
FMSKVATVTLYDDSAGKSILERYQVPLDSSGNGTADLSSFKVSPPTST
LLFVGWSKTQNGAPLSESEIQALPVSSDISLYPVFKESYGVEFNTGDL
STGVTYIAPRRVLTGQPASTIKPNDPTRPGYTFAGWYTAASGGAAFDF
NQVLTKDTTLYAHWSPAQTTYTINYWQQSATDNKNATDAQKTYEYAGQ
VTRSGLSLSNQTLTQQDINDKLPTGFKVNNTRTETSVMIKDDGSSVVN
VYYDRKLITIKFAKYGGYSLPEYYYSYNWSSDADTYTGLYGTTLAANG
YQWKTGAWGYLANVGNNQVGTYGMSYLGEFILPNDTVDSDVIKLFPKG
NIVQTYRFTKQGLDGTYSLADTGGGAGADEFTFTEKYLGFNVKYYQRL
YPDNYLFDQYASQTSAGVKVPISDEYYDRYGAYHKDYLNLVVWYERNS
YKIKYLDPLDNTELPNFPVKDVLYEQNLSSYAPDTTTVQPKPSRPGYV
WDGKWYKDQAQTQVFDFNTTMPPHDVKVYAGWQKVTYRVNIDPNGGRL
SKTDDTYLDLHYGDRIPDYTDITRDYIQDPSGTYYYKYDSRDKDPDST
KDAYYTTDTSLSNVDTTTKYKYVKDAYKLVGWYYVNPDGSIRPYNFSG
AVTQDINLRAIWRKAGDYHIIYSNDAVGTDGKPALDASGQQLQTSNEP
TDPDSYDDGSHSALLRRPTMPDGYRFRGWWYNGKIYNPYDSIDIDAHL
ADANKNITIKPVIIPVGDIKLEDTSIKYNGNGGTRVENGNVVTQVETP
RMELNSTTTIPENQYFTRTGYNLIGWHHDKDLADTGRVEFTAGQSIGI
DNNPDATNTLYAVWQPKEYTVRVSKTVVGLDEDKTKDFLFNPSETLQQ
ENFPLRDGQTKEEKVPYGTSISIDEQAYDEFKVSESITEKNLATGEAD
KTYDATGLQSLTVSGDVDISFTNTRIKQKVRLQKVNVENDNNFLAGAV
FDIYESDANGNKASHPMYSGLVTNDKGLLLVDANNYLSLPVGKYYLTE
TKAPPGYLLPKNDISVLVISTGVTFEQNGNNATPIKENLVDGSTVYTF
KITNSKGTE*LPSTG*GIGTHIYILVGLALALPSGLILYYRKKI 01524 contains an amino acid motif indicative of a cell wall anchor: SEQ ID NO:131 LPSTG (shown in italics in SEQ ID NO:36 above). In some recombinant host cell systems, it may be preferable to remove this motif to facilitate secretion of a recombinant 01524 protein from the host cell. Alternatively, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

Three pilin motifs, containing conserved lysine (K) residues have been identified in 01524. The pilin motif sequences are underlined in SEQ ID NO:36, below. Conserved lysine (K) residues are marked in bold, at amino acid residues 128 and 138, amino acid residues 671 and 682, and amino acid residues 809 and 820. The pilin sequences, in particular the conserved lysine residues, are thought to be important for the formation of oligomeric, pilus-like structures of 01524. Preferred fragments of 01524 include at least one conserved lysine residue. Preferably, fragments include at least one pilin sequence.

SEQ ID NO: 36

MLKKCQTFIIESLKKKKHPKEWKIIMWSLMILTTFLTTYFLILPAITV
EETKTDDVGITLENKNSSQVTSSTSSSQSSVEQSKPQTPASSVTETSS
SEEAAYREEPLMFRGADYTVTVTLTKEAKIPKNADLKVTELKDNSATF
KDYKKKALTEVAKQDSEIKNFKLYDITIESNGKEAEPQAPVKVEVNYD
KPLEASDENLKVVHFKDDGQTEVLKSKDTAETKNTSSDVAFKTDSFSI
YAIVQEDNTEVPRLTYHFQNNDGTDYDFLTASGMQVHHQIIKDGESLG
EVGIPTIKAGEHFNGWYTYDPTTGKYGDPVKFGEPITVTETKEICVRP
FMSKVATVTLYDDSAGKSILERYQVPLDSSGNGTADLSSFKVSPPTST
LLFVGWSKTQNGAPLSESEIQALPVSSDISLYPVFKESYGVEFNTGDL
STGVTYIAPRRVLTGQPASTIKPNDPTRPGYTFAGWYTAASGGAAFDF
NQVLTKDTTLYAHWSPAQTTYTINYWQQSATDNKNATDAQKTYEYAGQ
VTRSGLSLSNQTLTQQDINDKLPTGFKVNNTRTETSVMIKDDGSSVVN
VYYDRKLITIKFAKYGGYSLPEYYYSYNWSSDADTYTGLYGTTLAANG
YQWKTGAWGYLANVGNNQVGTYGMSYLGEFILPNDTVDSDVIKLFPKG
NIVQTYRFFKQGLDGTYSLADTGGGAGADEFTFTEKYLGFNVKYYQRL
YPDNYLFDQYASQTSAGVKVPISDEYYDRYGAYHKDYLNLVVWYERNS
YKIKYLDPLDNTELPNFPVKDVLYEQNLSSYAPDTTTVQPKPSRPGYV
WDGKWYKDQAQTQVFDFNTTMPPHDVKVYAGWQKVTYRVNIDPNGGRL
SKTDDTYLDLHYGDRIPDYTDITRDYIQDPSGTYYYKYDSRDKDPDST
KDAYYTTDTSLSNVDTTTKYKYVKDAYKLVGWYYVNPDGSIRPYNFSG
AVTQDINLRAIWRKAGDYHIIYSNDAVGTDGKPALDASGQQLQTSNEP
TDPDSYDDGSHSALLRRPTMPDGYRFRGWWYNGKIYNPYDSIDIDAHL
ADANKNITIKPVIIPVGDIKLEDTSIKYNGNGGTRVENGNVVTQVETP
RMELNSTTTIPENQYFTRTGYNLIGWHHDKDLADTGRVEFTAGQSIGI
DNNPDATNTLYAVWQPKEYTVRVSKTVVGLDEDKTKDFLFNPSETLQQ
ENFPLRDGQTKEFKVPYGTSISIDEQAYDEFKVSESITEKNLATGEAD
KTYDATGLQSLTVSGDVDISFTNTRIKQKVRLQKVNVENDNNFLAGAV
FDIYESDANGNKASHPMYSGLVTNDKGLLLVDANNYLSLPVGKYYLTE
TKAPPGYLLPKNDISVLVISTGVTFEQNGNNATPIKENLVDGSTVYTF
KITNSKGTELPSTGGIGTHIYILVGLALALPSGLILYYRKKI

An E box containing a conserved glutamic residue has also been identified in 01524. The E box motif is underlined in SEQ ID NO:36 below. The conserved glutamic acid (E), at amino acid residue 1344, is marked in bold. The E box motif, in particular the conserved glutamic acid residue, is thought to be important for the formation of oligomeric pilus-like structures of 01524. Preferred fragments of 01524 include the conserved glutamic acid residue. Preferably, fragments include the E box motif

SEQ ID NO: 36

```
MLKKCQTFIIESLKKKKHPKEWKIIMWSLMILTTFLTTYFLILPAITV
EETKTDDVGITLENKNSSQVTSSTSSSQSSVEQSKPQTPASSVTETSS
SEEAAYREEPLMFRGADYTVTVTLTKEAKIPKNADLKVTELKDNSATF
KDYKKKALTEVAKQDSEIKNFKLYDITIESNGKEAEPQAPVKVEVNYD
KPLEASDENLKVVHFKDDGQTEVLKSKDTAETKNTSSDVAFKTDSFSI
YAIVQEDNTEVPRLTYHFQNNDGTDYDFLTASGMQVHHQIIKDGESLG
EVGIPTIKAGEHFNGWYTYDPTTGKYGDPVKFGEPITVTETKEICVRP
FMSKVATVTLYDDSAGKSILERYQVPLDSSGNGTADLSSFKVSPPTST
LLFVGWSKTQNGAPLSESEIQALPVSSDISLYPVFKESYGVEFNTGDL
STGVTYIAPRRVLTGQPASTIKPNDPTRPGYTFAGWYTAASGGAAFDF
NQVLTKDTTLYAHWSPAQTTYTINYWQQSATDNKNATDAQKTYEYAGQ
VTRSGLSLSNQTLTQQDINDKLPTGFKVNNTRTETSVMIKDDGSSVVN
VYYDRKLITIKFAKYGGYSLPEYYYSYNWSSDADTYTGLYGTTLAANG
YQWKTGAWGYLANVGNNQVGTYGMSYLGEFILPNDTVDSDVIKLFPKG
NIVQTYRFFKQGLDGTYSLADTGGGAGADEFTFTEKYLGFNVKYYQRL
YPDNYLFDQYASQTSAGVKVPISDEYYDRYGAYHKDYLNLVVWYERNS
YKIKYLDPLDNTELPNFPVKDVLYEQNLSSYAPDTTTVQPKPSRPGYV
WDGKWYKDQAQTQVFDFNTTMPPHDVKVYAGWQKVTYRVNIDPNGGRL
SKTDDTYLDLHYGDRIPDYTDITRDYIQDPSGTYYYKYDSRDKDPDST
KDAYYTTDTSLSNVDTTTKYKYVKDAYKLVGWYYVNPDGSIRPYNFSG
AVTQDINLRAIWRKAGDYHIIYSNDAVGTDGKPALDASGQQLQTSNEP
TDPDSYDDGSHSALLRRPTMPDGYRFRGWWYNGKIYNPYDSIDIDAHL
ADANKNITIKPVIIPVGDIKLEDTSIKYNGNGGTRVENGNVVTQVETP
RMELNSTTTIPENQYFTRTGYNLIGWHHDKDLADTGRVEFTAGQSIGI
DNNPDATNTLYAVWQPKEYTVRVSKTVVGLDEDKTKDFLFNPSETLQQ
ENFPLRDGQTKEFKVPYGTSISIDEQAYDEFKVSESITEKNLATGEAD
KTYDATGLQSLTVSGDVDISFTNTRIKQKVRLQKVNVENDNNFLAGAV
FDIYESDANGNKASHPMYSGLVTNDKGLLLVDANNYLSLPVGKYYLTE
TKAPPGYLLPKNDISVLVISTGVTFEQNGNNATPIKENLVDGSTVYTF
KITNSKGTELPSTGGIGTHIYILVGLALALPSGLILYYRKKI
```

01525

An example of an amino acid sequence for 01525 is set forth below. SEQ ID NO:37 represents a 01 sequence from GBS serotype III, strain isolate COH1.

EQ ID NO: 37

```
MKRQISSDKLSQELDRVTYQKRFWSVIKNTIYILMAVASIAILIAVLW
LPVLRIYGHSMNKTLSAGDVVFTVKGSNFKTGDVVAFYYNNKVLVKRV
TAESGDWVNIDSQGDVYVNQHKLKEPYVIHKALGNSNIKYPYQVPDKK
IFVLGDNRKTSIDSRSTSVGDVSEEQIVGKTSFRIWPLGKISSIN
```

GBS 322

GBS 322 refers to a surface immunogenic protein, also referred to as "sip". Nucleotide and amino acid sequences of GBS sequenced from serotype V isolated strain 2603 V/R are set forth in Ref 3 as SEQ ID 8539 and SEQ OD 8540. These sequences are set forth below as SEQ ID NOS 38 and 39:

SEQ ID NO. 38

```
ATGAATAAAAAGGTACTATTGACATCGACAATGGCAGCTTCGCTATTA
TCAGTCGCAAGTGTTCAAGCACAAGAAACAGATACGACGTGGACAGCA
CGTACTGTTTCAGAGGTAAAGGCTGATTTGGTAAAGCAAGACAATAAA
TCATCATATACTGTGAAATATGGTGATACACTAAGCGTTATTTCAGAA
GCAATGTCAATTGATATGAATGTCTTAGCAAAAATAAATAACATTGCA
GATATCAATCTTATTTATCCTGAGACAACACTGACAGTAACTTACGAT
CAGAAGAGTCATACTGCCACTTCAATGAAAATAGAAACACCAGCAACA
AATGCTGCTGGTCAAACAACAGCTACTGTGGATTTGAAAACCAATCAA
GTTTCTGTTGCAGACCAAAAAGTTTCTCTCAATACAATTTCGGAAGGT
ATGACACCAGAAGCAGCAACAACGATTGTTTGGCCAATGAAGACATAT
TCTTCTGCGCCAGCTTTGAAATCAAAAGAAGTATTAGCACAAGAGCAA
GCTGTTAGTCAAGCAGCAGCTAATGAACAGGTATCACGAGCTCCTGTG
AAGTCGATTACTTCAGAAGTTCCAGCAGCTAAAGAGGAAGTTAAACCA
ACTCAGACGTCAGTCAGTCAGTCAACAACAGTATCACCAGCTTCTGTT
GCCGCTGAAACACCAGCTCCAGTAGCTAAAGTAGCACCGGTAAGAACT
GTAGCAGCCCCTAGAGTGGCAAGTGTTAAAGTAGTCACTCCTAAAGTA
GAAACTGGTGCATCACCAGAGCATGTATCAGCTCCAGCAGTTCCTGTG
ACTACGACTTCACCAGCTACAGACAGTAAGTTACAAGCGACTGAAGTT
AAGAGCGTTCCGGTAGCACAAAAAGCTCCAACAGCAACACCGGTAGCA
CAACCAGCTTCAACAACAAATGCAGTAGCTGCACATCCTGAAAATGCA
GGGCTCCAACCTCATGTTGCAGCTTATAAAGAAAAAGTAGCGTCAACT
TATGGAGTTAATGAATTCAGTACATACCGTGCGGGAGATCCAGGTGAT
CATGGTAAAGGTTTAGCAGTTGACTTTATTGTAGGTACTAATCAAGCA
CTTGGTAATAAAGTTGCACAGTACTCTACACAAAATATGGCAGCAAAT
AACATTTCATATGTTATCTGGCAACAAAAGTTTTACTCAAATACAAAC
AGTATTTATGGACCTGCTAATACTTGGAATGCAATGCCAGATCGTGGT
GGCGTTACTGCCAACCACTATGACCACGTTCACGTATCATTTAACAAA
TAATATAAAAAAGGAAGCTATTTGGCTTCTTTTTTATATGCCTTGAAT
AGACTTTCAAGGTTCTTATATAATTTTTATTA
```

SEQ ID NO. 39

```
MNKKVLLTSTMAASLLSVASVQAQETDTTWTARTVSEVKADLVKQDNK
SSYTVKYGDTLSVISEAMSIDMNVLAKINNIADINLIYPETTLTVTYD
QKSHTATSMKIETPATNAAGQTTATVDLKTNQVSVADQKVSLNTISEG
MTPEAATTIVSPMKTYSSAPALKSKEVLAQEQAVSQAAANEQVSPAPV
KSITSEVPAAKEEVKPTQTSVSQSTTVSPASVAAETPAPVAKVAPVRT
VAAPRVASVKVVTPKVETGASPEHVSAPAVPVTTTSPATDSKLQATEV
KSVPVAQKAPTATPVAQPASTTNAVAAHPENAGLQPHVAAYKEKVAST
YGVNEFSTYRAGDPGDHGKGLAVDFIVGTNQALGNKVAQYSTQNMAAN
NISYVIWQQKFYSNTNSIYGPANTWNAMPDRGGVTANHYDHVHVSFNK
```

GBS 322 contains an N-terminal leader or signal sequence region which is indicated by the underlined sequence near the beginning of SEQ ID NO:39. In one embodiment, one or more amino acids from the leader or signal sequence region of GBS 322 are removed. An example of such a GBS 322 fragment is set forth below as SEQ ID NO:40.

SEQ ID NO: 40

```
DLVKQDNKSSYTVKYGDTLSVISEAMSIDMNVLAKINNIADINLIYPE
TTLTVTYDQKSHTATSMKIETPATNAAGQTTATVDLKTNQVSVADQKV
SLNTISEGMTPEAATTIVSPMKTYSSAPALKSKEVLAQEQAVSQAAAN
EQVSPAPVKSITSENPAAKEEVKPTQTSVSQSTTVSPASVAAETPAPV
AKVAPVRTVAAPRVASVKVVTPKVETGASPEHVSAPAVPVTTTSPATD
SKLQATEVKSVPVAQKAPTATPVAQPASTTNAVAAHPENAGLQPHVAA
YKEKVASTYGVNEFSTYRAGDPGDHGKGLAVDFIVGTNQALGNKVAQY
STQNMAANNISYVIWQQKFYSNTNSIYGPANTWNAMPDRGGVTANHYD
HVHVSFNK
```

Additional preferred fragments of GBS 322 comprise the immunogenic epitopes identified in WO 03/068813, each of which are specifically incorporated by reference herein.

There may be an upper limit to the number of GBS proteins which will be in the compositions of the invention. Preferably, the number of GBS proteins in a composition of the invention is less than 20, less than 19, less than 18, less than 17, less than 16, less than 15, less than 14, less than 13, less than 12, less than 11, less than 10, less than 9, less than 8, less than 7, less than 6, less than 5, less than 4, or less than 3. Still more preferably, the number of GBS proteins in a composition of the invention is less than 6, less than 5, or less than 4. Still more preferably, the number of GBS proteins in a composition of the invention is 3.

The GBS proteins and polynucleotides used in the invention are preferably isolated, i.e., separate and discrete, from the whole organism with which the molecule is found in nature or, when the polynucleotide or polypeptide is not found in nature, is sufficiently free of other biological macromolecules so that the polynucleotide or polypeptide can be used for its intended purpose.

Group A *Streptococcus* Adhesin Island Sequences

The GAS AI polypeptides of the invention can, of course, be prepared by various means (e.g. recombinant expression, purification from GAS, chemical synthesis etc.) and in various forms (e.g. native, fusions, glycosylated, non-glycosylated etc.). They are preferably prepared in substantially pure form (i.e. substantially free from other streptococcal or host cell proteins) or substantially isolated form.

The GAS AI proteins of the invention may include polypeptide sequences having sequence identity to the identified GAS proteins. The degree of sequence identity may vary depending on the amino acid sequence (a) in question, but is preferably greater than 50% (e.g. 60%, 65%, 70%, 75%, 80%, 85%, 90%, 91%, 92%, 93%, 94%, 95%, 96%, 97%, 98%, 99%, 99.5% or more). Polypeptides having sequence identity include homologs, orthologs, allelic variants and functional mutants of the identified GBS proteins. Typically, 50% identity or more between two proteins is considered to be an indication of functional equivalence. Identity between proteins is preferably determined by the Smith-Waterman homology search algorithm as implemented in the MPSRCH program (Oxford Molecular), using an affinity gap search with parameters gap open penalty=12 and gap extension penalty=1.

The GAS adhesin island polynucleotide sequences may include polynucleotide sequences having sequence identity to the identified GAS adhesin island polynucleotide sequences. The degree of sequence identity may vary depending on the polynucleotide sequence in question, but is preferably greater than 50% (e.g. 60%, 65%, 70%, 75%, 80%, 85%, 90%, 91%, 92%, 93%, 94%, 95%, 96%, 97%, 98%, 99%, 99.5% or more).

The GAS adhesin island polynucleotide sequences of the invention may include polynucleotide fragments of the identified adhesin island sequences. The length of the fragment may vary depending on the polynucleotide sequence of the specific adhesin island sequence, but the fragment is preferably at least 10 consecutive polynucleotides, (e.g. at least 10, 12, 14, 16, 18, 20, 25, 30, 35, 40, 50, 60, 70, 80, 90, 100, 150, 200 or more).

The GAS adhesin island amino acid sequences of the invention may include polypeptide fragments of the identified GAS proteins. The length of the fragment may vary depending on the amino acid sequence of the specific GAS antigen, but the fragment is preferably at least 7 consecutive amino acids, (e.g. 8, 10, 12, 14, 16, 18, 20, 25, 30, 35, 40, 50, 60, 70, 80, 90, 100, 150, 200 or more). Preferably the fragment comprises one or more epitopes from the sequence. Other preferred fragments include (1) the N-terminal signal peptides of each identified GAS protein, (2) the identified GAS protein without their N-terminal signal peptides, and (3) each identified GAS protein wherein up to 10 amino acid residues (e.g. 1, 2, 3, 4, 5, 6, 7, 8, 9, 10, 15, 20, 25 or more) are deleted from the N-terminus and/or the C-terminus e.g. the N-terminal amino acid residue may be deleted. Other fragments omit one or more domains of the protein (e.g. omission of a signal peptide, of a cytoplasmic domain, of a transmembrane domain, or of an extracellular domain).

GAS AI-Sequences

As discussed above, a GAS AI-sequence is present in an M6 strain isolate (MGAS10394). Examples of GAS AI-sequences from M6 strain isolate MGAS10394 are set forth below.

M6_Spy0156: Spy0156 is a rofA transcriptional regulator. An example of an amino acid sequence for M6_Spy0156 is set forth in SEQ ID NO:41.

SEQ ID NO: 41

```
MIEKYLESSIESKCQLVVLEFKTSYLPITEVAEKTGLTFLQLNHYCEE

LNAFFPDSLSMTIQKRMISCQFTHPFKETYLYQLYASSNVLQLLAFLI

KNGSHSRPLTDFARSHFLSNSSAYRMREALIPLLRNFELKLSKNKIVG

EEYRIRYLIALLYSKFGIKVYDLTQQDKNTIHSFLSHSSTHLKTSPWL

SESFSFYDILLALSWKRHQFSVTIPQTRIFQQLKKLFIYDSLKKSSRD

IIETYCQLNFSAGDLDYLYLIYITANNSFASLQWTPEHIRQCCQLFEE

NDTFRLLLKPIITLLPNLKEQKPSLVKALMFESKSFLENLQHFIPETN

LFVSPYYKGNQKLYTSLKLIVEEWLAKLPGKRYLNHKHFHLFCHYVEQ

ILRNIQPPLVVVFVASNFINAHLLTDSFPRYFSDKSIDFHSYIAR
```

M6_Spy0157: M6_Spy0157 is a fibronectin binding protein. It contains a sortase substrate motif LPXTG (SEQ ID NO:122), shown in italics in the amino acid sequence SEQ ID NO:42.

SEQ ID NO: 42

MVSSYMFVRGEKMNNKIFLNKEASFLAHTKRKRRFAVTLVGVFFMLLA

CAGAIGFGQVAYAADEKTVPSHSSPNPEFPWYGYDAYGKEYPGYNIWT

RYHDLRVNLNGSRSYQVYCFNIQSNYPSQKNSEIKNWFKKIEGNGKSF

VDYAHTTKLGKEELEQRLLSLLYNAYPNDANGYMKGLEHLNAITVTQY

AVWHYSDNSQYQFETLWESEAKEGKISRSQVTLMREALKKLIDPNLEA

TAVNKIPSGYRLNIFESENEAYQNLLSAEYVPDDPPKPGETSEHNPKT

PELDGTPIPEDPKHPDDNLEPTLPPVMLDGEEVPEVPSESLEPALPPL

MPELDGQEVPEKPSIDLPIEVPRYEFNNKDQSPLAGESGETEYITEVY

GNQQNPVDIDKKLPNETGFSGNMVETEDTKEPEVLMGGQSESVEFTKD

TQTGMSGQTTPQVETEDTKEPEVLMGGQSESVEFTKDTQTGMSGQTTP

QIETEDTKEPEVLMGGQSESVEFTKDTQTGMSGQTTPQIETEDTKEPE

VLMGGQSESVEFTKDTQTGMSGFSETATVVEDTRPKLVFHFDNNEPKV

EENREKPTKNITPI*LPATG*DIENVLAFLGILILSVLSIFSLLKNKQSN

KKV

M6_Spy0157 contains an amino acid motif indicative of a cell wall anchor: SEQ ID NO:180 LPATG (shown in italics in SEQ ID NO:42, above). In some recombinant host cell systems, it may be preferable to remove this motif to facilitate secretion of a recombinant M6_Spy0157 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in M6_Spy0157. The pilin motif sequence is underlined in SEQ ID NO:42, below. Conserved lysine (K) residues are also marked in bold, at amino acid residues 277, 287, and 301. The pilin sequence, in particular the conserved lysine residues, are thought to be important for the formation of oligomeric, pilus-like structures. Preferred fragments of M6_Spy0157 include at least one conserved lysine residue. Preferably, fragments include the pilin sequence.

SEQ ID NO: 42

MVSSYMFVRGEKMNNKTFLNKEASFLAHTKRKRRFAVTLVGVFFMLLA

CAGAIGFGQVAYAAMVSSYMFVRGEKMNNKIFLNKEASFLAHTKRKRR

FAVTLVGVFFMLLACAGAIGFGQVAYAADEKTVPSHSSPNPEFPWYGY

DAYGKEYPGYNIWTRYHDLRVNLNGSRSYQVYCFNIQSNYPSQKNSFI

KNWFKKIEGNGKSFVDYAHTTKLGKEELEQRLLSLLYNAYPNDANGYM

KGLEHLNAITVTQYAVWHYSDNSQYQFETLWESEAKEGKISRSQVTLM

REALKKLIDPNLEATAVNKIPSGYRLNIFESENEAYQNLLSAEYVPDD

PPKPGETSEHNPKTPELDGTPIPEDPKHPDDNLEPTLPPVMLDGEEVP

EVPSESLEPALPPLMPELDGQEVPEKPSIDLPIEVPRYEFNNKDQSPL

AGESGETEYITEVYGNQQNPVDIDKKLPNETGFSGNMVETEDTKEPEV

LMGGQSESVEFTKDTQTGMSGQTTPQVETEDTKEPEVLMGGQSESVEF

TKDTQTGMSGQTTPQIETEDTKEPEVLMGGQSESVEFTKDTQTGMSGQ

TTPQIETEDTKEPEVLMGGQSESVEFTKDTQTGMSGFSETATVVEDTR

PKLVFHFDNNEPKVEENREKPTKNITPILPATGDIENVLAFLGILILS

VLSIFSLLKNKQSNKKV

A repeated series of four E boxes containing a conserved glutamic residue have been identified in M6_Spy0157. The E-box motifs are underlined in SEQ ID NO:42, below. The conserved glutamic acid (E) residues, at amino acid residues 415, 452, 489, and 526 are marked in bold. The E box motif, in particular the conserved glutamic acid residue, is thought to be important for the formation of oligomeric pilus-like structures of M6_Spy0157. Preferred fragments of M6_Spy0157 include at least one conserved glutamic acid residue. Preferably, fragments include at least one E box motif

SEQ ID NO: 42

MVSSYMFVRGEKMNNKIFLNKEASFLAHTKRKRRFAVTLVGVFFMLLA

CAGAIGFGQVAYAADEKTVPSHSSPNPEFPWYGYDAYGKEYPGYNIWT

RYHDLRVNLNGSRSYQVYCFNIQSNYPSQKNSFIKNWFKKIEGNGKSF

VDYAHTTKLGKEELEQRLLSLLYNAYPNDANGYMKGLEHLNAITVTQY

AVWHYSDNSQYQFETLWESEAKEGKISRSQVTLMREALKKLIDPNLEA

TAVNKIPSGYRLNIFESENEAYQNLLSAEYVPDDPPKPGETSEHNPKT

PELDGTPIPEDPKHPDDNLEPTLPPVMLDGEEVPEVPSESLEPALPPL

-continued

MPELDGQEVPEKPSIDLPIEVPRYEFNNKDQSPLAGESGETEYITEVY

GNQQNPVDIDKKLPNETGFSGNMVETEDTKEPEVLMGGQSESVEFTKD

TQTGMSGQTTPQVETEDTKEPEVLMGGQSESVEFTKDTQTGMSGQTTP

QIETEDTKEPEVLMGGQSESVEFTKDTQTGMSGQTTPQIETEDTKEPE

VLMGGQSESVEFTKDTQTGMSGFSETATVVEDTRPKLVFHFDNNEPKV

EENREKPTKNITPILPATGDIENVLAFLGILILSVLSIFSLLKNKQSN

KKV

M6_Spy0158: M6_Spy0158 is a reverse transcriptase. An example of Spy0158 is shown in the amino acid sequence SEQ ID NO 43.

SEQ ID NO: 43

MSLRHQNKKGIRKEGWKSRPQSRWSDHCQLVAQKSVLKQAISKTVLAE

RGLFSCLDDYLERHALKVN

M6_Spy0159: M6_Spy0159 is a collagen adhesion protein. It contains a sortase substrate motif LPXSG, shown in italics in the amino acid sequence SEQ ID NO:44.

SEQ ID NO: 44

MYSRLKRELVIVINRKKKYKLIRLMVTVGLIFSQLVLPIRRLGLQMIS

TQTKVIPQEIVTQTETQGTQVVATKQKLESENSSLKVALKRESGFEHN

ATIDASLDTESQGDNSQRSVTQAIVTMALELRKQGLSIVDTKIVRIQS

STNQRNDITTTLTFKNGLSLEGASTEANDPNVRVGIVNPNDTVQTITP

TIKQDADGKVKNLVFTGRLGKQVIIVSTTRLKEEQTISLDSYGELVID

GAVGLSQKDRPPYSKPITVNILKPKLSSIESSLDSKDFETVKTIDNLY

TWDDQFYLLDFISKQYEVLKTDYQSAKDSTPQTRKILFGEYTVEPLVM

NKGHNNTINIYIRSTRPLGLKPIGAAPALIQPRSFRSLTPRSTRMKRS

APVEKFEGELEHHKRIDYLGDNQNNPDTTIDDKEDEHDTSDLYRLYLD

MTGKKNPLDILVVVDKSGSMQEGIGSVQRYRYYAQRWDDYYSQWVYHG

TFDYSSYQGESFNRGQIHYRYRGIVSVSDGIRRDDAVKNSLLGVNGLL

QRFVNINPENKLSVIGFQGSADYHAGKWYPDQSPRGGFYQPNLNNSRD

AELLKGWSTNSLLDPNTLTALHNNGTNYHAALLKAKETLNEVKDDGRR

KIMIFISDGVPTEYFGEDGYRSGNGSSNDRNNVTRSQEGSKLAIDEFK

ARYPNLSIYSLGVSKDINSDTASSSPVVLKYLSGEEHYYGITDTAELE

KTLNKIVEDSKLSQLGISDSLSQYVDYYDKQPDVLVTRKSKVNDETEI

LYQKDQVQEAGKDIIDKVVFTPKTTSQPKGKVTLTFKSDYKVDDEYTY

TLSFNVKASDEAYEKYKDNEGRYSEMGDSDTDYGTNQTSSGKGGLPSN

SDASVNYMADGREQKLPYKHPVIQVKTVPITFTKVDADNNQKKLAGVE

FELRKEDKKIVWEKGTTGSNGQLNFKYLQKGKTYYLYETKAKLGYTLP

ENPWEVAVANNGDIKVKHPIEGELKSKDGSYMIKNYKIYQ*LPSSG*GRG

SQIFIIVGSMTATVALLFYRRQHRKKQY

M6_Spy0159 contains an amino acid motif indicative of a cell wall anchor: SEQ ID NO:181 LPSSG (shown in italics in SEQ ID NO:44, above). In some recombinant host cell systems, it may be preferable to remove this motif to facilitate secretion of a recombinant M6_Spy0159 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in M6_Spy0159. The pilin motif sequence is underlined in SEQ ID NO:44, below. Conserved lysine (K) residues are also marked in bold, at amino acid residues 265 and 276. The pilin sequence, in particular the conserved lysine residues, are thought to be important for the formation of oligomeric, pilus-like structures. Preferred fragments of M6_Spy0159 include at least one conserved lysine residue. Preferably, fragments include the pilin sequence.

SEQ ID NO: 44

MYSRLKRELVIVINRKKKYKLIRLMVTVGLIFSQLVLPIRRLGLQMIS

TQTKVIPQEIVTQTETQGTQVVATKQKLESENSSLKVALKRESGFEHN

ATIDASLDTESQGDNSQRSVTQAIVTMALELRKQGLSIVDTKIVRIQS

STNQRNDITTTLTFKNGLSLEGASTEANDPNVRVGIVNPNDTVQTITP

TIKQDADGKVKNLVFTGRLGKQVIIVSTTRLKEEQTISLDSYGELVID

GAVGLSQKDRPPYSKPITVNILKPKLSSIESSLDSKDFEIVKTIDNLY

TWDDQFYLLDFISKQYEVLKTDYQSAKDSTPQTRDILFGEYTVEPLVM

NKGHNNTINIYIRSTRPLGLKPIGAAPALIQPRSFRSLTPRSTRMKRS

APVEKFEGELEHHKRIDYLGDNQNNPDTTIDDKEDEHDTSDLYRLYLD

MTGKKNPLDILVVVDKSGSMQEGIGSVQRYRYYAQRWDDYYSQWVYHG

TFDYSSYQGESFNRGQIHYRYRGIVSVSDGIRRDDAVKNSLLGVNGLL

QRFVNINPENKLSVIGFQGSADYHAGKWYPDQSPRGGFYQPNLNNSRD

AELLKGWSTNSLLDPNTLTALHNNGTNYHAALLKAKEILNEVKDDGRR

KIMIFISDGVPTFYFGEDGYRSGNGSSNDRNNVTRSQEGSKLAIDEFK

ARYPNLSIYSLGVSKDINSDTASSSPVVLKYLSGEEHYYGITDTAELE

KTLNKIVEDSKLSQLGISDSLSQYVDYYDKQPDVLVTRKSKVNDETEI

LYQKDQVQEAGKDIIDKVVFTPKTTSQPKGKVTLTFKSDYKVDDEYTY

TLSFNVKASDEAYEKYKDNEGRYSEMGDSDTDYGTNQTSSGKGGLPSN

SDASVNYMADGREQKLPYKHPVIQVKTVPITFTKVDADNNQKKLAGVE

FELRKEDKKIVWEKGTTGSNGQLNFKYLQKGKTYYLYETKAKLGYTLP

ENPWEVAVANNGDIKVKHPIEGELKSKDGSYMIKNYKIYQLPSSGGRG

SQIFIIVGSMTATVALLFYRRQHRKKQY

An E box containing a conserved glutamic residue has been identified in M6_Spy0159. The E-box motif is underlined in SEQ ID NO:44, below. The conserved glutamic acid (E), at amino acid residue 950, is marked in bold. The E box motif, in particular the conserved glutamic acid residue, is thought to be important for the formation of oligomeric pilus-like structures of M6_Spy0159. Preferred fragments of M6_Spy0159 include the conserved glutamic acid residue. Preferably, fragments include the E box motif

SEQ ID NO: 44

MYSRLKRELVIVINRKKKYKLIRLMVTVGLIFSQLVLPIRRLGLQMIS

TQTKVIPQEIVTQTETQGTQVVATKQKLESENSSLKVALKRESGFEHN

ATIDASLDTESQGDNSQRSVTQAIVTMALELRKQGLSIVDTKIVRIQS

STNQRNDITTTLTFKNGLSLEGASTEANDPNVRVGIVNPNDTVQTITP

TIKQDADGKVKNLVFTGRLGKQVIIVSTTRLKEEQTISLDSYGELVID

GAVGLSQKDRPPYSKPITVNILKPKLSSIESSLDSKDFEIVKTIDNLY

TWDDQFYLLDFISKQYEVLKTDYQSAKDSTPQTRDILFGEYTVEPLVM

NKGHNNTINIYIRSTRPLGLKPIGAAPALIQPRSFRSLTPRSTRMKRS

APVEKFEGELEHHKRIDYLGDNQNNPDTTIDDKEDEHDTSDLYRLYLD

MTGKKNPLDILVVVDKSGSMQEGIGSVQRYRYYAQRWDDYYSQWVYHG

TFDYSSYQGESFNRGQIHYRYRGIVSVSDGIRRDDAVKNSLLGVNGLL

QRFVNINPENKLSVIGFQGSADYHAGKWYPDQSPRGGFYQPNLNNSRD

AELLKGWSTNSLLDPNTLTALHNNGTNYHAALLKAKEILNEVKDDGRR

KIMIFISDGVPTFYFGEDGYRSGNGSSNDRNNVTRSQEGSKLAIDEFK

ARYPNLSIYSLGVSKDINSDTASSSPVVLKYLSGEEHYYGITDTAELE

KTLNKIVEDSKLSQLGISDSLSQYVDYYDKQPDVLVTRKSKVNDETEI

LYQKDQVQEAGKDIIDKVVFTPKTTSQPKGKVTLTFKSDYKVDDEYTY

TLSFNVKASDEAYEKYKDNEGRYSEMGDSDTDYGTNQTSSGKGGLPSN

SDASVNYMADGREQKLPYKHPVIQVKTVPITFTKVDADNNQKKLAGVE

FELRKEDKKIVWEKGTTGSNGQLNFKYLQKGKTYYLYETKAKLGYTLP

ENPWEVAVANNGDIKVKHPIEGELKSKDGSYMIKNYKIYQLPSSGGRG

SQIFIIVGSMTATVALLFYRRQHRKKQY

M6_Spy0160: M6_Spy0160 is a fimbrial structural subunit. It contains a sortase substrate motif LPXTG (SEQ ID NO:122), shown in italics in amino acid sequence SEQ ID NO:45.

SEQ ID NO: 45

MTNRRETVREKILITAKKLMLACLATLAVVGLGMTRVSALSKDDTAQL

KITNIEGGPTVTLYKIGEGVYNTNGDSFINFKYAEGVSLTETGPTSQE

ITTIANGINTGKIKPFSTENVSISNGTATYNARGASVYIALLTGATDG

RTYNPILLAASYNGEGNLVTKNIDSKSNYLYGQTSVAKSSLPSITKKV

TGTIDDVNKKTTSLGSVLSYSLTFELPSYTKEAVNKTVYVSDNMSEGL

TFNFNSLTVEWKGKMANITEDGSVMVENTKIGIAKEVNNGFNLSFIYD

SLESISPNISYKAVVNNKAIVGEEGNPNKAEFFYSNNPTKGNTYDNLD

KKPDKGNGITSKEDSKIVYTYQIAFRKVDSVSKTPLTGAIFGVYDTSN

KLIDIVTTNKNGYAISTQVSSGKYKIKELKAPKGYSLNTETYEITANW

VTATVKTSANSKSTTYTSDKNKATDNSEQVGWLKNGIFYSIDSRPTGN

DVKEAYIESTKALTDGTTFSKSNEGSGTVLLETDIPNTKLGE*LPSTGS*

IGTYLEKAIGSAAMIGAIGIYIVKRRKA

M6_Spy0160 contains an amino acid motif indicative of a cell wall anchor: SEQ ID NO:131 LPSTG (shown in italics in SEQ ID NO:45, above). In some recombinant host cell systems, it may be preferable to remove this motif to facilitate secretion of a recombinant M6_Spy0160 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

An E box containing a conserved glutamic residue has been identified in M6_Spy0160. The E-box motif is underlined in SEQ ID NO:45, below. The conserved glutamic acid (E), at amino acid residue 412, is marked in bold. The E box motif, in particular the conserved glutamic acid residue, is thought to be important for the formation of oligomeric pilus-like structures of M6_Spy0160. Preferred fragments of M6_Spy0160 include the conserved glutamic acid residue. Preferably, fragments include the E box motif

SEQ ID NO: 45

```
MTNRRETVREKILITAKKLMLACLAILAVVGLGMTRVSALSKDDTAQL
KITNIEGGPTVTLYKIGEGVYNTNGDSFINFKYAEGVSLTETGPTSQE
ITTIANGINTGKIKPFSTENVSISNGTATYNARGASVYIALLTGATDG
RTYNPILLAASYNGEGNLVTKNIDSKSNYLYGQTSVAKSSLPSITKKV
TGTIDDVNKKTTSLGSVLSYSLTFELPSYTKEAVNKTVYVSDNMSEGL
TFNFNSLTVEWKGKMANITEDGSVMVENTKIGIAKEVNNGFNLSFIYD
SLESISPNISYKAVVNNKAIVGEEGNPNKAEFFYSNNPTKGNTYDNLD
KKPDKGNGITSKEDSKIVYTYQTAFRKVDSVSKTPLIGAIFGVYDTSN
KLIDIVTTNKNGYAISTQVSSGKYKIKELKAPKGYSLNTETYEITANW
VTATVKTSANSKSTTYTSDKNKATDNSEQVGWLKNGIFYSIDSRPTGN
DVKEAYIESTKALTDGTTFSKSNEGSGTVLLETDIPNTKLGELPSTGS
IGTYLFKAIGSAAMIGAIGIYIVKRRKA
```

M6_Spy0161 is a srtB type sortase. An example of an amino acid sequence of M6-Spy-161 is shown in SEQ ID NO:46.

SEQ ID NO: 46

```
MTERLKNLGILLLFLLGTAIFLYPTLSSQWNAYRDRQLLSTYHKQVIQ
KKPSEMEEVWQKAKAYNARLGIQPVPDAFSFRDGIHDKNYESLLQIEN
NDIMGYVEVPSIKVTLPIYHYTTDEVLTKGAGHLFGSALPVGGDGTHT
VISAHRGLPSAEMFTNLNLVKKGDTFYFRVLNKVLAYKVDQILIVEPD
QATSLSGVMGKDYATLVTCTPYGVNTKRLLVRGHRIAYHYKKYQQAKK
AMKLVDKSRMWAEVVCAAFGVVIAIILVFMYSRVSAKKSK
```

As discussed above, applicants have also determined the nucleotide and encoded amino acid sequence of fimbrial structural subunits in several other GAS AI-1 strains of bacteria. Examples of sequences of these fimbrial structural subunits are set forth below.

M6 strain isolate CDC SS 410 is a GAS AI-1 strain of bacteria. CDC SS 410_fimbrial is thought to be a fimbrial structural subunit of M6 strain isolate CDC SS 410. An example of a nucleotide sequence encoding the CDC SS 410_fimbrial protein (SEQ ID NO:267) and a CDC SS 410_fimbrial protein amino acid sequence (SEQ ID NO:268) are set forth below.

SEQ ID NO: 267

```
aaagatgatactgcacaactaaagataacaaatattgaaggtgggcca
acagtaacactttataaaataggagaaggtgtttacaacactaatggt
gattcttttattaactttaaatatgctgaggggtttctttaactgaa
acaggacctacatcacaagaaattactactattgcaaatggtattaat
acgggtaaaataaagccttttagtactgaaaacgttagtatttctaat
ggaacagcaacttataatgcgagaggtgcatctgtttatattgcatta
ttaacaggtgcgacagatggccgtacctacaatcctattttattagct
gcatcttataatggtgagggaaatttagttactaaaaatattgattcc
aaatctaattatttatatggacaaacaagtgttgcaaaatcatcatta
ccatctattacaaagaaagtaaccgggacaatagatgacgtgaataaa
aagactacctcgttaggaagtgtattgtcttattcgctgacatttgaa
ttaccaagttataccaaagaagcagtcaataaaacagtatatgtttct
gataatatgtcggaaggtcttacttttaactttaatagtcttacagta
gaatggaaaggtaagatggctaatattactgaagatggttcagtaatg
gtagaaaatacaaaaatcggaatagctaaggaggttaataacggtttt
aatttaagttttatttatgatagtttagaatctatatcaccaaatata
agttataaagctgttgtaaacaataaagctattgttggtgaagagggt
aatcctaataaagctgaattcttctattcaaataatccaacaaaaggt
aatacatacgataatttagataagaagcctgataaagggaatggtatt
acatccaaagaagattctaaaattgtttatacttatcaaatagcgttt
agaaaagttgatagtgttagtaagaccccacttattggtgcaattttt
ggagtttatgatactagtaataaattaattgatattgttacaaccaat
aaaaatggatatgctatttcaacacaagtatcttcaggaaaatataaa
attaaggaattaaaagctcctaaaggttattcattgaatacagaaact
tatgaaattacggcaaattgggtaactgctacagtcaagacaagtgct
aattcaaaaagtactacttatacatctgataaaaataaggcgacagat
aattcagagcaagtaggatggttaaaaaatggtatattctattctata
gatagtagacctacaggaaatgatgttaaagaggcttatattgaatct
actaaggctttaactgatggaacaactttctcaaaatcgaatgaaggt
tcaggtacagtattattagaaactgacatccctaacaccaagctaggt
gaactc
```

SEQ ID NO: 268

```
KDDTAQLKTTNIEGGPTVTLYKIGEGVYNTNGDSFINFKYAEGVSLTE
TGPTSQEITTIANGINTGKIKPFSTENVSISNGTATYNARGASVYIAL
LTGATDGRTYNPILLAASYNGEGNLVTKNIDSKSNYLYGQTSVAKSSL
PSITKLVTGTIDDVNKKTTSLGSVLSYSLTFELPSYTKEAVNKTVYVS
DNMSEGLTFNFNSLTVEWKKGMANITEDGSVMVENTKIGIAKEVNNGF
NLSFIYDSLESISPNISYKAVVNNKAIVGEEGNPNKAEFFYSNNPTKG
NTYDNLDKKPDKGNGITSKEDSKIVYTYQIAFRKVDSVSKTPLIGAIF
GVYDTSNKLIDIVTTNKNGYAISTQVSSGKYKIKELKAPKGYSLNTET
YEITANWVTATVKTSANSKSTTYTSDKNKATDNSEQVGWLKNGIFYSI
```

-continued

DSRPTGNDVKEAYTESTKALTDGTTFSKSNEGSGTVLLETDIPNTKLG

EL

M6 strain isolate ISS 3650 is a GAS AI-1 strain of bacteria. ISS3650_fimbrial is thought to be a fimbrial structural subunit of M6 strain isolate ISS 3650. An example of a nucleotide sequence encoding the ISS3650_fimbrial protein (SEQ ID NO:269) and an ISS3650_fimbrial protein amino acid sequence (SEQ ID NO:270) are set forth below.

SEQ ID NO: 269 gaatggaaaggtaagatggctaatattactgaagatggttcagtaatg gtagaaaatacaaaaatcggaatagctaaggaggttaataacggtttt aatttaagttttatttatgatagtttagaatctatatcaccaaatata agttataaagctgttgtaaacaataaagctattgttggtgaagagggt aatcctaataaagctgaattcttctattcaaataatccaacaaaaggt aatacatacgataatttagataagaagcctgataaagggaatggtatt acatccaaagaagattctaaaattgtttatacttatcaaatagcgttt agaaaagttgatagtgttagtaagaccccacttattggtgcaattttt ggagtttatgatactagtaataaattaattgatattgttacaaccaat aaaaatggatatgctatttcaacacaagtatcttcaggaaaatataaa attaaggaattaaaagctcctaaaggttattcattgaatacagaaact tatgaaattacggcaaattgggtaactgctacagtcaagacaagtgct aattcaaaaagtactacttatacatctgataaaaataaggcgacagat aattcagagcaagtaggatggttaaaaaatggtatattctattctata gatagtagacctacaggaaatgatgttaaagaggcttatattgaatct actaaggctttaactgatggaacaactttctcaaaatcgaatgaaggt tcaggtacagtattattagaaactgacatcc

SEQ ID NO: 270

EWKGKMANITEDGSVMVENTKIGIAKEVNNGFNLSFIYDSLESISPNI

SYKAVVNNKAIVGEEGNPNKAEFFYSNNPTKGNTYDNLDKKPDKGNGI

TSKEDSDIVYTYQIAFRKVDSVSKTPLIGAIFGVYDTSNKLIDIVTTN

KNGYAISTQVSSGKYKIKELKAPKGYSLNTETYEITANWVTATVKTSA

NSKSTTYTSDKNKATDNSEQVGWLKNGIFYSIDSRPTGNDVKEAYIES

TKALTDGTTFSKSNEGSGTVLLETDI

M23 strain isolate DSM2071 is a GAS AI-1 strain of bacteria. DSM2071_fimbrial is thought to be a fimbrial structural subunit of M23 strain DSM2071. An example of a nucleotide sequence encoding the DSM2071_fimbrial protein (SEQ ID NO:251) and a DSM2071_fimbrial protein amino acid sequence (SEQ ID NO:252) are set forth below.

SEQ ID NO: 251 atgagagagaaaatattaatagcagcaaaaaaactaatgctagcttgt ttagctatcttagctgtagtagggcttggaatgacaagagtatcagct ttatcaaaagatgataaggcggagttgaagataacaaatatcgaaggt aaaccgaccgtgacactgtataaaattggtgatggaaaatacagtgag -continued cgaggggattcttttattggatttgagttaaagcaaggtgtggagcta aataaggcaaaacctacatctcaagaaataaataaaatcgctaatggt attaataaaggtagtgttaaggctgaagtagttaatataaaagaacat gctagtacaacttatagttatacaacaactggtgcaggtatttacttg gctatattgactggagctactgatggacgtgcctataatcctatctta ctgacagcttcttacaatgaggaaaatccacttaagggagggcagatt gacgcaactagtcattatctttttggagaagaagcagttgctaaatct agccaaccaacaattagcaagtcaattacaaaatccacaaaagatggt gataaagatacagcatctgtaggtgaaaaagttgattacaaattaact gttcagttaccaagttattcgaaagatgctatcaataaaacggtgttt atcactgacaaattgtctcagggacttactttccttccaaaaagttta aagattatctggaatggtcaaacgttaacaaaggtgaatgaagaattt aaagctggagataaggtaattgctcaacttaaggttgaaaataatgga tttaatctgaactttaattatgataaccttgataatcatgccccagaa gttaactatagtgctctactaaatgaaaacgcagttgttggtaaaggt ggtaatgacaataatgtagactattactattcaaataatccgaataaa ggagagacccataaaacaactgagaagcctaaagagggtgaaggtact ggtatcactaaaaagacggataaaaaaaccgtctacacctatcgtgta gcctttaagaaaacaggcaaagatcatgccccactagctggtgctgtt ttcggtatctattcagataaggaagcgaaacaattagtcgatattgtt gtgacaaatgcacagggttatgcagcatcaagcgaagttgggaaaggg acttattacattaaagaaattaaatcccctaagggttactctttaaat acaaatatttatgaagtggaaacttcatgggaaaaagctacaacgact tctacaactaatcgtttagagacaatttatacaacagatgataatcaa aagtctccaggaactaatacagttggttggttggaagatggtgtcttt tacaaagaaaatccaggtggtgatgctaaacttgcctatatcaaacaa tcaacagaggagacttctacaactatagaagtcaaagaaaatcaagct gaaggttcaggtacggtattattagaaactgaaattcctaacaccaaa ttaggtgaattaccttcgacaggtagcattggtacttacctctttaaa gctattggttcggctgctatgatcggtgcaattggtatttatattgtt aaacgtcgtaaagcttaa

SEQ ID NO: 252

MREKILIAAKKLMLACLATLAVVGLGMTRVSALSKDDKAELKITNIEG

KPTVTLYKIGDGKYSERGDSFIGFELKQGVELNKAKPTSQEINKIANG

INKGSVKAEVVNIKEHASTTYSYTTTGAGIYLAILTGATDGRAYNPIL

LTASYNEENPLKGGQIDATSHYLFGEEAVAKSSQPTISKSITKSTKDG

DKDTASVGEKVDYKLTVQLPSYSKDAINKTVFITDKLSQGLTFLPKSL

KIIWNGQTLTKVNEEFKAGDKVIAQLKVENNGFNLNFNYDNLDNHAPE

VNYSALLNENAVVGKGGNDNNVDYYYSNNPNKGETHKTTEKPKEGEGT

GITKKTDKKTVYTYRVAFKKTGKDHAPLAGAVFGIYSDKEAKQLVDIV

VTNAQGYAASSEVGKGTYYIKEIKSPKGYSLNTNIYEVETSWEKATTT

-continued

STTNRLETIYTTDDNQKSPGTNTVGWLEDGVFYKENPGGDAKLAYIKQ

STEETSTTIEVKENQAEGSGTVLLETEIPNTKLGELPSTGSIGTYLFK

AIGSAAMIGAIGIYIVKRRKA

GAS AI-Sequences

As discussed above, a GAS AI-sequence is present in an M1 strain isolate (SF370). Examples of GAS AI-sequences from M1 strain isolate SF370 are set forth below.

Spy0124 is a rofA transcriptional regulator. An example of an amino acid sequence for Spy0124 is set forth in SEQ ID NO:47.

SEQ ID NO: 47

MIEKYLESSIESKGQLIVLFFKTSYLPITEVAEKTGLTFLQLNHYCEE

LNAFFPGSLSMTIQKRMISCQFTHPFKETYLYQLYASSNVLQLLAFLI

KNGSHSRPLTDPARSHFLSNSSAYRMREALIPLLRNFELKLSKNKIVG

EEYRIRYLIALLYSKFGIKVYDLTQQDKNTIHSFLSHSSTHLKTSPWL

SESESFYDILLALSWKRHQFSVTIPQTRIFQQLKKLFVYDSLKKSSHD

IIETYGQLNFSAGDLDYLYLIYITANNSFASLQWTPEHIRQYCQLFEE

NDTFRLLLNPIITLLPNLKEQKASLVKALMFFSKSFLFNLQHFIPETN

LFVSPYYKGNQKLYTSLKLIVEEWMAKLPGKRDLNHKHFHLFCHYVEQ

SLRNIQPPLVVVFVASNFINAHLLTDSFPRYFSDKSIDFHSYYLLQDN

VYQIPDLKPDLVITHSQLIPFVHHELTKGIAVAEISFDESILSIQELM

YQVKEEKEQADLTKQLT

GAS 015 is also referred to as Cpa. It contains a sortase substrate motif VVXTG (SEQ ID NO:135), shown in italics in SEQ ID NO:48.

SEQ ID NO: 48

LRGEKMKKTRFPNKLNTLNTQRVLSKNSKRFTVTLVGVFLMIEALVTS

MVGAKTVFGLVESSTPNAINPDSSSEYRWYGYESYVRGHPYYKQERVA

HDLRVNLEGSRSYQVYCFNLKKAFPLGSDSSVKKWYKKHDGISTKFED

YAMSPRITGDELNQKLRAVMYNGHPQNANGIMEGLEPLNAIRVTQEAV

WYYSDNAPISNPDESFKRESESNLVSTSQLSLMRQALKQLIDPNLATK

MPKQVPDDFQLSIFESEDKGDKYNKGYQNLLSGGLVPTKPPTPGDPPM

PPNQPQTTSVLIRKYAIGDYSKLLEGATLQLTGDNVNSFQARVFSSND

IGERIELSDGTYTLTELNSPAGYSIAEPITFKVEAGKVYTIIDGKQIE

NPNKEIVEPYSVEAYNDFEEFSVLTTQNYAKFYYAKNKNGSSQVVYCF

NADLKSPPDSEDGGKTMTPDFTTGEVKYTHIAGRDLFKYTVKPRDTDP

DTFLKHIKKVIEKGYREKGQAIEYSGLTETQLRAATQLATYYFTDSAE

LDKDKLKDYHGFGDMNDSTLAVAKILVEYAQDSNPPQLTDLDFFIPNN

NKYQSLIGTQWHPEDLVDTIRMEDKKEVIPVTHNLTLRKTVTGLAGDR

TKDFHFEIELKNNKQELLSQTVKTDKTNLEFKDGKATINLKHGESLTL

QGLPEGYSYLVKETDSEGYKVKVNSQEVANATVSKTGITSDETLAFEN

NKEP*VVPTG*VDQKINGYLALIVIAGISLGIWGIHTIRIRKHD

GAS 015 contains an amino acid motif indicative of a cell wall anchor: SEQ ID NO:182 VVPTG (shown in italics in SEQ ID NO:48, above). In some recombinant host cell systems, it may be preferable to remove this motif to facilitate secretion of a recombinant GAS 015 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in GAS 015. The pilin motif sequence is underlined in SEQ ID NO:48, below. Conserved lysine (K) residues are also marked in bold, at amino acid residue 243. The pilin sequence, in particular the conserved lysine residues, are thought to be important for the formation of oligomeric, pilus-like structures. Preferred fragments of GAS 015 include the conserved lysine residue. Preferably, fragments include the pilin sequence.

SEQ ID NO: 48

LRGEKMKKTRFPNKLNTLNTQRVLSKNSKRFTVTLVGVFLMIFALVTS

MVGAKTVFGLVESSTPNAINPDSSSEYRWYGYESYVRGHPYYKQFRVA

HDLRVNLEGSRSYQVYCFNLKKAFPLGSDSSVKKWYKKHDGISTKFED

YAMSPRITGDELNQKLRAVMYNGHPQNANGIMEGLEPLNAIRVTQEAV

WYYSDNAPISNPDESFKRESESNLVSTSQLSLMRQALKQLIDPNLATK

MPKQVPDDFQLSIFESEDKGDKYNKGYQNLLSGGLVPTKPPTPGDPPM

PPNQPQTTSVLIRKYAIGDYSKLLEGATLQLTGDNVNSFQARVFSSND

IGERIELSDGTYTLTELNSPAGYSIAEPITFKVEAGKVYTIIDGKQIE

NPNKEIVEPYSVEAYNDFEEFSVLTTQNYAKFYYAKNKNGSSQVVYCF

NADLKSPPDSEDGGKTMTPDFTTGEVKYTHIAGRDLFKYTVKPRDTDP

DTFLKHIKKVIEKGYREKGQAIEYSGLTETQLRAATQLAIYYFTDSAE

LDKDKLKDYHGFGDMNDSTLAVAKILVEYAQDSNPPQLTDLDFFIPNN

NKYQSLIGTQWHPEDLVDIIRMEDKKEVIPVTHNLTLRKTVTGLAGDR

TKDFHFEIELKNNKQELLSQTVKTDKTNLEFKDGKATINLKHGESLTL

QGLPEGYSYLVKETDSEGYKVKVNSQEVANATVSKTGITSDETLAFEN

NKEPVVPTGVDQKINGYLALIVIAGISLGIWGIHTIRIRKHD

An E box containing a conserved glutamic residue has been identified in GAS 015. The E-box motif is underlined in SEQ ID NO:48, below. The conserved glutamic acid (E), at amino acid residue 352, is marked in bold. The E box motif, in particular the conserved glutamic acid residue, is thought to be important for the formation of oligomeric pilus-like structures of GAS 015. Preferred fragments of GAS 015 include the conserved glutamic acid residue. Preferably, fragments include the E box motif

SEQ ID NO: 48

LRGEKMKKTRFPNKLNTLNTQRVLSKNSKRFTVTLVGVFLMIFALVTS

MVGAKTVFGLVESSTPNAINPDSSSEYRWYGYESYVRGHPYYKQFRVA

HDLRVNLEGSRSYQVYCFNLKKAFPLGSDSSVKKWYKKHDGISTKFED

YAMSPRITGDELNQKLRAVMYNGHPQNANGIMEGLEPLNAIRVTQEAV

-continued

WYYSDNAPISNPDESFKRESESNLVSTSQLSLMRQALKQLIDPNLATK

MPKQVPDDFQLSIFESEDKGDKYNKGYQNLLSGGLVPTKPPTPGDPPM

PPNQPQTTSVLIRKYAIGDYSKLLEGATLQLTGDNVNSFQARVFSSND

IGERIELSDGTYTLTELNSPAGYSIAEPITFKVEAGKVYTIIDGKQIE

NPNKEIVEPYSVEAYNDFEEFSVLTTQNYAKFYYAKNKNGSSQVVYCF

NADLKSPPDSEDGGKTMTPDFTTGEVKYTHIAGRDLFKYTVKPRDTDP

DTFLKHIKKVIEKGYREKGQAIEYSGLTETQLRAATQLAIYYFTDSAE

LDKDKLKDYHGFGDMNDSTLAVAKILVEYAQDSNPPQLTDLDFFIPNN

NKYQSLIGTQWHPEDLVDIIRMEDKKEVIPVTHNLTLRKTVTGLAGDR

TKDFHFEIELKNNKQELLSQTVKTDKTNLEFKDGKATINLKHGESLTL

QGLPEGYSYLVKETDSEGYKVKVNSQEVANATVSKTGITSDETLAFEN

NKEPVVPTGVDQKINGYLALIVIAGISLGIWGIHTIRIRKHD

Spy0127 is a LepA putative signal peptidase. An example of an amino acid sequence for Spy0127 is set forth in SEQ ID NO:49.

SEQ ID NO: 49

MIIKRNDMAPSVKAGDAILFYRLSQTYKVEEAVVYEDSKTSITKVGRI

IAQAGDEVDLTEQGELKINGHIQNEGLTFIKSREANYPYRIADNSYLT

LNDYYSQESENYLQDAIAKDAIKGTINTLIRLRNH

Spy0128 is thought to be a fibrial protein. It contains a sortase substrate motif EVXTG (SEQ ID NO:136) shown in italics in SEQ ID NO:50.

SEQ ID NO: 50

MKLRHLLLTGAALTSFAATTVHGETVVNGAKLTVTKNLDLVNSNALIP

NTDFTFKIEPDTTVNEDGNKFKGVALNTPMTKVTYTNSDKGGSNTKTA

EFDFSEVTFEKPGVYYYKVTEEKIDKVPGVSYDTTSYTVQVHVLWNEE

QQKPVATYIVGYKEGSKVPIQFKNSLDSTTLTVKKKVSGTGGDRSKDF

NFGLTLKANQYYKASEKVMIEKTTKGGQAPVQTEASIDQLYHFTLKDG

ESIKVTNLPVGVDYVVTEDDYKSEKYTTNVEVSPQDGAVKNIAGNSTE

QETSTDKDMTITFTNKKDF*EVPTG*VAMTVAPYIALGIVAVGGALYFVK

KKNA

Spy0128 contains an amino acid motif indicative of a cell wall anchor: SEQ ID NO:183 EVPTG (shown in italics in SEQ ID NO:50, above). In some recombinant host cell systems, it may be preferable to remove this motif to facilitate secretion of a recombinant Spy0128 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

Two E boxes containing a conserved glutamic residue have been identified in Spy0128. The E-box motifs are underlined in SEQ ID NO:50, below. The conserved glutamic acid (E) residues, at amino acid residues 271 and 290, are marked in bold. The E box motifs, in particular the conserved glutamic acid residues, are thought to be important for the formation of oligomeric pilus-like structures of Spy0128. Preferred fragments of Spy0128 include at least one conserved glutamic acid residue. Preferably, fragments include at least one E box motif

SEQ ID NO: 50

MKLRHLLLTGAALTSFAATTVHGETVVNGAKLTVTKNLDLVNSNALIP

NTDFTFKIEPDTTVNEDGNKFKGVALNTPMTKVTYTNSDKGGSNTKTA

EFDFSEVTFEKPGVYYYKVTEEKIDKVPGVSYDTTSYTVQVHVLWNEE

QQKPVATYIVGYKEGSKVPIQFKNSLDSTTLTVKKKVSGTGGDRSKDF

NFGLTLKANQYYKASEKVMIEKTTKGGQAPVQTEASIDQLYHFTLKDG

ESIKVTNLPVGVDYVVTEDDYKSEKYTTNVEVSPQDGAVKNIAGNSTE

QETSTDKDMTITFTNKKDFEVPTGVAMTVAPYIALGIVAVGGALYFVK

KKNA

Spy0129 is a srtC1 type sortase. An example of an amino acid sequence for Spy0129 is set forth in SEQ ID NO:51.

SEQ ID NO: 51

MIVRLIKLLDKLINVIVLCFFFLCLLIAALGIYDALTVYQGANATNYQ

QYKKKGVQFDDLLAINSDVMAWLTVKGTHIDYPIVQGENNLEYINKSV

EGEYSLSGSVFLDYRNKVTFEDKYSLIYAHHMAGNVMFGELPNFRKKS

FFNKHKEESIETKTKQKLKINIFACIQTDAFDSLLFNPIDVDISSKNE

FLNHIKQKSVQYREILTTNESRFVALSTCEDMTTDGRIIVIGQIE''

Spy0130 is referred to as a hypothetical protein. It contains a sortase substrate motif LPXTG (SEQ ID NO:122), shown in italics in SEQ ID NO:52.

SEQ ID NO: 52

MKKSILRILAIGYLLMSFCLLDSVEAENLTASINIEVINQVDVATNKQ

SSDIDETFMPVIEALDKESPLPNSVTTSVKGNGKTSFEQLTPSEVGQY

HYKIHQLLGKNSQYHYDETVYEVVIYVLYNEQSGALETNLVSNKLGET

EKSELIFKQEYSEKTPEPHQPDTTEKEKPQKKRNGI*LPSTG*EMVSYVS

ALGIVLVATITLYSIYKKLKTSK

Spy0130 contains an amino acid motif indicative of a cell wall anchor: SEQ ID NO:131 LPSTG (shown in italics in SEQ ID NO:52, above). In some recombinant host cell systems, it may be preferable to remove this motif to facilitate secretion of a recombinant Spy0130 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

Two E boxes containing conserved glutamic residues have been identified in Spy0130. The E-box motifs are underlined in SEQ ID NO:52, below. The conserved glutamic acid (E) residues, at amino acid residues 118 and 148, are marked in bold. The E box motifs, in particular the conserved glutamic acid residues, are thought to be important for the formation of oligomeric pilus-like structures of Spy0130. Preferred fragments of Spy0130 include at least one conserved glutamic acid residue. Preferably, fragments include at least one E box motif.

SEQ ID NO: 52

MKKSILRILAIGYLLMSFCLLDSVEAENLTASINIEVINQVDVATNKQ

SSDIDETFMFVIEALDKESPLPNSVTTSVKGNGKTSFEQLTFSEVGQY

HYKIHQLLGKNSQYHYDETVYEVVIYVLYNEQSGALETNLVSNKLGET

EKSELIFKQEYSEKTPEPHQPDTTEKEKPQKKRNGILPSTGEMVSYVS

ALGIVLVATITLYSIYKKLKTSK

Spy0131 is referred to as a conserved hypothetical protein. An example of an amino acid sequence of Spy0131 is set forth in SEQ ID NO:53

SEQ ID NO: 53

MTRTNYQKKRMTCPVETEDITYRRKKIKGRRQAILAQFEPELVHHELI

GDSCTCPDCHGTLTEIGSVVQRQELVFIPAQLKRINHVQHAYKCQTCS

DNSLSDKIIKAPVPKAPLAHSLGSASIIAHTVHQKFTLKVPNYRQEED

WNKLGLSISRKEIANWHIKSSQYYFEPLYDLLRDILLSQEVIHADETS

YRVLESDTQLTYYWTFLSGKHEKKGITLYHHDKRRSGLVTQEVLGDYS

GYVHCDMHGAYRQLEHAKLVGCWAHVRRKFFEATPKQADKTSLGRKGL

VYCDKLFALEAEWCELPPQERLVKRKEILTPLMTTFEDWCREQVVLSG

SKLGLATAYSLKHERTFRTVLEDGHIVLSNNMAERAIKSLVMGRKNWL

FSQSFEGAKAAAIIMSLLETAKRHGLNSEKYISYLLDRLPNEETLAKR

EVLEAYLPWAKKVQTNCQ

Spy0133 is referred to as a conserved hypothetical protein. An example of an amino acid sequence of Spy0133 is set forth in SEQ ID NO:54.

SEQ ID NO: 54

MTIRLNDLGQVYLVCGKTDMRQGIDSLAYLVKSQHELDLFSGAVYLFC

GGRTRDRFKALYWDGQGFWLLYKRFENGKLAWPRNRDEVKCLTAVQVD

WLMKGFFISPNIKISKSHDFY

Spy0135 is a SrtB type sortase. It is also referred to as a putative fibria-associated protein. An example of an amino acid sequence of Spy0135 is set forth in SEQ ID NO:55.

SEQ ID NO: 55

MECYRDRQLLSTYHKQVTQKKPSEMEEVWQKAKAYNARLGIQPVPDAF

SFRDGIHDKNYESLLQIENNDIMGYVEVPSIKVTLPIYHYTTDEVLTK

GAGHLFGSALPVGGDGTHTVISAHRGLPSAEMETNLNLVKKGDTFYFR

VLNKVLAYKVDQILTVEPDQVTSLSGVMGKDYATLVTCTPYGVNTKRL

LVRGHRIAYHYKKYQQAKKAMKLVDKSRMWAEVVCAAFGVVIAIILVF

MYSRVSAKKSK

GAS AI-Sequences

As discussed above, a GAS AI-sequence is present in a M3, M18 and M5 strain isolates. Examples of GAS AI-sequences from M3 strain isolate MGAS315 are set forth below.

SpyM3_0097 is as a negative transcriptional regulator (Nra). An example of an amino acid sequence of SpyM3_0097 is set forth in SEQ ID NO:56.

SEQ ID NO: 56

MPYVKKKKDSFLVETYLEQSIRDKSELVLLLFKSPTIIFSHVAKQTGL

TAVQLKYYCKELDDFFGNNLDTTIKKGKIICCFVKPVKEFYLHQLYDT

STILKLLVFFIKNGTSSQPLIKFSKKYFLSSSSAYRLRESLIKLLREF

GLRVSKNTIVGEEYRIRYLIAMLYSKFGIVIYPLDHLDNQIIYRFLSQ

SATNLRTSPWLEEPFSFYNMLLALSWKRHQFAVSIPQTRIFRQLKKLF

IYDCLTRSSRQVIENAFSLTFSQGDLEYLFLIYITTNNSFASLQWTPQ

HIETCCHIFEKNDTFRLLLEPILKRLPQLNHSKQDLIKALMYFSKSFL

FNLQHFVIEIPSFSLPTYTGNSNLYKALKNIVNQWLAQLPGKRHLNEK

HLQLFCSHIEQILKNKQPALTVVLISSNFINAKLLTDTIPRYPSDKGI

HFYSFYLLRDDIYQIPSLKPDLVITHSRLIPFVKNDLVKGVTVAEFSF

DNPDYSIASIQNLTYQLKDKKYQDFLNEQLQ

SpyM3_0098 is thought to be a collagen binding protein (Cpb). It contains a sortase substrate motif VPXTG (SEQ ID NO:137) shown in italics in SEQ ID NO:57.

SEQ ID NO: 57

MQKRDKTNYGSANNKRRQTTIGLLKVFLTFVALIGIVGFSIRAFGAEE

QSVPNKQSSVQDYPWYGYDSYSKGYPDYSPLKTYHNLKVNLDGSKEYQ

AYCFNLTKHFPSKSDSVRSQWYKKLEGTNENFIKLADKPRIEDGQLQQ

NILRILYNGYPNDRNGIMKGIDPLNAILVTQNAIWYYTDSSYISDTSK

AFQQEETDLKLDSQQLQLMRNALKRLINPKEVESLPNQVPANYQLSIF

QSSDKTFQNLLSAEYVPDTPPKPGEEPPAKTEKTSVIIRKYAEGDYSK

LLEGATLKLAQIEGSGFQEKIFDSNKSGEKVELPNGTYVLSELKPPQG

YGVATPITFKVAAEKVLIKNKEGQFVENQNKEIAEPYSVTAFNDEEEI

GYLSDFNNYGKFYYAKNTNGTNQVVYCFNADLHSPPDSYDHGANIDPD

VSESKEIKYTHVSGYDLYKYAATPRDKDADFFLKHIKKILDKGYKKKG

DTYKTLTEAQFRAATQLAIYYYTDSADLTTLKTYNDNKGYHGFDKLDD

ATLAVVHELITYAEDVTLPMTQNLDEFVPNSSRYQALIGTQYHPNELI

DVISMEDKQAPIIPITHKLTISKTVTGTIADKKKEFNFEIHLKSSDGQ

AISGTYPTNSGELTVTDGKATFTLKDGESLIVEGLPSGYSYEITETGA

SDYEVSVNGKNAPDGKATKASVKEDETVAFENRKDL*VPPTG*LTTDGAI

YLWLLLLVPFGLLVWLFGRKGTKK

SpyM3_0098 contains an amino acid motif indicative of a cell wall anchor: SEQ ID NO:184 VPPTG (shown in italics in SEQ ID NO:57, above). In some recombinant host cell systems, it may be preferable to remove this motif to facilitate secretion of a recombinant SpyM3_0098 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in SpyM30098. The pilin motif sequence is underlined in SEQ ID NO:57, below. Conserved lysine (K) residues are also marked in bold, at amino acid residues 262 and 270. The pilin sequence, in particular the conserved lysine residues, are thought to be important for the formation of oligomeric, pilus-like structures. Preferred fragments of SpyM30098 include at least one conserved lysine residue. Preferably, fragments include the pilin sequence.

SEQ ID NO: 57

```
MQKRDKTNYGSANNKRRQTTIGLLKVFLTFVALIGIVGFSIRAFGAEE
QSVPNKQSSVQDYPWYGYDSYSKGYPDYSPLKTYHNLKVNLDGSKEYQ
AYCFNLTKHFPSKSDSVRSQWYKKLEGTNENFIKLADKPRIEDGQLQQ
NILRILYNGYPNDRNGIMKGIDPLNAILVTQNAIWYYTDSSYISDTSK
AFQQEETDLKLDSQQLQLMRNALKRLINPKEVESLPNQVPANYQLSIF
QSSDKTFQNLLSAEYVPDTPPKPGEEPPAKTEKTSVIIRKYAEGDYSK
LLEGATLKLAQIEGSGFQEKIFDSNKSGEKVELPNGTYVLSELKPPQG
YGVATPITFKVAAEKVLIKNKEGQFVENQNKEIAEPYSVTAFNDFEEI
GYLSDFNNYGKFYYAKNTNGTNQVVYCFNADLHSPPDSYDHGANIDPD
VSESKEIKYTHVSGYDLYKYAATPRDKDADFFLKHIKKILDKGYKKKG
DTYKTLTEAQFRAATQLAIYYYTDSADLTTLKTYNDNKGYHGFDKLDD
ATLAVVHELITYAEDVTLPMTQNLDFFVPNSSRYQALIGTQYHPNELI
DVISMEDKQAPIIPITHKLTISKTVTGTIADKKKEFNFEIHLKSSDGQ
AISGTYPTNSGELTVTDGKATFTLKDGESLIVEGLPSGYSYEITETGA
SDYEVSVNGKNAPDGKATKASVKEDETVAFENRKDLVPPTGLTTDGAI
YLWLLLLVPFGLLVWLFGRKGTKK
```

An E box containing a conserved glutamic residue has been identified in SpyM3_0098. The E-box motif is underlined in SEQ ID NO:57, below. The conserved glutamic acid (E), at amino acid residue 330, is marked in bold. The E box motif, in particular the conserved glutamic acid residue, is thought to be important for the formation of oligomeric pilus-like structures of SpyM30098. Preferred fragments of SpyM30098 include the conserved glutamic acid residue. Preferably, fragments include the E box motif

SEQ ID NO: 57

```
MQKRDKTNYGSANNKRRQTTIGLLKVFLTFVALIGIVGFSIRAFGAEE
QSVPNKQSSVQDYPWYGYDSYSKGYPDYSPLKTYHNLKVNLDGSKEYQ
AYCFNLTKHFPSKSDSVRSQWYKKLEGTNENFIKLADKPRIEDGQLQQ
NILRILYNGYPNDRNGIMKGIDPLNAILVTQNAIWYYTDSSYISDTSK
AFQQEETDLKLDSQQLQLMRNALKRLINPKEVESLPNQVPANYQLSIF
QSSDKTFQNLLSAEYVPDTPPKPGEEPPAKTEKTSVIIRKYAEGDYSK
LLEGATLKLAQIEGSGFQEKIFDSNKSGEKVELPNGTYVLSELKPPQG
YGVATPITFKVAAEKVLIKNKEGQFVENQNKEIAEPYSVTAFNDFEEI
GYLSDFNNYGKFYYAKNTNGTNQVVYCFNADLHSPPDSYDHGANIDPD
VSESKEIKYTHVSGYDLYKYAATPRDKDADFFLKHIKKILDKGYKKKG
DTYKTLTEAQFRAATQLAIYYYTDSADLTTLKTYNDNKGYHGFDKLDD
ATLAVVHELITYAEDVTLPMTQNLDFFVPNSSRYQALIGTQYHPNELI
DVISMEDKQAPIIPITHKLTISKTVTGTIADKKKEFNFEIHLKSSDGQ
```

-continued

```
AISGTYPTNSGELTVTDGKATFTLKDGESLIVEGLPSGYSYEITETGA
SDYEVSVNGKNAPDGKATKASVKEDETVAFENRKDLVPPTGLTTDGAI
YLWLLLLVPFGLLVWLFGRKGTKK
```

SpyM30099 is referred to as LepA. An example of an amino acid sequence of SpyM30099 is set forth in SEQ ID) NO: 58.

SEQ ID NO: 58

```
MTNYLNRLNENPLLKAFIRLVLKISTIGFLGYILFQYVFGVMIVNTN
QMSPAVSAGDGVLYYRLTDRYHINDVVVYEVDDTLKVGRIAAQAGDV
ENFTQEGGLLINGHPPEKEVPYLTYPHSSGPNFPYKVPGTYFILND
YREERLDSRYYGALPINQIKGKISTLLRVRGI
```

SpyM30100 is thought to be a fimbrial protein. An example of an amino acid sequence of SpyM30100 is set forth in SEQ ID NO:59.

SEQ ID NO: 59

```
MKKNKLLLATAILATALGTASLNQNVKAETAGVSENAKLIVKKTFDS
YTDNEVLMPKADYTFKVEADSTASGKTKDGLEIKPGIVNGLTEQIIS
YTNTDKPDSKVKSTEFDFSKVVFPGIGVYRYTVSEKQGDVEGITYDT
KKWTVDVYVGNKEGGGFEPKFIVSKEQGTDVKKPVNFNNSFATTSLK
VKKNVSGNTGELQKEFDFTLTLNESTNFKKDQIVSLQKGNEKFEVKI
GTPYKFKLKNGESIQLDKLPVGITYKVNEMEANKDGYKTTASLKEGD
GQSKMYQLDMEQKTDESADEIVVTNKRDTQVPTGVVGTLAPFAVLSI
VAIGGVIYITKRKKA
```

SpyM30100 contains an amino acid motif indicative of a cell wall anchor: SEQ ID NO:140 QVPTG (shown in italics in SEQ ID NO:59, above). In some recombinant host cell systems, it may be preferable to remove this motif to facilitate secretion of a recombinant SpyM30100 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

Two pilin motifs, discussed above, containing conserved lysine (K) residues have also been identified in SpyM30100. The pilin motif sequences are underlined in SEQ ID NO:59, below. Conserved lysine (K) residues are also marked in bold, at amino acid residues 57 and 63 and at amino acid residues 161 and 166. The pilin sequences, in particular the conserved lysine residues, are thought to be important for the formation of oligomeric, pilus-like structures. Preferred fragments of SpyM30100 include at least one conserved lysine residue. Preferably, fragments include at least one pilin sequence.

SEQ ID NO: 59

```
MKKNKLLLATAILATALGTASLNQNVKAETAGVSENAKLIVKKTFDS
YTDNEVLMPKADYTFKVEADSTASGKTKDGLEIKPGIVNGLTEQIIS
YTNTDKPDSKVKSTEFDFSKVVFPGIGVYRYTVSEKQGDVEGITYDT
```

-continued

KKWTVDVYVGNKEGGGFEPKFIVSKEQGTDVKKPVNFNNSFATTSLK

VKKNVSGNTGELQKEFDFTLTLNESTNFKKDQIVSLQKGNEKFEVKI

GTPYKFKLKNGESIQLDKLPVGITYKVNEMEANKDGYKTTASLKEGD

GQSKMYQLDMEQKTDESADEIVVTNKRDTQVPTGVVGTLAPFAVLSI

VAIGGVIYITKRKKA

Two E boxes, each containing a conserved glutamic residue, have been identified in SpyM30100. The E-box motifs are underlined in SEQ ID NO: 59, below. The conserved glutamic acid (E) residues, at amino acid residues 232 and 264, are marked in bold. The E box motifs, in particular the conserved glutamic acid residues, are thought to be important for the formation of oligomeric pilus-like structures of SpyM30100. Preferred fragments of SpyM30100 include at least one conserved glutamic acid residue. Preferably, fragments include at least one E box motif

SEQ ID NO: 59

MKKNKLLLATAILATALGTASLNQNVKAETAGVSENAKLIVKKTFDS

YTDNEVLMPKADYTFKVEADSTASGKTKDGLEIKPGIVNGLTEQIIS

YTNTDKPDSKVKSTEFDFSKVVFPGIGVYRYTVSEKQGDVEGITYDT

KKWTVDVYVGNKEGGGFEPKFIVSKEQGTDVKKPVNFNNSFATTSLK

VKKNVSGNTGELQKEFDFTLTLNESTNFKKDQIVSLQKGNEKFEVKI

GTPYKFKLKNGESIQLDKLPVGITYKVNEMEANKDGYKTTASLKEGD

GQSKMYQLDMEQKTDESADEIVVTNKRDTQVPTGVVGTLAPFAVLSI

VAIGGVIYITKRKKA

SpyM30101 is a SrtC2 type sortase. An example of an amino acid sequence of SpyM30101 is set forth in SEQ ID NO:60.

SEQ ID NO: 60

MTIVQVINKAIDTLILIFCLVVLFLAGFGLWDSYHLYQQADASNPKK

FKTAQQQPKFEDLLALNEDVIGWLNIPGTHIDYPLVQGKTNLEYINK

AVDGSVANSGSLFLDTRNHNDFTDDYSLIYGHHMAGNAMFGEIPKFL

KKDFPSKHNKATIETKERKKLTVTIFACLKTDAFNQLVFNPNAITNQ

DQQRQLVDYISKRSKQFKPVKLKHHTKFVAFSTCENFSTDNRVIVVG

TTQE

SpyM30102 is referred to as a hypothetical protein. An example of an amino acid sequence of SpyM30102 is set forth in SEQ ID NO:61.

SEQ ID NO: 61

MILTMLAFNQTVLAKDSTVQTSISVENVLERAGDSTPFSIALESIDA

MKTIEEITIAGSGKASFSPLTFTTVGQYTYRVYQKPSQNKDYQADTT

VFDVLVYVTYDEDGTLVAKVISRRAGDEEKSAITFKPKWLVKPIPPR

QPNIPKTP*LPLAG*EVKSLLGILSIVLLGLLVLLYVKKLKSRL

SpyM30102 contains an amino acid motif indicative of a cell wall anchor: SEQ ID NO:185 LPLAG (shown in italics in SEQ ID NO:61, above). In some recombinant host cell systems, it may be preferable to remove this motif to facilitate secretion of a recombinant SpyM30102 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in SpyM30102. The pilin motif sequence is underlined in SEQ ID NO:61, below. The conserved lysine (K) residue is also marked in bold, at amino acid residue 132. The pilin sequence, in particular the conserved lysine residues, are thought to be important for the formation of oligomeric, pilus-like structures. Preferred fragments of SpyM30102 include the conserved lysine residue. Preferably, fragments include the pilin sequence.

SEQ ID NO: 61

MILTMLAFNQTVLAKDSTVQTSISVENVLERAGDSTPFSIALESIDA

MKTIEEITIAGSGKASFSPLTFTTVGQYTYRVYQKPSQNKDYQADTT

VFDVLVYVTYDEDGTLVAKVISRRAGDEEKSAITFKPKWLVKPIPPR

QPNIPKTPLPLAGEVKSLLGILSIVLLGLLVLLYVKKLKSRL

Two E boxes containing conserved glutamic residues have been identified in SpyM30102. The E-box motifs are underlined in SEQ ID NO:61, below. The conserved glutamic acid (E) residues, at amino acid residues 52 and 122, are marked in bold. The E box motifs, in particular the conserved glutamic acid residues, are thought to be important for the formation of oligomeric pilus-like structures of SpyM30102. Preferred fragments of SpyM30102 include at least one conserved lysine residue. Preferably, fragments include at least one pilin sequence.

SEQ ID NO: 61

MILTMLAFNQTVLAKDSTVQTSISVENVLERAGDSTPFSIALESIDA

MKTIEEITIAGSGKASFSPLTFTTVGQYTYRVYQKPSQNKDYQASTT

VFDVLVYVTYDEDGTLVAKVISRRAGDEEKSAITFKPKWLVKPIPPR

QPNIPKTPLPLAGEVKSLLGILSIVLLGLLVLLYVKKLKSRL

SpyM30103 is referred to as a putative multiple sugar metabolism regulator. An example of an amino acid sequence for SpyM3103 is set forth in SEQ ID NO:62.

SEQ ID NO: 62

MVRFDLKHVQTLHSLSQLPISVMSQDKALIQVYGNDDYLLCYYQFLK

HLAIPQAAQDVIFYEGLFEESFMIFPLCHYIIAIGPGYPYSLNKDYQ

EQLANNCLKHSSHRSKEELLSYMALVPHFPINNVRNLLIAIDAFFDT

QFETTCQQTIHQLLQHSKQMTADPDIIHRLKHISKASSQLPPVLEHL

NHTMDLVKLGNPQLLKQETNRIPLSSITSSSISALRAEKNLTVIYLT

RLLEFSFVENTDVAKHYSLVKYYMALNEEASDLLKVLRIRCAAIIHF

SESLTNKSISDKRQMYNSVLHYVDSHLYSKLKVSDIAKRLYVSESHL

RSVFKKYSNVSLQHYILSTKIKEAQLLLKRGIPVGEVAKSLYFYDTT

HFHKIFKKYTGISSKDYLAKYRDNI

SpyM30104 is thought to be a F2 like fibronectic binding protein. An example of an amino acid sequence for SpyM30104 is set forth in SEQ ID NO:63

SEQ ID NO: 63

MSSSDEETLKQYASKYTSNRRGDTSGNLKKQIAKVLTEGYPTNKSDW

LNGLTENEKIEVTQDAIWYFTETTVPADRSYTNRNVNSQKMKEVYQK

LIDTTDIDKYEDVQFDLFVPQDTNLQAVISVEPVIESLPWTSLKPIA

QKDITAKKIWVDAPKEKPIIYFKLYRQLPGEKEVAVDDAELKQINSE

GQQEISVTWTNQLVTDEKGMAYIYSVKEVDKNGELLEPKDYIKKEDG

LTVTNTYVKPTSGHYDIEVTFGNGHIDITEDTTPDIVSGENQMKQIE

GEDSKPIDEVTENNLIEFGKNTMPGEEDGTNSNKYEEVEDSRPVDTL

SGLSSEQGQSGDMTIEEDSATHIKFSKRDIDGKELAGATMELRDSSG

KTISTWISDGQVKDFYLMPGKYTFVETAAPDGYEVATAITFTVNEQG

QVTVNGKATKGDAHIVMVDAYKPTKGSGQVIDIEEKLPDEQGHSGST

TEIEDSKSSDVIIGGQGEVVDTTEDTQSGMTGHSGSTTEIEDSKSSD

VIIGGQGEVVDTTEDTQSGMTGHSGSTTKIEDSKSSDVIVGGQGQIV

ETTEDTQTGMHGDSGRKTEVEDTKLVQSFHFDNKEPESNSEIPKKDK

SKSNTS*LPATG*EKQHNKFFWMVTSCSLISSVFVISLKSKKRLSSC

SpyM30104 contains an amino acid motif indicative of a cell wall anchor: SEQ ID NO:180 LPATG (shown in italics in SEQ ID NO:63, above). In some recombinant host cell systems, it may be preferable to remove this motif to facilitate secretion of a recombinant SpyM30104 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

Two pilin motifs, discussed above, containing conserved lysine (K) residues have also been identified in SpyM30104. The pilin motif sequences are underlined in SEQ ID NO:63, below. Conserved lysine (K) residues are also marked in bold, at amino acid residues 156 and 227. The pilin sequences, in particular the conserved lysine residues, are thought to be important for the formation of oligomeric, pilus-like structures. Preferred fragments of SpyM30104 include at least one conserved lysine residue. Preferably, fragments include at least one pilin sequence.

SEQ ID NO: 63

MSSSDEETLKQYASKYTSNRRGDTSGNLKKQIAKVLTEGYPTNKSDW

LNGLTENEKIEVTQDAIWYFTETTVPADRSYTNRNVNSQKMKEVYQK

LIDTTDIDKYEDVQFDLFVPQDTNLQAVISVEPVIESLPWTSLKPIA

QKDITAKKIWVDAPKEKPIIYFKLYRQLPGEKEVAVDDAELKQINSE

GQQEISVTWTNQLVTDEKGMAYIYSVKEVDKNGELLEPKDYIKKEDG

LTVTNTYVKPTSGHYDIEVTFGNGHIDITEDTTPDIVSGENQMKQIE

GEDSKPIDEVTENNLIEFGKNTMPGEEDGTNSNKYEEVEDSRPVDTL

SGLSSEQGQSGDMTIEEDSATHIKFSKRDIDGKELAGATMELRDSSG

-continued

KTISTWISDGQVKDFYLMPGKYTFVETAAPDGYEVATAITFTVNEQG

QVTVNGKATKGDAHIVMVDAYKPTKGSGQVIDIEEKLPDEQGHSGST

TEIEDSKSSDVIIGGQGEVVDTTEDTQSGMTGHSGSTTEIEDSKSSD

VIIGGQGEVVDTTEDTQSGMTGHSGSTTKIEDSKSSDVIVGGQGQIV

ETTEDTQTGMHGDSGRKTEVEDTKLVQSFHFDNKEPESNSEIPKKDK

SKSNTSLPATGEKQHNKFFWMVTSCSLISSVFVISLKSKKRLSSC

An E box containing a conserved glutamic residue has been identified in SpyM30104. The E-box motif is underlined in SEQ ID NO:63, below. The conserved glutamic acid (E), at amino acid residue 402, is marked in bold. The E box motif, in particular the conserved glutamic acid residue, is thought to be important for the formation of oligomeric pilus-like structures of SpyM30104. Preferred fragments of SpyM30104 include the conserved glutamic acid residue. Preferably, fragments include the E box motif

SEQ ID NO: 63

MSSSDEETLKQYASKYTSNRRGDTSGNLKKQIAKVLTEGYPTNKSDW

LNGLTENEKIEVTQDAIWYFTETTVPADRSYTNRNVNSQKMKEVYQK

LIDTTDIDKYEDVQFDLFVPQDTNLQAVISVEPVIESLPWTSLKPIA

QKDITAKKIWVDAPKEKPIIYFKLYRQLPGEKEVAVDDAELKQINSE

GQQEISVTWTNQLVTDEKGMAYIYSVKEVDKNGELLEPKDYIKKEDG

LTVTNTYVKPTSGHYDIEVTFGNGHIDITEDTTPDIVSGENQMKQIE

GEDSKPIDEVTENNLIEFGKNTMPGEEDGTNSNKYEEVEDSRPVDTL

SGLSSEQGQSGDMTIEEDSATHIKFSKRDIDGKELAGATMELRDSSG

KTISTWISDGQVKDFYLMPGKYTFVETAAPDGYEVATAITFTVNEQG

QVTVNGKATKGDAHIVMVDAYKPTKGSGQVIDTEEKLPDEQGHSGST

TEIEDSKSSDVIIGGQGEVVDTTEDTQSGMTGHSGSTTEIEDSKSSD

VIIGGQGEVVDTTEDTQSGMTGHSGSTTKIEDSKSSDVIVGGQGQIV

ETTEDTQTGMHGDSGRKTEVEDTKLVQSFHFDNKEPESNSEIPKKDK

SKSNTSLPATGEKQHNKFFWMVTSCSLISSVFVISLKSKKRLSSC

Examples of GAS AI-sequences from M3 strain isolate SSI-1 are set forth below.

Sps0099 is a negative transcriptional regulator (Nra). An example of an amino acid sequence for Sps0099 is set forth in SEQ ID NO:64.

SEQ ID NO: 64

MPYVKKKKDSPLVETYLEQSIRDKSELVLLLFKSPTIIFSHVAKQTG

LTAVQLKYYCKELDDFFGNNLDITIKKGKIICCFVKPVKEFYLHQLY

DTSTILKLLVFFIKNGTSSQPLIKFSKKYFLSSSSAYRLRESLIKLL

REFGLRVSKNTIVGEEYRIRYLIAMLYSKFGIVIYPLDHLDNQIIYR

FLSQSATNLRTSPWLEEPFSFYNMLLALSWKRHQFAVSIPQTRIFRQ

LKKLFIYDCLTRSSRQVIENAFSLTESQGDLEYLFLIYITTNNSFAS

LQWTPQHIETCCHIFEKNDTFRLLLEPILKRLPQLNHSKQDLIKALM

YFSKSFLFNLQHFVIEIPSFSLPTYTGNSNLYKALKNIVNQWLAQLP

GKRHLNEKHLQLFCSHIEQILKNKQPALTVVLTSSNFINAKLLTDTI

-continued

PRYFSDKGIHFYSFYLLRDDIYQIPSLKPDLVTTHSRLIPFVKNDLV

KGVTVAEFSFDNPDYSIASIQNLIYQLKDKKYQDFLNEQLQ

Sps0100 is thought to be a collagen binding protein (Cbp). It contains a sortase substrate motif VPXTG shown in italics in SEQ ID NO:65.

SEQ ID NO: 65

MQKRDKTNYGSANNKRRQTTIGLLKVFLTFVALIGIVGFSIRAFGAE

EQSVPNKQSSVQDYPWYGYDSYSKGYPDYSPLKTYHNLKVNLDGSKE

YQAYCFNLTKHFPSKSDSVRSQWYKKLEGTNENFIKLADKPRIEDGQ

LQQNILRILYNGYPNDRNGIMKGIDPLNAILVTQNAIWYYTDSSYIS

DTSKAFQQEETDLKLDSQQLQLMRNALKRLINPKEVESLPNQVPANY

QLSIFQSSDKTFQNLLSAEYVPDTPPKPGEEPPAKTEKTSVIIRKYA

EGDYSKLLEGATLKLAQIEGSGFQEKIFDSNKSGEKVELPNGTYVLS

ELKPPQGYGVATPITFKVAAEKVLIKNKEGQFVENQNKETAEPYSVT

AFNDFEEIGYLSDFNNYGKFYYAKNTNGTNQVVYCFNADLHSPPDSY

DHGANIDPDVSESKEIKYTHVSGYDLYKYAATPRDKDADFFLKHIKK

ILDKGYKKKGDTYKTLTEAQFRAATQLAIYYYTDSADLTTLKTYNDN

KGYHGFDKLDDATLAVVHELITYAEDVTLPMTQNLDFFVPNSSRYQA

LIGTQYHPNELIDVISMEDKQAPIIPITHKLTISKTVTGTIADKKKE

FNFEIHLKSSDGQAISGTYPTNSGELTVTDGKATFTLKDGESLIVEG

LPSGYSYEITETGASDYEVSVNGKNAPDGKATKASVKEDETVAFENR

KDL*VPPTG*LTTDGAIYLWLLLLVPFGLLVWLFGRKGTKK

Sps0101 is referred to as a LepA protein. An example of an amino acid sequence of Sps0101 is set forth as SEQ ID NO:66

SEQ ID NO: 66

MTNYLNRLNENPLLKAFIRLVLKISIIGFLGYILFQYVFGVMIVNTN

QMSPAVSAGDGVLYYRLTDRYHINDVVVYEVDDTLKVGRIAAQAGDE

VNFTQEGGLLINGHPPEKEVPYLTYPHSSGPNFPYKVPTGTYFILND

YREERLDSRYYGALPINQIKGKISTLLRVRGI

Sps0102 is thought to be a fimbrial protein. It contains a sortase substrate motif QVXTG shown in italics in SEQ ID NO:67.

SEQ ID NO: 67

MEREKMKKNKLLLATAILATALGTASLNQNVKAETAGVSENAKLIV

KKTFDSYTDNEVLMPKADYTFKVEADSTASGKTKDGLEIKPGIVNG

LTEQIISYTNTDKPDSKVKSTEFDFSKVVFPGIGVYRYTVSEKQGD

VEGITYDTKKWTVDVYVGNKEGGGFEPKFIVSKEQGTDVKKPVNEN

NSFATTSLKVKKNVSGNTGELQKEFDFTLTLNESTNEKKDQIVSLQ

KGNEKFEVKIGTPYKFKLKNGESIQLDKLPVGITYKVNEMEANKDG

YKTTASLKEGDGQSKMYQLDMEQKTDESADEIVVTNKRDTQVPTGV

VGTLAPFAVLSIVAIGGVIYITKRKKA

Sps0103 is a SrtC2 type sortase. An example of Sps0103 is set forth in SEQ ID NO:68.

SEQ ID NO: 68

MVMTIVQVINKATDTLILTFGLVVLFLAGFGLWDSYHLYQQADASN

FKKFKTAQQQPKFEDLLALNEDVIGWLNIPGTHIDYPLVQGKTNLE

YINKAVDGSVAMSGSLFLDTRNHNDFTDDYSLTYGHHMAGNAMFGE

IPKFLKKDFFSKHNKAIIETKERKKLTVTIFACLKTDAFNQLVFNP

NAITNQDQQRQLVDYISKRSKQFKPVKLKHHTKFVAFSTCENFSTD

NRVTVVGTIQE

Sps0104 is referred to as a hypothetical protein. It contains a sortase substrate motif LPXAG shown in italics in SEQ ID NO:69.

TABLE-US-001

SEQ ID NO: 69

MLFSVVMILTMLAFNQTVLAKDSTVQTSISVENVLERAGDSTPFST

ALESIDAMKTIEEITIAGSGKASFSPLTFTTVGQYTYRVYQKPSQN

KDYQADTTVFDVLVYVTYDEDGTLVAKVISRRAGDEEKSAITFKPK

WLVKPIPPRQPNIPKTPLPLAGEVKSLLGILSIVLLGLLVLLYVKK

LKSRL

Sps0105 is referred to as a putative multiple sugar metabolism regulator. An example of Sps0105 is set forth in SEQ ID NO:70.

SEQ ID NO: 70

MALVPHFPINNVRNLLIAIDAFFDTQFETTCQQTIHQLLQHSKQMT

ADPDITHRLKHISKASSQLPPVLEHLNHIMDLVKLGNPQLLKQEIN

RIPLSSITSSSISALRAEKNLTVIYLTRLLEPSEVENTDVAKHYSL

VKYYMALNEEASDLLKVLRIRCAAIIHESESLINKSISDKRQMYNS

VLHYVDSHLYSKLKVSDIAKRLYVSESHLRSVEKKYSNVSLQHYTL

STKIKEAQLLLKRGIPVGEVAKSLYFYDTTHFHKIFKKYTGISSKD

YLAKYRDNI

Sps0106 is thought to be a F2 like fibronectic binding protein. It contains a sortase substrate LPXTG (SEQ ID NO:122) shown in italics in SEQ ID NO:71.

SEQ ID NO: 71

MTQKNSYKLSELLSLTGFILGLLLVFIGLSGVSVGHAETRNGANKQ

GAFEIKKNKSQEEYNYEVYDNRNILQDGEHKLEIKRVDGTGKTYQG

FCFQLTKNEPTAQGVSKKLYKKLSSSDEETLKQYASKYTSNRRGDT

SGNLKKQTAKVLTEGYPTNKSDWLNGLTENEKIEVTQDATWYFTET

TVPADRSYTNRNVNSQKMKEVYQKLIDTTDIDKYEDVQFDLFVPQD

TNLQAVISVEPVIESLPWTSLKPIAQKDITAKKIWVDAPKEKPTIY

EKLYRQLPGEKEVAVDDAELKQTNSEGQQEISVTWTNQLVTDEKGM

AYIYSVKEVDKNGELLEPKDYIKKEDGLTVTNTYVKPTSGHYDIEV

TFGNGHIDITEDTTPDIVSGENQMKQIEGEDSKPIDEVTENNLIEF

GKNTMPGEEDGTNSNKYEEVEDSRPVDTLSGLSSEQGQSGDMTTEE

DSATHIKESKRDIDGKELAGATMELRDSSGKTISTWISDGQVKDFY

-continued

```
LMPGKYTEVETAAPDGYEVATAITFTVNEQGQVTVNGKATKGDAHI

VMVDAYKPTKGSGQVIDIEEKLPDEQGHSGSTTEIEDSKSSDVIIG

GQGEVVDTTEDTQSGMTGHSGSTTKIEDSKSSDVIVGGQGQIVETT

EDTQTGMHGDSGRKTEVEDTKLVQSFHFDNKEPESNSEIPKKDKSK

SNTSLPATGEKQHNKFFWMVTSCSLISSVEVISLKSKKRLSSC
```

Examples of GAS AI-sequences from M5 isolate Manfredo are set forth below. Orf 77 encodes a negative transcription regulator (Nra). An example of the nucleotide sequence encoding Nra (SEQ ID NO:88) and an Nra amino acid sequence (SEQ ID NO:89) are set forth below.

```
                                              SEQ ID NO: 88
ATGCCTTATGTCAAAAAGAAAAAGGATAGTTTCTTAGTAGAAACAT
ATCTTGAACAGTCTATTAGAGATAAAAGTGAATTAGTCTTACTGTT
ATTTAAATCGCCTACTATCATTTTTTCTCATGTTGCTAAACAAACT
GGTCTGACGGCTGTACAATTAAAATATTACTGTAAAGAACTTGATG
ACTTTTTTGGAAATAATTTAGACATTACCATTAAAAAGGGCAAAAT
AATATGTTGTTTTGTCAAACCTGTTAAGGAATTCTACCTTCATCAA
CTCTATGACACATCAACAATATTAAAATTATTAGTTTTCTTTATTA
AAAATGGAACGTCATCACAACCTCTGATTAAATTTTCAAAAAAGTA
TTTTCTATCAAGCTCCTCAGCTTATCGACTACGGGAATCGCTGATC
AAATTACTACGGGAATTTGGCTTGAGAGTCTCAAAAAATACAATTG
TCGGAGAGGAATATCGTATTCGCTATCTTATTGCCATGCTATATAG
TAAATTTGGCATTGTCATCTATCCGTTAGATCATCTAGACAATCAA
ATTATTTATCGCTTCTTATCACAAAGTGCAACCAATTTAAGAACAT
CGCCCTGGCTAGAGGAACCTTTTTCTTTTTATAATATGTTACTTGC
CTTGTCATGGAAACGTCACCAATTTGCAGTTAGCATTCCTCAAACA
CGTATTTTTCGACAATTAAAAAAGCTTTTTATCTATGATTGTTTAA
CTCGAAGCAGTCGACAAGTAATCGAAAATGCTTTTTCGTTAATGTT
CTCACAAGGAGATCTCGATTATCTTTTTTTAATTTATATTACCACC
AATAATTCCTTTGCCAGCCTACAATGGACTCCACAGCATATTGAAA
CTTGCTGCCATATTTTTGAAAAAAATGACACATTTCGGTTATTGTT
AGAGCCCATTCTTAAACGTTTACCGCAATTAAACCATTCTAAACAA
GACCTTATTAAAGCCCTTATGTATTTTTCAAAATCTTTTCTATTTA
ACCTCCAACATTTCGTCATCGAGATTCCTTCTTTTTCCTTGCCGAC
CTATACAGGCAACTCTAATCTTTACAAAGCTTTAAAAAATATTGTA
AATCAGTGGCTTGCTCAATTACCCGGAAAGCGTCATCTTAACGAAA
AGCATCTCCAACTTTTTTGCTCTCATATTGAACAAATCTTAAAAAA
TAAACAACCTGCTTTAACTGTCGTTTTAATATCTAGTAACTTTATA
AATGCTAAACTCCTTACAGATACTATCCCACGATATTTTTCTGATA
AAGGAATTCATTTTTATTCTTTTTACTTATTAAGAGATGATATCTA
TCAAATTCCAAGCTTAAAACCAGATTTAGTTATCACTCATAGCCGA
TTAATTCCTTTTGTTAAGAATGATCTGGTCAAAGGTGTTACTGTTG
CTGAATTTTCTTTTGATAACCCTGACTACTCTATTGCTTCAATTCA
AAACTTGATATATCAGCTCAAAGATAAAAAATATCAAGATTTTCTA
AACGAGCAATTACAA
```

```
                                              SEQ ID NO: 89
MPYVKKKKDSFLVETYLEQSIRDKSELVLLLFKSPTIIFSHVAKQT
GLTAVQLKYYGKELDDFPGNNLDITIKKGKIICCFVKPVKEFYLHQ
LYDTSTILKLLVFFIKNGTSSQPLIKFSKKYFLSSSSAYRLRESLI
KLLREFGLRVSKNTIVGEEYRIRYLIAMLYSKFGIVIYPLDHLDNQ
IIYRFLSQSATNLRTSPWLEEPFSFYNMLLALSWKRHQFAVSIPQT
RIFRQLKKLFIYDCLTRSSRQVIENAFSLMFSQGDLDYLFLIYITT
NNSFASLQWTPQHIETCCHIFEKNDTFRLLLEPILKRLPQLNHSKQ
DLIKALMYFSKSFLFNLQHFVIEIPSFSLPTYTGNSNLYKALKNIV
NQWLAQLPGKRHLNEKHLQLFCSHIEQILKNKQPALTVVLISSNFI
NAKLLTDTIPRYFSDKGIHFYSEYLLRDDIYQIPSLKPDLVITHSR
LIPFVKNDLVKGVTVAEFSFDNPDYSIASIQNLIYQLKDKKYQDFL
NEQLQ
```

Orf78 is thought to be a collagen binding protein (Cbp). An example of the nucleotide sequence encoding Cbp (SEQ ID NO:90) and a Cbp amino acid sequence (SEQ ID NO:91) are set forth below.

```
                                              SEQ ID NO: 90
TTGCAAAAGAGGGATAAAACCAATTATGGAAGCGCTAACAACAAAC
GACGACAAACGACGATCGGATTACTGAAAGTATTTTTGACGTTTGT
AGCTCTGATAGGAATAGTAGGGTTTTCTATCAGAGCGTTCGGAGCT
```

-continued

```
GAAGAAAAATCTACTGAAACTAAAAAAACGTCAGTCATTATTAGAA
AATATGCTGAAGGTGACTACTCTAAACTTCTAGAGGGAGCAACTTT
GCGTTTAACAGGGGAAGATATCCCAGATTTTCAAGAAAAAGTCTTC
CAAAGTAATGAACAGGAGAAAAAGATTGAATTATCAAATGGGACTT
ATACCTTAACAGAAACATCATCTCCAGATGGATATAAAATTACGGA
GCCGATTAAGTTTAGAGTAGTGAATAAAAAAGTATTTATCGTCCAA
AAAGATGGTTCTCAAGTGGAAAACCCAAACAAAGAACTAGGTTCTC
CATATACTATAGAGGCATACAATGATTTTGATGAATTTGGCTTACT
GTCAACACAAAATTATGCGAAATTTTATTATGGAAAAAACTATGAT
GGCAGTTCACAAATTGTTTATTGCTTCAATGCCAACTTGAAATCTC
CACCTGACTCGGAAGATCATGGTGCTACAATAAATCCTGACTTTAC
GACTGGTGATATTAGGTACAGTCATATTGCTGGTTCAGATTTGATA
AAATACGCTAATACAGCTAGGGATGAAGATCCTCAATTATTTTTAA
AACACGTAAAAAAAGTAATTGAAAATGGGTATCATAAAAAAGGTCA
AGCTATTCCATATAACGGTCTGACTGAGGCACAGTTTCGTGCGGCT
ACTCAACTGGCAATTTATTATTTTACAGATAGTGTTGACTTAACTA
AGGATAGATTGAAAGACTTCCATGGATTTGGAGATATGAATGATCA
AACTTTGGGTGTAGCTAAAAAAATTGTAGAATACGCTTTGAGTGAT
GAAGATTCAAAACTAACAAATCTTGATTTCTTCGTACCTAATAATA
GCAAATACCAATCTCTTATTGGGACAGAATACCATCCAGATGATTT
GGTTGACGTGATTCGTATGGAAGATAAAAAGCAAGAAGTTATTCCA
GTAACTCATAGTTTGACGGTGCAAAAAACAGTAGTCGGTGAGTTGG
GAGATAAGACTAAAGGCTTTCAATTTGAACTTGAGTTGAAAGATAA
AACTGGACAGCCTATTGTTAACACTCTAAAAACTAATAATCAAGAT
TTAGTAGCTAAAGATGGGAAATATTCATTTAATCTAAAGCATGGTG
ACACCATAAGAATAGAAGGATTACCGACGGGATATTCTTATACCCT
GAAAGAGACTGAAGCTAAGGATTATATAGTAACTGTTGATAACAAA
GTTAGTCAAGAAGCTCAATCAGCAAGTGAGAATGTCACAGCAGACA
AAGAAGTCACTTTTGAAAACCGAAAAGATCTTGTCCCACCAACTGG
TTTGACAACAGATGGGGCTATCTATCTTTGGTTATTACTACTTGTT
CCATTTGGGTTATTGGTTTGGCTATTTGGTCGTAAAGGGTTAAAAA
ATGAC
```

```
                                              SEQ ID NO: 91
MQKRDKTNYGSANNKRRQTTIGLLKVFLTFVALIGIVGFSIRAFGA
EEKSTETKKTSVIIRKYAEGDYSKLLEGATLRLTGEDIPDFQEKVF
QSNGTGEKIELSNGTYTLTETSSPDGYKITEPEKERVVNKKVFIVQ
KDGSQVENPNKELGSPYTIEAYNDFDEFGLLSTQNYAKFYYGKNYD
GSSQIVYCFNANLKSPPDSEDHGATINPDFTTGDIRYSHIAGSDLI
KYANTARDEDPQLFLKHVKKVIENGYHKKGQATPYNGLTEAQFRAA
TQLAIYYETDSVDLTKDRLKDPHGFGDMNDQTLGVAKKIVEYALSD
EDSKLTNLDFFVPNNSKYQSLIGTEYHPDDLVDVIRMEDKKQEVTP
VTHSLTVQKTVVGELGDKTKGFQFELELKDKTGQPIVNTLKTNNQD
LVAKDGKYSFNLKHGDTIRIEGLPTGYSYTLKETEAKDYIVTVDNK
VSQEAQSASENVTADKEVTFENRKDLVPPTGLTTDGAIYLWLLLLV
PFGLLVWLFGRKGLKND
```

Orf78 contains an amino acid motif indicative of a cell wall anchor: SEQ ID NO:184 VPPTG (shown in italics in SEQ ID NO:91, above). In some recombinant host cell systems, it may be preferable to remove this motif to facilitate secretion of a recombinant Orf 78 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

Three E boxes containing conserved glutamic residues have been identified in Orf 78. The E-box motifs are underlined in SEQ ID NO:91, below. The conserved glutamic acid (E) residues, at amino acid residues 112, 395, and 447, are marked in bold. The E box motifs, in particular the conserved glutamic acid residues, are thought to be important for the formation of oligomeric pilus-like structures of Orf 78. Preferred fragments of Orf 78 include at least one conserved glutamic acid residue. Preferably, fragments include at least one E box motif

```
                                              SEQ ID NO: 91
MQKRDKTNYGSANNKRRQTTIGLLKVFLTFVALIGIVGFSIRAFGA

EEKSTETKKTSVIIRKYAEGDYSKLLEGATLRLTGEDIPDFQEKVF
```

-continued

```
QSNGTGEKIELSNGTYTLTETSSPDGYKITEPIKFRVVNKKVFIVQ

KDGSQVENPNKELGSPYTIEAYNDFDEFGLLSTQNYAKFYYGKNYD

GSSQIVYCFNANLKSPPDSEDHGATINPDFTTGDIRYSHIAGSDLI

KYANTARDEDPQLFLKHVKKVIENGYHKKGQAIPYNGLTEAQFRAA

TQLAIYYFTDSVDLTKDRLKDFHGFGDMNDQTLGVAKKIVEYALSD

EDSKLTNLDFFVPNNSKYQSLIGTEYHPDDLVDVIRMEDKKQEVIP

VTHSLTVQKTVVGELGDKTKGFQFELELKDKTGQPIVNTLKTNNQD

LVAKDGKYSFNLKHGDTIRIEGLPTGYSYTLKETEAKDYIVTVDNK

VSQEAQSASENVTADKEVTFENRKDLVPPTGLTTDGAIYLWLLLLV

PFGLLVWLFGRKGLKND
```

Orf 79 is thought to be a LepA signal peptidase I. An example of the nucleotide sequence encoding a LepA signal peptidase I (SEQ ID NO:92) and a LepA signal peptidase I amino acid sequence (SEQ ID NO:93) are set forth below.

```
                                     SEQ ID NO: 92
ATGACTAATTACCTAAATCGTTTAAATGAGAATTCACTATTTAAA
GCTTTCATACGGTTAGTACTTAAGATTTCTATTATTGGGTTTCTA
GGTTACATTCTATTTCAGTATGTTTTTGGTGTTATGATTATTAAC
ACTAATGATATGAGTCCTGCTTTAAGTGCAGGTGACGGTGTTTTA
TATTATCGTTTGACTGATCGCTATCATATTAATGATGTGGTGGTC
TATGAGGTTGATAACACTTTGAAAGTTGGTCGAATTGTCGCTCAA
GCTGGCGATGAGGTTAGTTTTACGCAAGAAGGAGGACTGTTGATT
AATGGGCATCCACCAGAAAAAGAGGTCCCTTACCTGACGTATCCT
CACTCAAGTGGCCCAAACTTTCCCTATAAAGTTCCTACGGGTAAG
TATTTCATATTGAATGATTATCGTGAAGAACGTTTGGACAGTCGT
TATTATGGGGCGTTACCCGTCAATCAAATAAAAGGGAAAATCTCA
ACTCTATTAAGAGTGAGAGGAATT
```

```
                                     SEQ ID NO: 93
MTNYLNRLNENSLFKAFIRLVLKISIIGELGYTLFQYVEGVMIIN
TNDMSPALSAGDGVLYYRLTDRYHINDVVVYEVDNTLKVGRTVAQ
AGDEVSFTQEGGLLINGHPPEKEVPYLTYPHSSGPNFPYKTPTGK
YFILNDYREERLDSRYYGALPVNQIKGKISTLLRVRGI
```

Orf 80 is thought to be a fimbrial protein. An example of the nucleotide sequence encoding the fimbrial protein (SEQ ID NO:94) and a fimbrial protein amino acid sequence (SEQ ID NO:95) are set forth below.

```
                                     SEQ ID NO: 94
TTGGAGAGAGAAAAAATGAAAAAAAACAAATTATTACTTGCTACT
GCAATCTTAGCAACTGCTTTAGGAACAGCTTCTTTAAATCAAAAC
GTAAAAGCTGAGACGGCAGGGGTTGTAACAGGAAAATCACTACAA
GTTACAAAGACAATGACTTATGATGATGAAGAGGTGTTAATGCCC
GAAACCGCCTTTACTTTTACTATAGAGCCTGATATGACTGCAAGT
GGAAAAGAAGGCAGCCTAGATATTAAAAATGGAATTGTAGAAGGC
TTAGACAAACAAGTAACAGTAAAATATAAGAATACAGATAAAACA
TCTCAAAAAACTAAAATAGCACAATTTGATTTTTCTAAGGTTAAA
TTTCCAGCTATAGGTGTTTACCGCTATATGGTTTCAGAGAAAAAC
GATAAAAAAGACGGAATTACGTACGATGATAAAAAGTGGACTGTA
GATGTTTATGTTGGGAATAAGGCCAATAACGAAGAAGGTTTCGAA
GTTCTATATATTGTATCAAAAGAAGGTACTTCTAGTACTAAAAAA
CCAATTGAATTTACAAACTCTATTAAAACTACTTCCTTAAAAATT
GAAAAACAAATAACTGGCAATGCAGGAGATCGTAAAAAATCATTC
AACTTCACATTAACATTACAACCAAGTGAATATTATAAAACTGGA
TCAGTTGTGAAAATCGAACAGGATGGAAGTAAAAAAGATGTGACG
ATAGGAACGCCTTACAAATTTACTTTGGGACACGGTAAGAGTGTC
ATGTTATCGAAATTACCAATTGGTATCAATTACTATCTTAGTGAA
GACGAAGCGAATAAAGACGGCTACACTACAACGGCAACATTAAAA
GAACAAGGCAAAGAAAAGAGTTCCGATTTCACTTTGAGTACTCAA
AACCAGAAAACAGACGAATCTGCTGACGAAATCGTTGTCACAAAT
AAGCGTGACACTCAAGTTCCAACTGGTGTTGTAGGGACCCTTGCT
CCATTTGCAGTTCTTAGCATTGTGGCTATTGGTGGAGTTATCTAT
ATTACAAAACGTAAAAAAGCT
```

```
                                     SEQ ID NO: 95
MEREKMKKNKLLLATAILATALGTASLNQNVKAETAGVVTGKSLQ
VTKTMTYDDEEVLMPETAFTPTIEPDMTASGKEGSLDIKNGIVEG
LDKQVTVKYKNTDKTSQKTKIAQFDFSKVKFPAIGVYRYMVSEKN
DKKDGITYDDKKWTVDVYVGNKANNEEGPEVLYIVSKEGTSSTKK
PIEFTNSIKTTSLKIEKQITGNAGDRKKSFNFTLTLQPSEYYKTG
SVVKIEQDGSKKDVTIGTPYKFTLGHGKSVMLSKLPIGINYYLSE
DEANKDGYTTTATLKEQGKEKSSDFTLSTQNQKTDESADEIVVIN
KRDTQVPTGVVGTLAPFAVLSIVAIGGVIYITKRKKA
```

Orf 82 contains an amino acid motif indicative of a cell wall anchor: SEQ ID NO:140 QVPTG (shown in italics in SEQ ID NO:95, above). In some recombinant host cell systems, it may be preferable to remove this motif to facilitate secretion of a recombinant Orf 82 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

An E box containing a conserved glutamic residue has been identified in Orf 80. The E-box motif is underlined in SEQ ID NO:95, below. The conserved glutamic acid (E), at amino acid residue 270, is marked in bold. The E box motif, in particular the conserved glutamic acid residue, is thought to be important for the formation of oligomeric pilus-like structures of Orf 80. Preferred fragments of Orf 80 include at least one conserved glutamic acid residue. Preferably, fragments include at least one E box motif.

```
                                     SEQ ID NO: 95
MEREKMKKNKLLLATAILATALGTASLNQNVKAETAGVVTGKSLQ

VTKTMTYDDEEVLMPETAFTFTIEPDMTASGKEGSLDIKNGIVEG

LDKQVTVKYKNTDKTSQKTKIAQFDFSKVKFPAIGVYRYMVSEKN

DKKDGITYDDKKWTVDVYVGNKANNEEGFEVLYIVSKEGTSSTKK

PIEFTNSIKTTSLKIEKQITGNAGDRKKSFNFTLTLQPSEYYKTG

SVVKIEQDGSKKDVTIGTPYKFTLGHGKSVMLSKLPIGINYYLSE

DEANKDGYTTTATLKEQGKEKSSDFTLSTQNQKTDESADEIVVTN

KRDTQVPTGVVGTLAPFAVLSIVAIGGVIYITKRKKA
```

Orf 81 is thought to be a SrtC2 type sortase. An example of the nucleotide sequence encoding the SrtC2 sortase (SEQ ID NO:96) and a SrtC2 sortase amino acid sequence (SEQ ID NO:97) are set forth below.

```
                                     SEQ ID NO: 96
GTGATTAGTCAAAGAATGATGATGACAATTGTACAGGTTATCAATA
AAGCCATTGATACTCTCATTCTTATCTTTTGTTAGTCGTACTATT
TTTAGCTGGTTTTGGTTTGTGGGATTCTTATCATCTCTATCAACAA
GCAGACGCTTCTAATTTCAAAAAATTTAAAACAGCTCAACAACAGC
CTAAATTTGAAGACTTGTTAGCTTTGAATGAGGATGTCATTGGTTG
GTTAAATATCCCAGGGACTCATATTGATTATCCTCTAGTTCAGGGA
AAAACGAATTTAGAGTATATTAATAAAGCAGTTGATGGCAGTGTTG
CCATGTCTGGTAGTTTATTTTTAGATACACGGAATCATAATGATTT
TACGGACGATTACTCTCTGATTTATGGCCATCATATGGCAGGTAAT
GCCATGTTTGGCGAAATTCCAAAATTTTTAAAAAAGGATTTTTTCA
ACAAACATAATAAAGCTATCATTGAAACAAAAGAGAGAAAAAAACT
AACCGTCACTATTTTTGCTTGTCTCAAGACAGATGCCTTTGACCAG
TTAGTTTTTAATCCTAATGCTATTACCAATCAAGACCAACAAAAGC
AGCTCGTTGATTATATCAGTAAAAGATCAAAACAATTTAAACCTGT
TAAATTGAAGCATCATACAAAGTTCGTTGCTTTTTCAACGTGTGAA
AATTTTTCTACTGACAATCGTGTTATCGTTGTCGGTACTATTCAAG
AA
```

-continued

SEQ ID NO: 97

MISQRMMMTIVQVINKAIDTLILIFCLVVLFLAGFGLWDSYHLYQQ
ADASNFKKFKTAQQQPKFEDLLALNEDVIGWLNIPGTHIDYPLVQG
KTNLEYINKAVDGSVAMSGSLFLDTRNHNDFTDDYSLIYGHHMAGN
AMFGEIPKFLKKDFFNKHNKATIETKERKKLTVTIFACLKTDAFDQ
LVFNPNAITNQDQQKQLVDYISKRSKQFKPVKLKHHTKFVAFSTCE
NFSTDNRVIVVGTIQE

Orf 82 is referred to as a hypothetical protein. It contains a sortase substrate motif LPXAG shown in italics in SEQ ID NO:99. An example of the nucleotide sequence encoding the hypothetical protein (SEQ ID NO:98) and a hypothetical protein amino acid sequence (SEQ ID NO:99) are set forth below.

SEQ ID NO: 98

TTGCTTTTTCAACGTGTGAAAATTTTTCTACTGACAATCGTGTTAT
CGTTGTCGGTACTATTCAAGAATAACGAAAGGAGGAGACTTTTGAG
AAAATATTGGAAAATGTTATTTTCTGTCGTAATGATATTAACCATG
CTGGCCTTTAATCAGACTGTTTTAGCAAAAGACAGCACTGTTCAAA
CTAGCATTAGTGTCGAAAATGTCTTAGAGAGAGCAGGCGATAGTAC
CCCATTTTCGGTTGCATTAGAATCAATTGATGCGATGAAAACAATA
GACGAAATAACAATTGCTGGTTCTGGAAAAGCAAGCTTTTCCCCTC
TGACCTTCACAACAGTTGGGCAATATACTTATCGTGTTTATCAGAA
GCCTTCACAAAATAAAGATTATCAAGCAGATACTACTGTATTTGAC
GTTCTTGTCTATGTGACCTATGATGAAGATGGGACTCTAGTCGCAA
AAGTTATTTCTCGAAGGGCTGGAGACGAAGAAAAATCAGCGATTAC
TTTTAAGCCCAAACGGTTAGTAAAACCAATACCGCCTAGACAACCT
AACATCCCTAAAACCCCATTACCATTAGCTGGTGAAGTAAAAAGTT
TATTGGGTATCTTAAGTATCGTATTACTGGGGTTACTAGTTCTTCT
TTATGTTAAAAAACTGAAGAGTAGGCTA

SEQ ID NO: 99

MLFQRVKIFLLTIVLSLSVLFKNNERRRLLRKYWKMLFSVVMILTM
LAFNQTVLAKDSTVQTSISVENVLEPAGDSTPFSVALESIDAMKTI
DEITIAGSGKASFSPLTFTTVGQYTYRVYQKPSQNKDYQADTTVFD
VLVYVTYDEDGTLVAKVISRRAGDEEKSAITFKPKRLVKPIPPRQP
NIPKTPLPLAGEVKSLLGILSTVLLGLLVLLYVKKLKSRL

Orf 82 contains an amino acid motif indicative of a cell wall anchor: SEQ ID NO:185 LPLAG (shown in italics in SEQ ID NO:99, above). In some recombinant host cell systems, it may be preferable to remove this motif to facilitate secretion of a recombinant Orf 82 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in Orf 82. The pilin motif sequence is underlined in SEQ ID NO:99, below. Conserved lysine (K) residues are also marked in bold, at amino acid residues 173 and 188. The pilin sequence, in particular the conserved lysine residues, are thought to be important for the formation of oligomeric, pilus-like structures. Preferred fragments of Orf 82 include at least one conserved lysine residue. Preferably, fragments include the pilin sequence.

SEQ ID NO: 99

MLFQRVKIFLLTIVLSLSVLFKNNERRRLLRKYWKMLFSVVMILTM

LAFNQTVLAKDSTVQTSISVENVLERAGDSTPFSVALESIDAMKTI

DEITIAGSGKASFSPLTFTTVGQYTYRVYQKPSQNKDYQADTTVFD

VLVYVTYDEDGILVAKVISRRAGDEEKSAITFKPKRLVKPIPPRQP

NIPKTPLPLAGEVKSLLGILSIVLLGLLVLLYVKKLKSRL

An E box containing a conserved glutamic residue has been identified in Orf 82. The E-box motif is underlined in SEQ ID NO: 99, below. The conserved glutamic acid (E), at amino acid residue 163, is marked in bold. The E box motif, in particular the conserved glutamic acid residue, is thought to be important for the formation of oligomeric pilus-like structures of Orf 82. Preferred fragments of Orf 82 include the conserved glutamic acid residue. Preferably, fragments include the E box motif

SEQ ID NO: 99

MLFQRVKIFLLTIVLSLSVLFKNNERRRLLRKYWKMLFSVVMILTM

LAFNQTVLAKDSTVQTSISVENVLERAGDSTPFSVALESIDAMKTI

DEITIAGSGKASFSPLTFTTVGQYTYRVYQKPSQNKDYQADTTVFD

VLVYVTYDEDGTLVAKVISRRAGDEEKSAITFKPKRLVKPIPPRQP

NIPKTPLPLAGEVKSLLGILSIVLLGLLVLLYVKKLKSRL

Orf 83 is thought to be a multiple sugar metabolism regulator protein. An example of a nucleotide sequence encoding the sugar metabolism regulator protein (SEQ ID NO:100) and a sugar metabolism regulator protein amino acid sequence (SEQ ID NO:101) are set forth below.

SEQ ID NO: 100

ATGATACAACTAAGGATGGGGGCAATCTATCAAATGGTTATATTCGA
TTTAAAACATGTGCAAACATTACACAGCTTGTCTCAATTACCTATTT
CAGTGATGTCACAAGATAAGGCACTTATTCAAGTATATGGTAATGAC
GACTATTTATTATGTTACTATCAATTTTTAAAGCATCTAGCTATTCC
TCAAGCTGCACAAGATGTTATTTTTTATGAGGGTTTATTTGAAGAGT
CCTTTATGATTTTTCCTCTTTGTCACTACATTATTGCCATTGGACCT
TTCTATCCTTATTCACTTAATAAAGACTATCAGGAACAATTAGCTAA
TAATTTTTTAAAACATTCTTCTCATCGTAGCAAAGAAGAGCTCTTGT
CCTATATGGCACTTGTCCCACATTTTCCAATTAATAATGTGCGGAAC
CTTTTGATAGCTATTGACGCTTTTTTTGACACACAATTTGAGACGAC
TTGCCAACAAACGATTCATCAATTGTTGCAGCATTCAAAACAGATGA
CTGCTGATCCTGATATCATTCATCGCCTTAAGCATATTAGCAAAGCA
TCTAGCCAATTACCGCCTGTTTTAGAGCACCTAAATCATATTATGGA
TCTGGTAAAGCTAGGCAATCCACAATTGCTCAAGCAAGAAATCAATC
GCATCCCCTTATCAAGTATCACCTCATCTTCTATTTCTGCTCTAAGG
GCGGAAAGAACCTCACTGTTATCTATTTCAACTAGGTTACTGGAATT
CAGTTTTGTAGAAAATACTGACGTAGCAAAGCATTATAGCCTTGTCA
AATACTACATGGCCTTAAATGAAGAAGCGAGTGACTTGCTCAAAGTT
TTGAGAATTCGCTGTGCAGCTATCATCCATTTTTCCGAATCATTAAC
CAATAAAAGTATTTCTGATAAACGTCAAATGTACAATAGTGTGCTTC
ATTATGTCGATAGTCACCTGTATTCCAAATTAAAGGTATCTGATATC
GCTAAGCGCCTATATGTTTCCGAATCTCACTTACGTTCAGTCTTTAA
AAAATACTCAAATGTTTCCTTACAACATTATATTCTAAGTACAAAAA
TCAAAGAAGCTCAACTACTCTTAAAACGAGGAATTCCTGTTGGAGAA
GTGGCTAAAAGCTTATATTTTTATGACACTACCCATTTTCATAAAAT
CTTTAAAAAATACACGGGTATTTCTTCAAAAGACTATCTTGCTAAAT
ACCGAGATAATATT

SEQ ID NO: 101

MIQLRMGAIYQMVIFDLKHVQTLHSLSQLPISVMSQDKALIQVYGND
DYLLCYYQFLKHLAIPQAAQDVIFYEGLFEESFMIFPLCHYIIAIGP
FYPYSLNKDYQEQLANNFLKHSSHRSKEELLSYMALVPHFPINNVRN
LLIAIDAFFDTQFETTCQQTIHQLLQHSKQMTADPDIIHRLKHISKA
SSQLPPVLEHLNHIMDLVKLGNPQLLKQEINRIPLSSITSSSISALR
AEKNLTVIYLTRLLEFSFVENTDVAKHYSLVKYYMALNEEASDLLKV
LRIRCAAIIHFSESLTNKSISDKRQMYNSVLHYVDSHLYSKLKVSDI
AKRLYVSESHLRSVFKKYSNVSLQHYILSTKIKEAQLLLKRGIPVGE
VAKSLYFYDTTHFHKIFKKYTGTSSKDYLAKYRDNI

Orf 84 is thought to be a F2-like fibronectin-binding protein. An example of a nucleotide sequence encoding the F2-like fibronectin-binding protein (SEQ ID NO:102) and a F2-like fibronectin-binding protein amino acid sequence (SEQ ID NO:103) are set forth below.

SEQ ID NO: 102

ATGACACAAAAAAATAGCTATAAGTTAAGCTTCCTGTTATCCCTAAC
AGGATTTATTTTAGGTTTATTATTGGTTTTTATAGGATTGTCCGGAG
TATCAGTAGGACATGCGGAAACAAGAAATGGAGCAAACAAACAAGGA
GCTTTTGAAATCAAGAAAAATAAAAGTCAAGAAGAATATAATTATGA
AGTTTATGATAACAGAAACATACTTCAGGATGGGGAACATAAACTTG
AAATAAAAAGAGTTGATGGGACAGGTAAAACTTATCAAGGTTTTTGC
TTTCAGTTAACGAAAAATTTTCCCACTGCTCAAGGTGTAAGTAAAAA
GCTGTATAAAAAATTGAGTAGTAGTGATGAAGAAACACTAAAGCAAT
ATGCCTCTAAGTATACAAGTAATAGGAGAGGAGATACTAGTGGTAAT
CTTAAAAAGCAAATTGCTAAGGTTCTGACAGAAGGTTACCCAACTAA
CAAAAGTGATTGGTTAAATGGATTGACTGAAAACGAAAAAATAGAAG
TAACCCAGGATGCAATTTGGTATTTTACAGAAACGACAGTTCCGGCT
GATAGAAGTTATACGAATCGCAACGTAAATAGTCAAAAAATGAAAGA
AGTGTATCAAAAGCTAATTGATACAACAGATATAGATAAATATGAAG
ATGTACAATTTGATTTATTTGTGCCACAAGATACAAACTTACAGGCA
GTAATTAGTGTAGAGCCTGTTATCGAAAGCCTTCCTTGGACATCGTT
GAAGCCAATAGCCCAGAAGGATATCACTGCCAAAAAAATCTGGGTAG
ATGCACCTAAAGAAAAACCAATTATTTATTTTAAGCTATATAGACAG
CTGCCTGGAGAAAAGGAAGTAGCAGTGGATGACGCTGAGCTAAAACA
GATAAATAGTGAAGGTCAACAAGAAATATCAGTAACTTGGACAAATC
AACTTGTTACAGATGAAAAAGGAATGGCTTACATTTATTCTGTAAAA
GAAGTAGATAAAAATGGCGAGTTACTTGAGCCAAAAGATTATATCAA
GAAGGAAGATGGACTTACAGTTACTAATACTTATGTAAAGCCAACTA
GTGGGCACTATGATATAGAAGTGACATTTGGAAATGGACATATTGAT
ATTACAGAAGATACTACACCAGATATTGTTTCAGGTGAAAACCAAAT
GAAGCAAATAGAGGGAGAAGATAGTAAGCCTATTGATGAAGTAACGG
AAAATAATTTAATTGAATTTGGTAAAAACACGATGCCAGGTGAAGAA
GATGGCACAAATTCTAATAAGTATGAAGAAGTCGAAGACTCACGCCC
AGTTGATACCTTGTCAGGTTTATCAAGTGAGCAAGGTCAGTCCGGTG
ATATGACAATTGAAGAAGATAGTGCTACCCATATTAAATTCTCAAAA
CGTGATATTGACGGCAAAGAGTTAGCTGGTGCAACTATGGAGTTGCG
TGATTCATCTGGTAAAACTATTAGTACATGGATTTCAGATGGACAAG
TGAAAGATTTCTACCTGATGCCAGGAAAATATACATTTGTCGAAACC
GCAGCACCAGACGGTTATGAGATAGCAACTGCTATTACCTTTACAGT
TAATGAGCAAGGTCAGGTTACTGTAAATGGCAAAGCAACTAAAGGTG
ACGCTCATATTGTCATGGTTGATGCTTACAAGCCAACTAAGGGTTCA
GGTCAGGTTATTGATATTGAAGAAAAGCTTCCAGACGAGCAGGGCCA
TTCTGGCTCAACTACTGAAATAGAAGATAGCAAGTCTTCAGACGTTA
TCATTGGTGGTCAGGGGCAGATTGTCGAGACAACAGAGGATACCCAA
ACTGGCATGCACGGGGATTCTGGTTGTAAAACGGAAGTCGAAGATAC
TAAACTAGTACAATCCTTCCACTTTGATAACAAGGAATCAGAAAGTA
ACTCTGAGATTCCTAAAAAAGATAAGCCAAAGAGTAATACTAGTTTA
CCAGCAACTGGTGAGAAGCAACATAATATGTTCTTTTGGATGGTTAC
TTCTTGCTCACTTATTAGTAGTGTTTTTGTAATATCACTAAAAACTA
AAAAACGCCTATCATCATGT

SEQ ID NO: 103

MTQKNSYKLSFLLSLTGFILGLLLVFIGLSGVSVGHAETRNGANKQG
AFEIKKNKSQEEYNYEVYDNRNILQDGEHKLEIKRVDGTGKTYQGFC
FQLTKNFPTAQGVSKKLYKKLSSSDEETLKQYASKYTSNRRGDTSGN
LKKQIAKVLTEGYPTNKSDWLNGLTENEKIEVTQDAIWYFTETTVPA
DRSYTNRNVNSQMKKEVYQKLIDTTDIDKYEDVQFDLFVPQDTNLQA
VISVEPVIESLPWTSLKPIAQKDITAKKIWVDAPKEKPIIYFKLYRQ
LPGEKEVAVDDAELKQINSEGQQEISVTWTNQLVTDEKGMAYIYSVK
EVDKNGELLEPKDYIKKEDGLTVTNTYVKPTSGHYDIEVTFGNGHID
ITEDTTPDIVSGENQMKQIEGEDSKPIDEVTENNLIEFGKNTMPGEE
DGTNSNKYEEVEDSRPVDTLSGLSSEQGQSGDMTIEEDSATHIKFSK
RDIDGKELAGATMELRDSSGKTISTWISDGQVKDFYLMPGKYTFVET
AAPDGYEIATAITFTVNEQGQVTVNGKATKGDAHIVMVDAYKPTKGS
GQVIDIEEKLPDEQGHSGSTTEIEDSKSSDVIIGGQGQIVETTEDTQ
TGMHGDSGCKTEVEDTKLVQSFHFDNKESESNSEIPKKDKPKSNTS*L*
*PATG*EKQHNMFFWMVTSCSLISSVFVISLKTKKRLSSC

Orf 84 contains an amino acid motif indicative of a cell wall anchor: SEQ ID NO:181 LPATG (shown in italics in SEQ ID NO:103, above). In some recombinant host cell systems, it may be preferable to remove this motif to facilitate secretion of a recombinant Orf 84 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in Orf 84. The pilin motif sequence is underlined in SEQ ID NO:103, below. A conserved lysine (K) residue is also marked in bold, at amino acid residue 270. The pilin sequence, in particular the conserved lysine residue, is thought to be important for the formation of oligomeric, pilus-like structures. Preferred fragments of Orf 84 include the conserved lysine residue. Preferably, fragments include the pilin sequence.

SEQ ID NO: 103

MTQKNSYKLSFLLSLTGFILGLLLVFIGLSGVSVGHAETRNGANKQG

AFEIKKNKSQEEYNYEVYDNRNILQDGEHKLEIKRVDGTGKTYQGFC

FQLTKNFPTAQGVSKKLYKKLSSSDEETLKQYASKYTSNRRGDTSGN

LKKQIAKVLTEGYPTNKSDWLNGLTENEKIEVTQDAIWYFTETTVPA

DRSYTNRNVNSQKMKEVYQKLIDTTDIDKYEDVQGDLFVPQDTNLQA

VISVEPVIESLPWTSLKPIAQKDITAKKIWVDAPKEKPIIYFKLYRQ

LPGEKEVAVDDAELKQINSEGQQEISVTWTNQLVTDEKGMAYIYSVK

EVDKNGELLEPKDYIKKEDGLTVTNTYVKPTSGHYDIEVTFGNGHID

ITEDTTPDIVSGENQMKQIEGEDSKPIDEVTENNLIEFGKNTMPGEE

DGTNSNKYEEVEDSRPVDTLSGLSSEQGQSGDMTIEEDSATHIKFSK

IDIDGKELAGATMELRDSSGKTISTWISDGQVKDFYLMPGKYTFVET

AAPDGYEIATAITFTVNEQGQVTVNGKATKGDAHIVMVDAYKPTKGS

GQVIDIEEKLPDEQGHSGSTTEIEDSKSSDVIIGGQGQIVETTEDTQ

TGMHGDSGCKTEVEDTKLVQSFHFDNKESESNSEIPKKDKPKSNTSL

PATGEKQHNMFFWMVTSCSLISSVFVISLKTKKRLSSC

An E box containing a conserved glutamic residue has been identified in Orf 84. The E-box motif is underlined in SEQ ID NO:103, below. The conserved glutamic acid (E), at amino acid residue 516, is marked in bold. The E box motif, in particular the conserved glutamic acid residue, is thought to be important for the formation of oligomeric pilus-like structures of Orf 84. Preferred fragments of Orf 84 include the conserved glutamic acid residue. Preferably, fragments include the E box motif

SEQ ID NO: 103

MTQKNSYKLSFLLSLTGFILGLLLVFIGLSGVSVGHAETRNGANKQ

GAFEIKKNKSQEEYNYEVYDNRNILQDGEHKLEIKRVDGTGKTYQG

FCFQLTKNFPTAQGVSKKLYKKLSSSDEETLKQYASKYTSNRRGDT

SGNLKKQIAKVLTEGYPTNKSDWLNGLTENEKIEVTQDAIWYFTET

TVPADRSYTNRNVNSQKMKEVYQKLIDTTDIDKYEDVQFDLFVPQD

TNLQAVISVEPVIESLPWTSLKPIAQKDITAKKIWVDAPKEKPIIY

FKLYRQLPGEKEVAVDDAELKQINSEGQQEISVTWTNQLVTDEKGM

AYIYSVKEVDKNGELLEPKDYIKKEDGLTVTNTYVKPTSGHYDIEV

TFGNGHIDITEDTTPDIVSGENQMKQIEGEDSKPIDEVTENNLIEF

GKNTMPGEEDGTNSNKYEEVEDSRPVDTLGSLSSEQGQSGDMTIEE

DSATHIKFSKRDIDGKELAGATMELRDSSGKTISTWISDGQVKDFY

LMPGKYTFVETAAPDGYEIATAITFTVNEQGQVTVNGKATKGDAHI

VMVDAYKPTKGSGQVIDIEEKLPDEQGHSGSTTEIEDSKSSDVIIG

GQGQIVETTEDTQTGMHGDSGCKTEVEDTKLVQSFHFDNKESESNS

-continued

EIPKKDKPKSNTSLPATGEKQHNMFFWMVTSCSLISSVFVISLKTK

KRLSSC

Examples of GAS AI-sequences from M18 strain isolate MGAS 8232 are set forth below.

SpyM18_0125 is a negative transcriptional regulator (Nra). An example of SpyM18_0125 is set forth in SEQ ID NO:72.

SEQ ID NO: 72

MPYVKKKKDSFLVETYLEQSIRDKSELVLLLFKSPTIIFSHVAKQTG

LTAVQLKYYCKELDDFFGNNLDITIKKGKIICCFVKPVKEFYLHQLY

DTSTILKLLVFFIKNGTTSQPLIKFSKKYFLSSSSAYRLRESLIKLL

REFGLRVSKNTIVGEEYRIRYLIAMLYSKFGIVIYPLDHLDNQIIYR

FLSQSATNLRTSPWLEEPFSFYNMLLALS

SpyM18_0126 is thought to be a collagen binding protein (CBP). An example of SpyM18_0126 is set forth in SEQ ID NO:73.

SEQ ID NO: 73

MQKRDKTNYGSANNKRRQTTIGLLKVFLTFVALIGIVGFSIRAFGAE

EQSTETKKTSVIIRKYAEGDYSKLLEGATLKLAQIEGSGFQEQSFES

STSGQKLQLSDGTYILTETKSPQGYEIAEPITFKVTAGKVFIKGKDG

QFVENQNKEVAEPYSVTAYNDFDDSGFINPKTFTPYGKFYYAKNANG

TSQVVYCFNVDLHSPPDSLDKGETIDPDFNEGKEIKYTHILGADLFS

YANNPRASTNDELLSQVKKVLEKGYRDDSTTYANLTSVEFRAATQLA

IYYFTDSVDLDNLADYHGFGALTTEALNATKEIVAYAEDRANLPNIS

NLDFYVPNSNKYQSLIGTQYHPESLVDIIRMEDKQAPIIPITHKLTI

SKTVTGTIADKKKEFNFEIHLKSSDGQAISGTYPTNSGELTVTDGKA

TFTLKDGESLIVEGLPSGYSYEITETGASDYEVSVNGKNAPDGKATK

ASVKEDETITFENRKDL*VPPTG*LTTDGAIYLWLLLLVLLGLWVWLIG

RKGLKND

SpyM18_0126 contains an amino acid motif indicative of a cell wall anchor: SEQ II ID NO: 184 VPPTG (shown in italics in SEQ ID NO:73, above). In some recombinant host cell systems, it may be preferable to remove this motif to facilitate secretion of a recombinant SpyM18_0126 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in SpyM18_0126. The pilin motif sequence is underlined in SEQ ID NO:73, below. Conserved lysine (K) residues are also marked in bold, at amino acid residues 172 and 179. The pilin sequence, in particular the conserved lysine residues, are thought to be important for the formation of oligomeric, pilus-like structures. Preferred fragments of SpyM18_0126 include at least one conserved lysine residue. Preferably, fragments include the pilin sequence.

SEQ ID NO: 73

MQKRDKTNYGSANNKRRQTTIGLLKVFLTFVALIGIVGFSIRAFGAE

EQSTETKKTSVIIRKYAEGDYSKLLEGATLKLAQIEGSGFQEQSFES

STSGQKLQLSDGTYILTETKSPQGYEIAEPITFKVTAGKVFIKGKDG

QFVENQNKEVAEPYSVTAYND<u>FDDSGFINPKTFTPYGK</u>FYYAKNANG

TSQVVYCFNVDLHSPPDSLDKGETIDPDFNEGKEIKYTHILGADLFS

YANNPRASTNDELLSQVKKVLEKGYRDDSTTYANLTSVEFRAATQLA

IYYFTDSVDLDNLADYHGFGALTTEALNATKEIVAYAEDRANLPNIS

NLDFYVPNSNKYQSLIGTQYHPESLVDIIRMEDKQAPIIPITHKLTI

SKTVTGTIADKKKEFNFEIHLKSSDGQAISGTYPTNSGELTVTDGKA

TFTLKDGESLIVEGLPSGYSYEITETGASDYEVSVNGKNAPDGKATK

ASVKEDETITFENRKDLVPPTGLTTDGAIYLWLLLLVLLGLWVWLIG

RKGLKND

Three E boxes containing conserved glutamic residues have been identified in SpyM18_0126. The E-box motifs are underlined in SEQ ID NO:73, below. The conserved glutamic acid (E) residues, at amino acid residues 112, 257, and 415, are marked in bold. The E box motifs, in particular the conserved glutamic acid residues, are thought to be important for the formation of oligomeric pilus-like structures of SpyM18_0126. Preferred fragments of SpyM18_0126 include at least one conserved glutamic acid residue. Preferably, fragments include at least one E box motif

SEQ ID NO: 73

MQKRDKTNYGSANNKRRQTTIGLLKVFLTFVALIGIVGFSIRAFGAE

EQSTETKKTSVIIRKYAEGDYSKLLEGATLKLAQIEGSGFQEQSFES

STSGQKLQLSDGT<u>YILTETKSPQGY</u>EIAEPITFKVTAGKVFIKGKDG

QFVENQNKEVAEPYSVTAYNDFDDSGFINPKTFTPYGKFYYAKNANG

TSQVVYCFNVDLHSPPDSLDKGETIDPDFNEGKEIKYTHILGADLFS

YANNPRASTNDELLSQV<u>KKVLEKGYRDD</u>STTYANLTSVEFRAATQLA

IYYFTDSVDLDNLADYHGFGALTTEALNATKEIVAYAEDRANLPNIS

NLDFYVPNSNKYQSLIGTQYHPESLVDIIRMEDKQAPIIPITHKLTI

SKTVTGTIADKKKEFNFEIHLKSSDGQAISGTYP<u>TNSGELTVTDG</u>KA

TFTLKDGESLIVEGLPSGYSYEITETGASDYEVSVNGKNAPDGKATK

ASVKEDETITFENRKDLVPPTGLTTDGAIYLWLLLLVLLGLWVWLIG

RKGLKND

SpyM18_0127 is a LepA protein. An example of SpyM18_0127 is shown in SEQ ID NO: 74.

SEQ ID NO: 74

MTNYLNRLNENPLEKAFIRLVLKISIIGFLGYILFQYIFGVMIINTN

VMSPALSAGDGILYYRLTDRYHINDVVVYEVDNTLKVGRIVAQAGDE

VSFTQEGGLLINGHPPEKEVPYLTYPHSSGPNFPYKVPIGTYFILND

YREERLDSRYYGALPINQIKGKISTLLRVRGI

SpyM18_0128 is thought to be a fimbrial protein. An example of SypM18_0128 is shown in SEQ ID NO:75.

SEQ ID NO: 75

```
MKKNKLLLATAILATALGTASLNQNVKAETAGVIDGSTLVVKKTFP
SYTDDKVLMPKADYTFKVEADDNAKGKTKGDLDIKPGVTDGLENTK
TIHYGNSDKTTAKEKSVNFDFANVKFPGVGVYRYTVSEVNGNKAGI
AYDSQQWTVDVYVVNREDGGFEAKYIVSTEGGQSDKKPVLFKNFFD
TTSLKVTKKVTGNTGEHQRSFSFTLLLTPNECFEKGQVVNILQGGE
TKKVVIGEEYSFTLKDKESVTLSQLPVGIEYKVTEEDVTKDGYKTS
ATLKDGDVTDGYNLGDSKTTDKSTDEIVVTNKRDTQVPTGVVGTLA
PFAVLSIVATGGVIYITKRKKA
```

SpyM18_0128 contains an amino acid motif indicative of a cell wall anchor: SEQ ID NO:140 QVPTG (shown in italics in SEQ ID NO:75, above). In some recombinant host cell systems, it may be preferable to remove this motif to facilitate secretion of a recombinant SpyM18_0128 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in SpyM18_0128. The pilin motif sequence is underlined in SEQ ID NO:75, below. A conserved lysine (K) residue is also marked in bold, at amino acid residue 57. The pilin sequence, in particular the conserved lysine residue, is thought to be important for the formation of oligomeric, pilus-like structures. Preferred fragments of SpyM18_0128 include the conserved lysine residue. Preferably, fragments include at least one pilin sequence.

SEQ ID NO: 75

```
MKKNKLLLATAILATALGTASLNQNVKAETAGVIDGSTLVVKKTF
PSYTDDKVLMPKADYTFKVEADDNAKGKTKDGLDIKPGVIDGLEN
TKTIHYGNSDKTTAKEKSVNFDFANVKFPGVGVYRYTVSEVNGNK
AGIAYDSQQWTVDVYVVNREDGGFEAKYIVSTEGGQSDKKPVLFK
NFFDTTSLKVTKKVTGNTGEHQRSFSFTLLLTPNEVFEKGQVVNI
LQGGETKKVVIGEEYSFTLKDKESVTLSQLPVGIEYKVTEEDVTK
DGYKTSATLKDGDVTDGYNLGDSKTTDKSTDEIVVTNKRDTQVPT
GVVGTLAPFAVLSIVAIGGVIYITKRKKA
```

An E box containing a conserved glutamic residue has been identified in SpyM18_0128. The E-box motif is underlined in SEQ ID NO: 75, below. The conserved glutamic acid (E), at amino acid residue 266, is marked in bold. The E box motif, in particular the conserved glutamic acid residue, is thought to be important for the formation of oligomeric pilus-like structures of SpyM18_0128. Preferred fragments of SpyM18_0128 include the conserved glutamic acid residue. Preferably, fragments include the E box motif

SEQ ID NO: 75

```
MKKNKLLLATAILATALGTASLNQNVKAETAGVIDGSTLVVKKTFPS
YTDDKVLMPKADYTFKVEADDNAKGKTKDGLDIKPGVIDGLENTKTI
```

-continued

```
HYGNSDKTTAKEKSVNFDFANVKFPGVGVYRYTVSEVNGNKAGIAYD
SQQWTVDVYVVNREDGGFEAKYIVSTEGGQSDKKPVLFKNFFDTTSL
KVTKKVTGNTGEHQRSFSFTLLLTPNECFEKGQVVNILQGGETKKVV
IGEEYSFTLKDKESVTLSQLPVGIEYKVTEEDVTKDGYKTSATLKDG
DVTDGYNLGDSKTTDKSTDEIVVTNKRDTQVPTGVVGTLAPFAVLSI
VAIGGVIYITKRKKA
```

SpyM18_0129 is a SrtC2 type sortase. An example of SpyM18_0129 is shown in SEQ ID NO: 76

SpyM18_0129 is a SrtC2 type sortase. An example of SpyM18_0129 is shown in SEQ ID NO:76

SEQ ID NO: 76

```
MISQRMMMTIVQVINKAIDTLILIFCLVVLFLAGFGLWDSYHLYQQA
DASNFKKFKTAQQQPKFEDLLALNEDVIGWLNIPGTHMDYPLVQGKT
NLEYINKAVDGSVAMSGSLFLDTRNHNDFTDDYSLIYGHHMAGNAMF
GEIPKFLKKDFFNKHNKAIIETKERKKLTVTIFACLKTDAFDQLVFN
PNAITNQDQQRQLVDYISKRSKQFKPVKLKHHTKFVAFSTCENFSTD
NRVIVVGTIQE
```

SpyM18_0130 is referred to as a hypothetical protein. An example of SpyM18_0130 is shown in SEQ ID NO:77

SEQ ID NO: 77

```
MRKYWKMLFSVVMILTMLAFNQTVLAKDSTVQTSISVENVLERAGDS
TSFSVALESIDAMKTIDEITIAGSGKASFSPLTFTTVGQYTYRVYQK
PSQNKDYQADTTVFDVLVYVTYDEDGTLVAKVISRRAGDEEKSAITF
KPKRLVKPIPPRQPDIPKTPLPLAGEVKSLLGILSIVLLGLLVLLYV
KKLKSRL
```

SpyM18_0130 contains an amino acid motif indicative of a cell wall anchor: SEQ ID NO:185 LPLAG (shown in italics in SEQ ID NO:77, above). In some recombinant host cell systems, it may be preferable to remove this motif to facilitate secretion of a recombinant SpyM18_0130 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in SpyM18_0130. The pilin motif sequence is underlined in SEQ ID NO:77, below. Conserved lysine (K) residues are also marked in bold, at amino acid residues 144, 159, and 169. The pilin sequence, in particular the conserved lysine residues, are thought to be important for the formation of oligomeric, pilus-like structures. Preferred fragments of SpyM18_0130 include at least one conserved lysine residue. Preferably, fragments include the pilin sequence.

SEQ ID NO: 77

```
MRKYWKMLFSVVMILTMLAFNQTVLAKDSTVQTSISVENVLERAGDS
TSFSVALESIDAMKTIDEITIAGSGKASFSPLTFTTVGQYTYRVYQK
```

-continued

PSQNKDYQADTTVEDVLVYVTYDEDGTLVAKVISRRAGDEEKSAITF

KPKRLVKPIPPRQPDIPKTPLPLAGEVKSLLGILSIVLLGLLVLLYV

KKLKSRL

An E box containing a conserved glutamic residue has been identified in SpyM18_0130. The E-box motif is underlined in SEQ ID NO: 77, below. The conserved glutamic acid (E), at amino acid residue 134, is marked in bold. The E box motif, in particular the conserved glutamic acid residue, is thought to be important for the formation of oligomeric pilus-like structures of SpyM18_0130. Preferred fragments of SpyM18_0130 include the conserved glutamic acid residue. Preferably, fragments include the E box motif

SEQ ID NO: 77

MRKYWKMLFSVVMILTMLAFNQTVLAKDSTVQTSISVENVLERAGDS

TSFSVALESIDAMKTIDEITIAGSGKASFSPLTFTTVGQYTYRVYQK

PSQNKDYQADTTVEDVLVYVTYDEDGTLVAKVISRRAGDEEKSAITF

KPKRLVKPIPPRQPDIPKTPLPLAGEVKSLLGILSIVLLGLLVLLYV

KKLKSRL

SpyM18_0131 is referred to as a putative multiple sugar metabolism regulator. An example of SpyM18_0131 is set forth in SEQ ID NO: 78.

SEQ ID NO: 78

MAIFDLKHVQTLHSLSQLPISVMSQDKALIQVYGNDDYLLCYYQFLK

HLAIPQAAQDVIFYEGLFEESFMIFPLCHYIIAIGPFYPYSLNKDYQ

EQLANNCLKHSSHRSKEELLSYMALVPHFPINNVRNLLIAIDAFFDT

QFETTCQQTIHQLLQHSKQMTADPDIIHRLKHISKASSQLPPVLEHL

NHIMDLVKLGNPQLLKQEINRIPLSSITSSSISALRAEKNLTVIYLT

RLLEFSFVENTDVAKHYSLVKYYMALNEEASDLLKVLRIRCAAIIHF

SESLINKSISDKRQMYNSVLHYVDSHLYSKLKVSDTAKRLYVSESHL

RSVFKKYSNVSLQHYTLSTKTKEAQLLLKRGIPVGEVAKSLYFYDIT

HEHKIFKKYTGISSKDYLAKYRDNI

SpyM18_0132 is a F2 like fibronectic-binding protein. An example of SpyM18_0132 is set forth in SEQ ID NO:79.

SEQ ID NO: 79

MTQKNSYKLSELLSLTGFILGLLLVFIGLSGVSVGHAETRNGANKQG

AFEIKKNKSQEEYNYEVYDNRNILQDGEHKLEIKRVDGTGKTYQGFC

FQLTKNEPTAQGVSKKLYKKLSSSDEETLKQYASKYTSNRRGDTSGN

LKKQTAKVLTEGYPTNKSDWLNGLTENEKIEVTQDAIWYFTETTVPA

DRSYTNRNVNSQKMKEVYQKLIDTTDIDKYEDVQFDLFVPQDTNLQA

VISVEPVIESLPWTSLKPIAQKDITAKKIWVDAPKEKPITYFKLYRQ

LPGEKEVAVDDAELKQINSEGQQEISVTWTNQLVTDEKGMAYIYSVK

EVDKNGELLEPKDYIKKEDGLTVTNTYVKPTSGHYDIEVTFGNGHID

ITEDTTPDIVSGENQMKQIEGEDSKPIDEVTENNLIEPGKNTMPGEE

DGTNSNKYEEVEDSRPVDTLSGLSSEQGQSGDMTIEEDSATHIKESK

-continued

RDIDGKELAGATMELRDSSGKTISTWISDGQVKDFYLMPGKYTEVET

AAPDGYEIATAITFTVNEQGQVTVNGKATKGDAHIVMVDAYKPTKGS

GQVIDIEEKLPDEQGHSGSTTEIEDSKSSDVIIGGQGQIVETTEDTQ

TGMHGDSGCKTEVEDTKLVQSFHFDNKESESNSEIPKKDKPKSNTS*L*

*PATG*EKQHNMFFWMVTSCSLISSVPVISLKTKKRLSSC

SpyM18_0132 contains an amino acid motif indicative of a cell wall anchor: SEQ ID NO:180 LPATG (shown in italics in SEQ ID NO:79, above). In some recombinant host cell systems, it may be preferable to remove this motif to facilitate secretion of a recombinant SpyM18_0132 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in SpyM18_0132. The pilin motif sequence is underlined in SEQ ID NO:79, below. A conserved lysine (K) residue is also marked in bold, at amino acid residue 270. The pilin sequence, in particular the conserved lysine residue, is thought to be important for the formation of oligomeric, pilus-like structures. Preferred fragments of SpyM18_0132 include the conserved lysine residue. Preferably, fragments include the pilin sequence.

SEQ ID NO: 79

MTQKNSYKLSFLLSLTGFILGLLLVFIGLSGVSVGHAETRNGANKQG

AFEIKKNKSQEEYNYEVYDNRNILQDGEHKLEIKRVDGTGKTYQGFC

FQLTKNFPTAQGVSKKLYKKLSSSDEETLKQYASKYTSNRRGDTSGN

LKKQTAKVLTEGYPTNKSDWLNGLTENEKIEVTQDAIWYFTETTVPA

DRSYTNRNVNSQKMKEVYQKLIDTTDIDKYEDVQFDLFVPQDTNLQA

VISVEPVIESLPWTSLKPIAQKDITAKKIWVDAPKEKPITYFKLYRQ

LPGEKEVAVDDAELKQINSEGQQEISVTWTNQLVTDEKGMAYIYSVK

EVDKNGELLEPKDYIKKEDGLTVTNTYVKPTSGHYDIEVTFGNGHID

ITEDTTPDIVSGENQMKQIEGEDSKPIDEVTENNLIEFGKNTMPGEE

DGTNSNKYEEVEDSRPVDTLSGLSSEQGQSGDMTIEEDSATHIKFSK

RDIDGKELAGATMELRDSSGKTISTWISDGQVKDFYLMPGKYTFVET

AAPDGYEIATAITFTVNEQGQVTVNGKATKGDAHIVMVDAYKPTKGS

GQVIDIEEKLPDEQGHSGSTTEIEDSKSSDVIIGGQGQIVETTEDTQ

TGMHGDSGCKTEVEDTKLVQSFHFDNKESESNSEIPKKDKPKSNTSL

FVISLKTKKRLSSC

An E box containing a conserved glutamic residue has been identified in SpyM18_0132. The E-box motif is underlined in SEQ ID NO: 79, below. The conserved glutamic acid (E), at amino acid residue 516, is marked in bold. The E box motif, in particular the conserved glutamic acid residue, is thought to be important for the formation of oligomeric pilus-like structures of SpyM18_0132. Preferred fragments of SpyM18_0132 include the conserved glutamic acid residue. Preferably, fragments include the E box motif

SEQ ID NO: 79

MTQKNSYKLSELLSLTGFILGLLLVFIGLSGVSVGHAETRNGANKQG

AFEIKKKNKSQEEYNYEVYDNRNILQDGEHKLEIKRVDGTGKTYQGFC

FQLTKNEPTAQGVSKKLYKKLSSSDEETLKQYASKYTSNRRGDTSGN

LKKQTAKVLTEGYPTNKSDWLNGLTENEKIEVTQDAIWYFTETTVPA

DRSYTNRNVNSQKMKEVYQKLIDTTDIDKYEDVQFDLFVPQDTNLQA

VISVEPVIESLPWTSLKPIAQKDITAKKIWVDAPKEKPITYFKLYRQ

LPGEKEVAVDDAELKQINSEGQQEISVTWTNQLVTDEKGMAYIYSVK

EVDKNGELLEPKDYIKKEDGLTVTNTYVKPTSGHYDIEVTFGNGHID

ITEDTTPDIVSGENQMKQIEGEDSKPIDEVTENNLIEFGKNTMPGEE

DGTNSNKYEEVEDSRPVDTLSGLSSEQGQSGDMTIEEDSATHIKESK

RDIDGKELAGATMELRDSSGKTISTWISDGQVKDFYLMPGKYTFVET

AAPDGYEIATAITFTVNEQGQVTVNGKATKGDAHIVMVDAYKPTKGS

GQVIDIEEKLPDEQGHSGSTTEIEDSKSSDVIIGGQGQIVETTEDTQ

TGMHGDSGCKTEVEDTKLVQSFHEDNKESESNSEIPKKDKPKSNTSL

PATGEKQHNMFFWMVTSCSLISSVFVISLKTKKRLSSC

Examples of GAS AI-sequences from M49 strain isolate 591 are set forth below. SpyoM01000156 is a negative transcriptional regulator (Nra). An example of SpyoM01000156 is set forth in SEQ ID NO:243.

SEQ ID NO: 243

MPYVKKKKDSFLVETYLEQSIRDKSELVLLLFKSPTIIFSHVAKQTG

LTAVQLKYYCKELDDEFGNNLDITIKKGKIIGCFVKPVKEFYLHQLY

DTSTILKLLVFFIKNGTSSQPLIKFSKKYFLSSSSAYRLRESLIKLL

REFGLRVSKNTIVGEEYRIRYLIAMLYSKFGIVIYPLDHLDNQIIYR

FLSQSATNLRTSPWLEEPFSFYNMLLALSWKRHQFAVSIPQTRIFRQ

LKKLFIYDCLIRSSRQVIENAFSLTFSQGDLDYLELIYITTNNSEAS

LQWTPQHIETCCHIFEKNDTERLLLEPILKRLPQLNHSKQDLIKALM

YFSKSFLFNLQHEVIEIPSFSLPTYTGNSNLYKALKNIVNQWLAQLP

GKRHLNEKHLQLFCSHIEQILKNKQPALTVVLISSNFINAKLLTDTI

PRYFSDKGIHFYSFYLLRDDTYQIPSLKPDLVITHSRLTPFVKNDLV

KGVTVAEFSFDNPDYSIASIQNLIYQLKDKKYQDFLNEQLQ

SpyoM01000155 is thought to be a collagen binding protein (CPA). An example of SpyoM01000155 is set forth in SEQ ID NO:244.

SEQ ID NO: 244

MQKRDKTNYGSANNKRRQTTIGLLKVELTEVALIGIVGESIRAFGAE

EQSVPNRQSSIQDYPWYGYDSYPKGYPDYSPLKTYHNLKVNLEGSKD

YQAYCFNLTKHFPSKSDSVRSQWYKKLEGTNENFIKLADKPRIEDGQ

LQQNILRILYNGYPNNRNGIMKGIDPLNAILVTQNAIWYYTDSAQIN

PDESFKTEARSNGINDQQLGLMRKALKELIDPNLGSKYSNKTPSGYR

LNVFESHDKTFQNLLSAEYVPDTPPKPGEEPPAKTEKTSVIIRKYAE

-continued

GDYSKLLEGATLKLSQIEGSGFQEKDFQSNSLGETVELPNGTYTLTE

TSSPDGYKIAEPIKFRVENKKVETVQKDGSQVENPNKEVAEPYSVEA

YNDFMDEEVLSGFTPYGKFYYAKNKDKSSQVVYCPNADLHSPPDSYD

SGETTNPDTSTMKEVKYTHTAGSDLEKYALRPRDTNPEDFLKHIKKV

IEKGYKKKGDSYNGLTETQFRAATQLAIYYFTDSADLKTLKTYNNGK

GYHGFESMDEKTLAVTKELITYAQNGSAPQLTNLDFFVPNNSKYQSL

IGTEYHPDDLVDVTRMEDKKQEVIPVTHSLTVKKTVVGELGDKTKGF

QFELELKDKTGQPIVNTLKTNNQDLVAKDGKYSFNLKHGDTIRIEGL

PTGYSYTLKETEAKDYIVTVDNKVSQEAQSVGKDITEDKKVTFENRK

DL*VPPTG*LTTDGAIYLWLLLLVPLGLLVWLFGRKGLKND

SpyoM01000155 contains an amino acid motif indicative of a cell wall anchor: SEQ ID NO:184 VPPTG (shown in italics in SEQ ID NO:244, above). In some recombinant host cell systems, it may be preferable to remove this motif to facilitate secretion of a recombinant SpyoM1000155 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

Two pilin motifs, discussed above, containing conserved lysine (K) residues have also been identified in SpyoM01000155. The pilin motif sequence is underlined in SEQ ID NO:244, below. Conserved lysine (K) residues are also marked in bold, at amino acid residues 71 and 261. The pilin sequences, in particular the conserved lysine residues, are thought to be important for the formation of oligomeric, pilus-like structures. Preferred fragments of SpyoM01000155 include at least one conserved lysine residue. Preferably, fragments include at least one pilin sequence.

SEQ ID NO: 244

MQKRDKTNYGSANNKRRQTTIGLLKVFLTFVALIGIVGFSIRAFGAE

EQSVPNRQSSIQDYPMQKRDKTNYGSANNKRRQTTIGLLKVFLTFVA

LIGIVGFSIRAFGAEEQSVPNRQSSIQDYPWYGYDSYPKGYPDYSPL

KTYHNLKVNLEGSKDYQAYCFNLIKHEPSKSDSVRSQWYKKLEGTNE

NFIKLADKPRIEDGQLQQNILRILYNGYPNNRNGIMKGIDPLNAILV

TQNAIWYYTDSAQINPDESFKTEARSNGINDQQLGLMRKALKELIDP

NLGSKYSNKTPSGYRLNVFESHDKTFQNLLSAEYVPDTPPKPGEEPP

AKTEKTSVIIRKYAEGDYSKLLEGAILKLSQIEGSGFQEKDFQSNSL

GETVELPNGTYTLTETSSPDGYKIAEPIKFRVENKKVFIVQKDGSQV

ENPNKEVAEPYSVEAYNDFMDEEVLSGFTPYGKFYYAKNKDKSSQVV

YCFNADLHSPPDSYDSGETINPDTSTMKEVKYTHTAGSDLFKYALRP

RDTNPEDFLKHIKKVIEKGYKKKGDSYNGLTETQFRAATQLAIYYFT

DSADLKTLKTYNNGKGYHGFESMDEKTLAVTKELITYAQNGSAPQLT

NLDFFVPNNSKYQSLIGTEYHPDDLVDVIRMEDKKQEVIPVTHSLTV

KKTVVGELGDKTKGFQFELELKDKTGQPIVNTLKTNNQDLVAKDGKY

-continued

SFNLKHGDTIRIEGLPTGYSYTLKETEAKDYIVTVDNKVSQEAQSVG

KDITEDKKVTFENRKDLVPPTGLTTDGAIYLWLLLLVPLGLLVWLFG

RKGLKND

Two E boxes containing conserved glutamic residues have been identified in SpyoM1000155. The E-box motifs are underlined in SEQ ID NO:244, below. The conserved glutamicacid (E) residues, at amino acid residues 329 and 668, are marked in bold. The E box motifs, in particular the conserved glutamic acid residues, are thought to be important for the formation of oligomeric pilus-like structures of SpyoM01000155. Preferred fragments of SpyoM01000155 include at least one conserved glutamic acid residue. Preferably, fragments include at least one E box motif

SEQ ID NO: 244

MQKRDKTNYGSANNKRRQTTIGLLKVFLTFVALIGIVGFSIRAFGAE

EQSVPNRQSSIQDYPWYGYDSYPKGYPDYSPLKTYHNLKVNLEGSKD

YQAYCFNLTKHFPSKSDSVRSQWYKKLEGTNENEIKLADKPRIEDGQ

LQQNILRILYNGYPNNRNGIMKGIDPLNAILVTQNAIWYYTDSAQIN

PDESFKTEARSNGINDQQLGLMRKALKELIDPNLGSKYSNKTPSGYR

LNVFESHDKTFQNLLSAEYVPDTPPKPGEEPPAKTEKTSVIIRKYAE

GDYSKLLEGATLKLSQIEGSGFQEKDFQSNSLGETVELPNGTYTLTE

TSSPDGYKIAEPIKERVENKKVFIVQKDGSQVENPNKEVAEPYSVEA

YNDEMDEEVLSGETPYGKEYYAKNKDKSSQVVYCFNADLHSPPDSYD

SGETINPDTSTMKEVKYTHTAGSDLEKYALRPRDTNPEDFLKHIKKV

IEKGYKKKGDSYNGLTETQFRAATQLAIYYFTDSADLKTLKTYNNGK

GYHGFESMDEKTLAVTKELITYAQNGSAPQLTNLDFFVPNNSKYQSL

IGTEYHPDDLVDVIRMEDKKQEVIPVTHSLTVKKTVVGELGDKTKGF

QFELELKDKTGQPIVNTLKTNNQDLVAKDGKYSFNLKHGDTIRIEGL

PTGYSYTLKETEAKDYIVTVDNKVSQEAQSVGKDITEDKKVTFENRK

DLVPPTGLTTDGAIYLWLLLLVPLGLLVWLFGRKGLKND

SpyoM01000154 is a LepA protein. An example of SpyoM01000154 is shown in SEQ ID NO:245.

SEQ ID NO: 245

MTNYLNRLNENSLFKAFIRLVLKISTIGELGYILFQYVEGVMIINTN

DMSPALSAGDGVLYYRLADRSHINDVVVYEVDNTLKVGRIAAQAGDE

VNFTQEGGLLINGHPPEKEVPYLTYPHSSGPNEPYKVPIGTYFILND

YREERLDSRYYGALPINQIKGKISTLLRVRGI

SpyoM01000153 is thought to be a fimbrial protein. An example of SpyoM01000153 is shown in SEQ ID NO:246.

SEQ ID NO: 246

MKKNKLLLATAILATALGMASMSQNIKAETAGVIDGSTLVVKKTFPS

YTDDNVLMPKADYSFKVEADDNAKGKTKDGLDIKPGVIDGLENTKTI

RYSNSDKITAKEKSVNFEFANVKFPGVGVYRYTVAEVNGNKAGITYD

SQQWTVDVYVVNKEGGGFEVKYIVSTEVGQSEKKPVLFKNSFDTTSL

-continued

KIEKQVTGNTGEHQRLFSFTLLLTPNECFEKGQVVNILQGGETKKVV

IGEEYSFTLKDKESVTLSQLPVGIEYKLTEEDVTKDGYKTSATLKDG

EQSSTYELGKDHKTDKSADEIVVTNKRDT*QVPTG*VVGTLAPFAVLSI

VAIGGVIYITKRKKA

SpyoM01000153 contains an amino acid motif indicative of a cell wall anchor: SEQ ID NO:140 QVPTG (shown in italics in SEQ ID NO:246, above). In some recombinant host cell systems, it may be preferable to remove this motif to facilitate secretion of a recombinant SpyoM01000153 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in SpyoM01000153. The pilin motif sequence is underlined in SEQ ID NO:246, below. A conserved lysine (K) residue is also marked in bold, at amino acid residue 57. The pilin sequence, in particular the conserved lysine residue, is thought to be important for the formation of oligomeric, pilus-like structures. Preferred fragments of SpyoM01000153 include the conserved lysine residue. Preferably, fragments include the pilin sequence.

SEQ ID NO: 246

MKKNKLLLATAILATALGMASMSQNIKAETAGVIDGSTLVVKKTFPS

YTDDNVLMPKADYSFKVEADDNAKGKTKDGLDIKPGVIDGLENTKTI

RYSNSDKITAKEKSVNFEFANVKFPGVGVYRYTVAEVNGNKAGITYD

SQQWTVDVYVVNKEGGGFEVKYIVSTEVGQSEKKPVLFKNSFDTTSL

KIEKQVTGNTGEHQRLFSFTLLLTPNECFEKGQVVNILQGGETKKVV

IGEEYSFTLKDKESVTLSQLPVGIEYKLTEEDVTKDGYKTSATLKDG

EQSSTYELGKDHKTDKSADEIVVTNKRDTQVPTGVVGTLAPFAVLSI

VAIGGVIYITKRKKA

An E box containing a conserved glutamic residue has been identified in SpyoM01000153. The E-box motif is underlined in SEQ ID NO:246, below. The conserved glutamic acid (E), at amino acid residue 265, is marked in bold. The E box motif, in particular the conserved glutamic acid residue, is thought to be important for the formation of oligomeric pilus-like structures of SpyoM01000153. Preferred fragments of SpyoM01000153 include the conserved glutamic acid residue. Preferably, fragments include the E box motif

SEQ ID NO: 246

MKKNKLLLATAILATALGMASMSQNIKAETAGVIDGSTLVVKKTFPS

YTDDNVLMPKADYSFKVEADDNAKGKTKDGLDIKPGVIDGLENTKTI

RYSNSDKITAKEKSVNFEFANVKFPGVGVYRYTVAEVNGNKAGITYD

SQQWTVDVYVVNKEGGGFEVKYIVSTEVGQSEKKPVLFKNSFDTTSL

KIEKQVTGNTGEHQRLFSFTLLLTPNECFEKGQVVNILQGGETKKVV

-continued

```
IGEEYSFTLKDKESVTLSQLPVGIEYKLTEEDVTKDGYKTSATLKDG

EQSSTYELGKDHKTDKSADEIVVTNKRDTQVPTGVVGTLAPFAVLSI

VAIGGVIYITKRKKA
```

SpyoM01000152 is a SrtC2 type sortase. An example of SpyoM01000152 is shown in SEQ ID NO:247.

```
                                          SEQ ID NO: 247
MMMTIVQVINKAIDILILIFCLVVLFLAGFGLWDSYHLYQQADASNF

KKFKTAQQQPKFEDLLALNEDVIGWLNIPGTHIDYPLVQGKTNLEYI

NKAVDGSVAMSGSLFLDTRNHNDFTDDYSLIYGHHMAGNAMFGEIPK

FLKKNFFNKHNKAIIETKERKKLTVTIFACLKTDAFDQLVFNPNAIT

NQDQQRQLVDYISKRSKQFKPVKLKHHTKFVAPSTCENFSTDNRVIV

VGTIQE
```

SpyoM01000151 is referred to as a hypothetical protein. An example of SpyoM01000151 is shown in SEQ ID NO:248.

```
                                          SEQ ID NO: 248
MLFSVVMMLTMLAFNQTVLAKDSTVQTSISVENVLERAGDSTPFSTA

LESIDAMKTIEEITIAGSGKASFSPLTFTTVGQYTYRVYQKPSQNKD

YQADTTVFDVLVYVTYDEDGTLVAKVISRRAGDEEKSAITFKPKRLV

KPIPPRQPDIPKTPLPLAGEVKSLLGILSIVLLGLLVLLYVKKLKSR

L
```

SpyoM01000151 contains an amino acid motif indicative of a cell wall anchor: SEQ ID NO:185 LPLAG (shown in italics in SEQ ID NO:248, above). In some recombinant host cell systems, it may be preferable to remove this motif to facilitate secretion of a recombinant SpyoM01000151 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in SpyoM01000151. The pilin motif sequence is underlined in SEQ ID NO:248, below. Conserved lysine (K) residues are also marked in bold, at amino acid residue 138. The pilin sequence, in particular the conserved lysine residue, is thought to be important for the formation of oligomeric, pilus-like structures. Preferred fragments of SpyoM01000151 include the conserved lysine residue. Preferably, fragments include the pilin sequence.

```
                                          SEQ ID NO: 248
MLFSVVMMLTMLAFNQTVLAKDSTVQTSISVENVLERAGDSTPFST

ALESIDAMKTIEEITIAGSGKASFSPLTFTTVGQYTYRVYQKPSQN

KDYQADTTVFDVLVYVTYDEDGTLVAKVISRRAGDEEKSAITFKPK

RLVKPIPPRQPDIPKTPLPLAGEVKSLLGILSIVLLGLLVLLYVKK

LKSRL
```

Two E boxes containing conserved glutamic residues have been identified in SpyoM01000151. The E-box motifs are underlined in SEQ ID NO: 248, below. The conserved glutamic acid (E) residues, at amino acid residues 58 and 128, are marked in bold. The E box motifs, in particular the conserved glutamic acid residues, are thought to be important for the formation of oligomeric pilus-like structures of SpyoM01000151. Preferred fragments of SpyoM01000151 include at least one conserved glutamic acid residue. Preferably, fragments include at least one E box motif

```
                                          SEQ ID NO: 248
MLFSVVMMLTMLAFNQTVLAKDSTVQTSISVENVLERAGDSTPFST

ALESIDAMKTIEEITIAGSGKASFSPLTFTTVGQYTYRVYQKPSQN

KDYQADTTVFDVLVYVTYDEDGTLVAKVISRRAGDEEKSAITFKPK

RLVKPIPPRQPDIPKTPLPLAGEVKSLLGILSIVLLGLLVLLYVKK

LKSRL
```

SpyoM01000150 is referred to as a putative MsmRL. An example of SpyoM01000150 is set forth in SEQ ID NO: 249.

```
                                          SEQ ID NO: 249
MVIFDLKHVQTLHSLSQLPISVMSQDKALIQVYGNDDYLLCYYQFL

KHLAIPQAAQDVIFYEGLFEESFMIFPLCHYIIAIGPFYPYSLNKD

YQEQLANNFLKHSSHRSKEELLSYMALVPHFPINNVRNLLIAIDAF

FDTQFETTCQQTIHQLLQHSKQMTADPDIIHRLKHISKASSQLPPV

LEHLNHIMDLVKLGNPQLLKQEINRIPLSSITSSSISALRAEKNLT

VIYLTRLLEFSFVENTDVAKHYSLVKYYMALNEEASDLLKVLRIRC

AAIIHFSESLINKSISDKRQMYNSVLHYVDSHLYSKLKVSDIAKRL

YVSESHLRSVFKKYSNVSLQHYILSTKIKEAQLLLKRGIPVGEVAK

SLYFYDITHEHKIFKKYTGISSKDYLAKYRDNI
```

SpyoM01000149 is a F2 like fibronectin-binding protein. An example of SpyoM01000149 is set forth in SEQ ID NO:250.

```
                                          SEQ ID NO: 250
MTQKNSYKLSFLLSLTGFILGLLLVFIGLSGVSVGHAETRNGANKQ

GYFEIKKVDQNNKPLSGATFSLTPKDGKGKPVQTFTSSEEGIIDAQ

NLQPGTYTLKEETAPDGYDKTSRTWTVTVYENGYTKLVENPYNGEI

ISKAGSKDVSSSLQLENPKMSVVSKYGEQEKTSNSADFYRNHAAYF

KMSFELKQKDKSETINPGDTFVLQLDRRLNPKGISQDIPKIIYDSE

NSPLATGKYDAKTHQLTYTETNYIAGLDKVQLSAELSLFLENKEVL

ENTNISDFKSTIGGQEITYKGTVNVLYGNESTKESNYITNGLSNVG

GSIESYNTETGEFVWYVYVNPNRTNIPYAVLNLWGFAKRTAQGEND

NSSVSSAQLTGYDIYEVPHNYRLPTSYGVDISRLNLRKDLEAKLPQ

GSTQGANKRLRIDFGENLQGKAFVVKVTGKADQSGKELIVQSHLSS

PNNWGSYKTLRPNSHVSETNEIALSPSKGSGSGTSEETKPAITVAN

LKRVAQLRFKKVSTDNVPLPEAAFELRSSNGNSQKLEASSNTQGEI

HPKDLTSGTYDLYETKAPKGYQQVTEKLATVTVDTTKPAEQMVKWE
```

-continued

KPHSFVKVEANKEVTIVNHKETLTFSGKKIWENDRPDQRPAKIQVQ
LLQNGQKMPNQIQEVTKDNDWSYHFKDLPKYDAKNQEYKYSVEEVK
VPDGYKVSYLGNDIFNTRETEFVFEQNNENLEFGNAEIKGQSGSKI
IDEDTLTSFKGKKIWKNDTAENRPQAIQVQLYADGVAVEGQTKFIS
GSGNEWSFEFKNLKKYNGTGNDIIYSVKEVTVPTGYDVTYSANDII
NTKREVITQQGPNLEIEETLPLESGASGGTTTVEDSRSVDTLSGLS
SEQGQSGDMTIEEDSATHIKESKRDIDGKELAGATMELRDSSGKTI
STWISDGQVKDFYLMPGKYTFVETAAPDGYEIATAITFTVNEQGQV
TVNGKATKGDAHIVMVDAYKPTKGSGQVIDIEEKLPDEQGHSGSTT
EIEDSKPSDVIIGGQGEVVDTTEDTQSGMTGHSGSTTEIEDSKSSD
VIIGGQGQVVETTEDTQTGMHGDSGCKTEVEDTKLVQFFHFDNKEP
ESNSEIPKKDKPKSNTSLPATGEKQHNKFFWMVTSCSLISSVFVIS
LKSKKRLLSC

SpyoM01000149 contains an amino acid motif indicative of a cell wall anchor: SEQ ID NO:180 LPATG (shown in italics in SEQ ID NO:250, above). In some recombinant host cell systems, it may be preferable to remove this motif to facilitate secretion of a recombinant SpyoM01000149 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

Two pilin motifs, discussed above, containing conserved lysine (K) residues have also been identified in SpyoM01000149. The pilin motif sequences are underlined in SEQ ID NO:250, below. Conserved lysine (K) residues are also marked in bold, at amino acid residues 157 and 163, and 216 and 224. The pilin sequences, in particular the conserved lysine residues, are thought to be important for the formation of oligomeric, pilus-like structures. Preferred fragments of SpyoM01000149 include at least one conserved lysine residue. Preferably, fragments include at least one pilin sequence.

SEQ ID NO: 250

MTQKNSYKLSFLLSLTGFILGLLLVFIGLSGVSVGHAETRNGANKQ
GYFEIKKVDQNNKPLSGATFSLTPKDGKGKPVQTFTSSEEGIIDAQ
NLQPGTYTLKEETAPDGYDKTSRTWTVTVYENGYTKLVENPYNGEI
ISKAGSKDVSSSLQLENPKMSVVSKYGEQEKTSNSADFYRNHAAYF
KMSFELKQKDKSETINPGDTFVLQLDRRLNPKGISQDIPKIIYDSE
NSPLATGKYDAKTHQLTYTFTNYIAGLDKVQLSAELSLFLENKEVL
ENTNISDFKSTIGGQEITYKGTVNVLYGNESTKESNYITNGLSNVG
GSIESYNTETGEFVWYVYVNPNRTNIPYAVLNLWGFAKRTAQGEND
NSSVSSAQLTGYDIYEVPHNYRLPTSYGVDISRLNLRKDLEAKLPQ
GSTQGANKRLRIDFGENLQGKAFVVKVTGKADQSGKELIVQSHLSS
FNNWGSYKTLRPNSHVSFTNEIALSPSKGSGSGTSEFTKPAITVAN
LKRVAQLRFKKVSTDNVPLPEAAFELRSSNGNSQKLEASSNTQGEI

-continued

HFKDLTSGTYDLYETKAPKGYQQVTEKLATVTVDTTKPAEQMVKWE
KPHSFVKVEANKEVTIVNHKETLTFSGKKIWENDRPDQRPAKIQVQ
LLQNGQKMPNQIQEVTKDNDWSYHFKDLPKYDAKNQEYKYSVEEVK
VPDGYKVSYLGNDIENTRETEFVFEQNNENLEFGNAEIKGQSGSKI
IDEDTLTSFKGKKIWKNDTAENRPQAIQVQLYADGVAVEGQTKFIS
GSGNEWSFEFKNLKKYNGTGNDIIYSVKEVTVPTGYDVTYSANDII
NTKREVITQQGPNLEIEETLPLESGASGGTTTVEDSRSVDTLSGLS
SEQGQSGDMTIEEDSATHIKESKRDIDGKELAGATMELRDSSGKTI
STWISDGQVKDFYLMPGKYTFVETAAPDGYEIATAITFTVNEQGQV
TVNGKATKGDAHIVMVDAYKPTKGSGQVIDIEEKLPDEQGHSGSTT
EIEDSKPSDVIIGGQGEVVDTTEDTQSGMTGHSGSTTEIEDSKSSD
VIIGGQGQVVETTEDTQTGMHGDSGCKTEVEDTKLVQFFHFDNKEP
ESNSEIPKKDKPKSNTSLPATGEKQHNKFFWMVTSCSLISSVFVIS
LKSKKRLLSC

Two E boxes containing conserved glutamic residues have been identified in SpyoM01000149. The E-box motifs are underlined in SEQ ID NO:250, below. The conserved glutamic acid (E) residues, at amino acid residues 329 and 668, are marked in bold. The E box motifs, in particular the conserved glutamic acid residues, are thought to be important for the formation of oligomeric pilus-like structures of SpyoM01000149. Preferred fragments of SpyoM01000149 include at least one conserved glutamic acid residue. Preferably, fragments include at least one E box motif

SEQ ID NO: 250

MTQKNSYKLSFLLSLTGFILGLLLVFIGLSGVSVGHAETRNGANKQ
GYFEIKKVDQNNKPLSGATFSLTPKDGKGKPVQTFTSSEEGIIDAQ
NLQPGTYTLKEETAPDGYDKTSRTWTVTVYENGYTKLVENPYNGEI
ISKAGSKDVSSSLQLENPKMSVVSKYGEQEKTSNSADFYRNHAAYF
KMSFELKQKDKSETINPGDTFVLQLDRRLNPKGISQDIPKIIYDSE
NSPLAIGKYDAKTHQLTYTFTNYIAGLDKVQLSAELSLFLENKEVL
ENTNISDFKSTIGGQEITYKGTVNVLYGNESTKESNYITNGLSNVG
GSIESYNTETGEFVWYVYVNPNRTNIPYAVLNLWGFAKRTAQGEND
NSSVSSAQLTGYDIYEVPHNYRLPTSYGVDISRLNLRKDLEAKLPQ
GSTQGANKRLRIDFGENLQGKAFVVKVTGKADQSGKELIVQSHLSS
FNNWGSYKTLRPNSHVSFTNEIALSPSKGSGSGTSEFTKPAITVAN
LKRVAQLRFKKVSTDNVPLPEAAFELRSSNGNSQKLEASSNTQGEI
HFKDLTSGTYDLYETKAPKGYQQVTEKLATVTVDTTKPAEQMVKWE
KPHSFVKVEANKEVTIVNHKETLTFSGKKIWENDRPDQRPAKIQVQ
LLQNGQKMPNQIQEVTKDNDWSYHFKDLPKYDAKNQEYKYSVEEVK
VPDGYKVSYLGNDIFNTRETEFVFEQNNFNLEFGNAEIKGQSGSKI
IDEDTLTSFKGKKIWKNDTAENRPQAIQVQLYADGVAVEGQTKFIS
GSGNEWSFEFKNLKKYNGTGNDIIYSVKEVTVPTGYDVTYSANDII

-continued

NTKREVITQQGPNLEIEETLPLESGASGGTTTVEDSRSVDTLSGLS

SEQGQSGDMTIEEDSATHIKFSKRDIDGKELAGATMELRDSSGKTI

STWISDGQVKDFYLMPGK<u>YTFVETAAPDGY</u>EIATAITFTVNEQGQV

TVNGKATKGDAHIVMVDAYKPTKGSGQVIDIEEKLPDEQGHSGSTT

EIEDSKPSDVIIGGQGEVVDTTEDTQSGMTGHSGSTTEIEDSKSSD

VIIGGQGQVVETTEDTQTGMHGDSGCKTEVEDTKLVQFFHFDNKEP

ESNSEIPKKDKPKSNTSLPATGEKQHNKFFWMVTSCSLISSVFVIS

LKSKKRLLSC

As discussed above, applicants have also determined the nucleotide and encoded amino acid sequence of fimbrial structural subunits in several other GAS AI-3 strains of bacteria. Examples of sequences of these fimbrial structural subunits are set forth below.

M3 strain isolate ISS 3040 is a GAS AI-3 strain of bacteria. ISS3040_fimbrial is thought to be a fimbrial structural subunit of M3 strain isolate ISS 3040. An example of a nucleotide sequence encoding the ISS3040_fimbrial protein (SEQ ID NO:263) and an ISS3040_fimbrial protein amino acid sequence (SEQ ID NO:264) are set forth below.

SEQ ID NO: 263

```
gagacggcaggagtgtccgaaaatgcaaaattaatagtaaaaaaga
catttgactcttatacagacaatgaagttttaatgccaaaagctga
ttatacttttaaagtagaggcagatagtacagctagtggcaaaacg
aaagacggtttagagattaagccaggtattgttaatggtttaacag
aacagattaccagctatactaatactgataaaccagatagtaaagt
taaaagtacagagtttgattttcaaaagtagtattccctggtatt
ggtgtttaccgctatactgtttcagaaaaacaaggtgatgttgaag
gaattacctacgatactaagaagtggacagtagatgtttatgttgg
aaacaaagaaggtggtggttttgaacctaagtttattgtatctaag
gaacaaggaacagacgtcaaaaaaccagttaattttaacaactcgt
ttgcaactacttcgttaaaagttaagaagaatgtatcggggaatac
tggagaattgcaaaaagaatttgactttacattgacgcttaatgaa
agcacgaattttaaaaagatcaaattgtttcttacaaaaggaa
acgagaaatttgaagttaagattggtactccctacaagtttaaact
caaaaatggggaatctattcaactagacaagttaccagttggtatt
acttataaagtcaatgaaatggaagctaataaagatgggtataaaa
caacagcatccttgaaagagggagatggtcaatctaaaatgtatca
attggatatggaacaaaaaacagacgaatctgctgacgaaatcgtt
gtcacaaataagcgtgacactcaagttccaactggtgttgtaggca
cccttgctccatttgcagttcttagc
```

SEQ ID NO: 264

```
ETAGVSENAKLIVKKTEDSYTDNEVLMPKADYTEKVEADSTASGKT
KDGLEIKPGIVNGLTEQIISYTNTDKPDSKVKSTEEDFSKVVFPGI
GVYRTVSEKQGDVEGITYDTKKWTVDVYVGNKEGGGFEPKFIVSKE
QGTDVKKPVNFNNSFATTSLKVKKNVSGNTGELQKEFDFTLTLNES
TNFKKDQIVSLQKGNEKFEVKIGTPYKFKLKNGESIQLDKLPVGIT
YKVNEMEANKDGYKTTASLKEGDGQSKMYQLDMEQKTDESADEIVV
TNKRDTQVPTGVVGTLAPFAVLS
```

M44 strain isolate ISS 3776 is a GAS AI-3 strain of bacteria. ISS3776_fimbrial is thought to be a fimbrial structural subunit of M44 isolate ISS 3776. An example of a nucleotide sequence encoding the ISS3776_fimbrial protein (SEQ ID NO:253) and an ISS3776_fimbrial protein amino acid sequence (SEQ ID NO:254) are set forth below.

SEQ ID NO: 253

```
ttggagagagaaaaaatgaaaaaaaacaaattattacttgctactg
caatcttagcaactgctttaggaacagcttctttaaatcaaaacgt
aaaagctgagacggcaggggttgtaacaggaaaatcactacaagtt
acaaagacaatgacttatgatgatgaagaggtgttaatgcccgaaa
ccgcctttacttttactatagagcctgatatgactgcaagtggaaa
agaaggcagcctagatattaaaaatggaattgtagaaggcttagac
aaacaagtaacagtaaaatataagaatacagataaaacatctcaaa
```

-continued

```
aaactaaaatagcacaatttgattttctaaggttaaatttccagc
tataggtgtttaccgctatatggtttcagagaaaaacgataaaaaa
gacggaattacgtacgatgataaaaagtggactgtagatgtttatg
ttgggaataaggccaataacgaagaaggtttcgaagttctatatat
tgtatcaaaagaaggtacttctagtactaaaaaaccaattgaattt
acaaactctattaaaactacttccttaaaaattgaaaaacaaataa
ctggcaatgcaggagatcgtaaaaaatcattcaacttcacattaac
attacaaccaagtgaatattataaaactggatcagttgtgaaaatc
gaacaggatggaagtaaaaaagatgtgacgataggaacgccttaca
aatttactttgggacacggtaagagtgtcatgttatcgaaattacc
aattggtatcaattactatcttagtgaagacgaagcgaataaagac
ggctacactacaacggcaacattaaaagaacaaggcaaagaaaaga
gttccgatttcactttgagtactcaaaaccagaaaacagacgaatc
tgctgacgaaatcgttgtcacaaataagcgtgacactcaagttcca
actggtgttgtagggacccttgctccatttgcagttcttagcattg
tggctattggtggagttatctatattacaaaacgtaaaaaagctta
a
```

SEQ ID NO: 254

```
MEREKMKKNKLLLATAILATALGTASLNQNVKAETAGVVTGKSLQV
TKTMTYDDEEVLMPETAFTFTIEPDMTASGKEGSLDIKNGIVEGLD
KQVTVKYKNTDKTSQKTKIAQFDFSKVKFPAIGVYRYMVSEKNDKK
DGTTYDDKKWTVDVYVGNKANNEEGFEVLYIVSKEGTSSTKKPIEF
TNSIKTTSLKIEKQITGNAGDRKKSFNFTLTLQPSEYYKTGSVVKI
EQDGSKKDVTIGTPYKFTLGHGKSVMLSKLPIGINYYLSEDEANKD
GYTTTATLKEQGKEKSSDFTLSTQNQKTDESADEIVVTNKRDTQVP
TGVVGTLAPFAVLSIVAIGGVIYTTKRKKA
```

M77 strain isolate ISS4959 is a GAS AI-3 strain of bacteria. ISS4959_fimbrial is thought to be a fimbrial structural subunit of M77 strain ISS 4959. An example of a nucleotide sequence encoding the ISS4959_fimbrial protein (SEQ ID NO:271) and an ISS4959_fimbrial protein amino acid sequence (SEQ ID NO:272) are set forth below.

SEQ ID NO: 271

```
gtaacagtaaaatataagaatacagataaaacatctcaaaaaacta
aaatagcacaatttgattttctaaggttaaatttccagctatagg
tgtttaccgctatatggtttcagagaaaaacgataaaaaagacgga
attacgtacgatgataaaaagtggacngtagatgtttatgttggga
ataaggccaataacgaagaaggtttcgaagttctatatattgtatc
aaaagaaggtacttctagtnctaaaaaaccaattgaatttacaaac
tctattaaaactacttccttaaaaattgaaaaacaaataactggca
atgcaggagatcgtaaaaaatcattcaacttcacattnacattaca
nccaagtgaatattataaaactggatcagttgtgaaaatcgaacag
gatggaagtaaaaaagatgtgacgataggaacgccttacaaattta
ctttgggacacggtaagagtgtcatgttatcgaaattnccaattgg
tatcaattactatcttagtgaagacgaagcgaataaagacggntac
actacancggcaacattaaaagaacaaggcaaagaaaaagagttccg
atttcactttgagtactcaaaaccagaaaacagacgaatctgctg
```

SEQ ID NO: 272

```
VTVKYKNTDKTSQKTKIAQFDFSKVKFPAIGVYRYMVSEKNDKKDG
ITYDDKKWTVDVYVGNKANNEEGREVLYIVSKEGTSSXKKPIEFTN
SIKTTSLKIEKQITGNAGDRKKSENFTXTLXPSEYYKTGSVVKIEQ
DGSKKDVTIGTPYKFTLGHGKSVNLSKXPIGINYYLSEDEANKDGY
TTXATLKEQGKEKSSDFTLSTQNQKTDESA
```

Examples of GAS AI-sequences from M12 strain isolate A735 are set forth below.

19224133 is thought to be a RofA regulatory protein. An example of a nucleotide sequence encoding the RofA regulatory protein (SEQ ID NO:104) and a RofA regulatory protein amino acid sequence (SEQ ID NO:105) are set forth below.

SEQ ID NO: 104

```
ATGACCATCCAAAAAAGGATGATATCTTGCCAATTTACACATCCTT
CTAAAGAAACTTATCTTTACCAACTCTATGCATCATCTAATGTCTT
ACAATTACTAGCGTTTTTAATAAAAAATGGTTCCCACTCTCGTCCC
CTTACGGATTTTGCAAGAAGTCATTTTTTATCAAACTCCTCAGCTT
ATCGGATGCGCGAAGCATTGATTCCTTTATTAAGAAACTTTGAATT
AAAACTCTCTAAGAACAAGATTGTCGGTGAGGAATATCGTATCCGT
TACCTCATCGCTCTGCTATATAGTAAGTTTGGCATTAAAGTTTATG
ACTTGACGCAGCAAGACAAAAACATTATTCATAGCTTTTTATCCCA
```

-continued

TAGTTCCACCCACCTTAAAACTTCTCCTTGGTTATCGGAATCGTTT
TCTTTCTATGACATTTTATTAGCTTTATCGTGGAAGCGGCATCAAT
TTTCGGTAACTATTCCCCAAACCAGAATTTTTCAACAATTAAAAAA
ACTTTTTGTCTACGATTCTTTGAAAAAAAGTAGCCGTGATATTATC
GAAACTTACTGCCAACTAAACTTTTCAGCAGGAGATTTGGACTACC
TCTATTTAATTTATATCACCGCTAATAATTCTTTTGCGAGCTTACA
ATGGACACCTGAGCATATCAGACAATGTTGTCAACTTTTTGAAGAA
AATGATACTTTTCGCCTGCTTTTAAATCCTATCATCACTCTTTTAC
CTAACCTAAAAGAGCAAAAGGCTAGTTTAGTAAAAGCTCTTATGTT
TTTTTCAAAATCATTCTTGTTTAATCTGCAACATTTTATTCCTACA
GATTCTTTCCCAAGGTATTTCTCGGATAAAAGCATTGATTTTCATT
CCTATTATCTATTGCAAGATAATGTTTATCAAATTCCTGATTTAAA
GCCAGATTTGGTCATCACTCACAGTCAACTGATTCCTTTTGTTCAC
CATGAACTTACAAAAGGAATTGCTGTTGCTGAAATATCTTTTGATG
AATCGATTCTGTCTATCCAAGAATTGATGTATCAAGTTAAAGAGGA
AAAATTCCAAGCTGATTTAACCAAACAATTAACATAA

SEQ ID NO: 105

MTIQKRMISCQFTHPSKETYLYQLYASSNVLQLLAFLIKNGSHSRP
LTDFARSHFLSNSSAYRMREALIPLLRNFELKLSKNKIVGEEYRIR
YLIALLYSKFGIKVYDLTQQDKNIIHSFLSHSSTHLKTSPWLSESF
SFYDILLALSWKRHQFSVTIPQTRIFQQLKKLFVYDSLKKSSRDII
ETYCQLNFSAGDLDYLYLIYITANNSFASLQWTPEHIRQCCQLFEE
NDTFRLLLNPIITLLPNLKEQKASLVKALMFFSKSFLFNLQHFIPE
TNLFVSPYYKGNQKLYTSLKLIVEEWMAKLPGKRYLNHKHFHLFCH
YVEQILRNIQPPLVVVFVASNFINAHLLTDSFPRYFSDKSIDFHSY
YLLQDNVYQIPDLKPDLVITHSQLIPFVHHELTKGTAVAEISFDES
TLSIQELMYQVKEEKFQADLTKQLT 19224134 is thought to be a protein F fibronectin binding protein. An example of a nucleotide sequence encoding the protein F fibronectin binding protein (SEQ ID NO:106) and a protein F fibronectin binding protein amino acid sequence (SEQ ID NO:107) are set forth below.

SEQ ID NO: 106

ATGGTAAGCTCATATATGTTTGCGAGAGGAGAGAAAATGAATAACA
AAATGTTTTTGAACAAAGAAGCCGGTTTTTTGGTACACACAAAAAG
AAAAAGGCGATTTGCTGTCACTTTAGTGGGAGTCTTTTTTCTGCTT
TTGGCATGTGCGGGTGCTATCGGTTTTGGTCAAGTAGCCTATGCTG
CGGATGAGAAGACTGTGCCGAATTTTAAAAGCCCAGATCCAGATTA
TCCCTGGTATGGTTATGATTCGTATAGAGGAATATTTGCAAGATAT
CACAATTTAAAAGTAAATCTAAAAGGAAGTAAGGAGTATCAAGCGT
ATTGTTTTAACCTAACAAAATACTTTCCTCGCCCCACTTATAGTAC
TACAAATAATTTTTACAAGAAAATTGATGGGAGTGGATCAGCGTTC
AAATCTTATGCAGCGAATCCTAGGGTTTTAGATGAGAATTTAGATA
AATTAGAAAAAAATATACTGAATGTAATTTATAATGGATATAAAAG
TAATGCAAATGGTTTTATGAATGGTATAGAAGATCTTAATGCTATA
CTAGTAACTCAAAACGCTATTTGGTACTATTCAGATAGTGCTCCAT
TAAATGATGTTAATAAAATGTGGGAAAGAGAGGTTCGGAATGGGGA
GATTAGTGAGTCACAAGTTACTTTAATGCGTGAGGCATTGAAAAAA
CTAATTGATCCCAATTTAGAAGCTACTGCAGCTAATAAAATCCCAT
CAGGATATCGTTTAAATATCTTTAAGTCTGAAAATGAAGATTACCA
AAATCTTTTAAGTGCTGAATATGTACCTGATGATCCCCCTAAACCT
GGTGATACGTCAGAACATAATCCTAAAACTCCCGAGTTGGATGGCA
CTCCAATTCCCGAGGACCCAAAACGTCCAGATGAGAGTTCAGAACC
TGCGCTTCCCCCATTAATGCCAGAGCTAGATGGTGAAGAAGTCCCA
GAAGTTCCAAGCGAGAGCTTAGAACCTGCGCTTCCCCCATTGATGC
CAGAGCTAGATGGTGAAGAAGTCCCAGAAGTTCCAAGCGAGAGCTT
AGAACCTGCGCTTCCCCCATTGATGCCAGAGCTAGATGGTGAAGAA
GTCCCAGAAGTTCCAAGCGAGAGCTTAGAACCTGCGCTTCCCCCAT
TAATGCCAGAGCTAGATGGTGAAGAAGTCCCAGAAGTTCCAAGCGA
GAGCTTAGAACCTGCGCTTCCCCCATTGATGCCAGAGTTAGATGGT
GAAGAAGTCCCTGAAAAACCTAGTGTTGACTTACCTATTGAAGTTC
CTCGTTATGAGTTTAACAATAAAGACCAGTCACCTCTAGCGGGTGA
GTCTGGTGAGACGGAGTATATTACCGAAGTCTATGGAAATCAACAG
AACCCTGTTGATATTGATAAAAAACTTCCGAATGAAACAGGTTTTT
CAGGAAATATGGTTGAGACAGAAGATACGAAAGAGCCAGAAGTGTT
GATGGGAGGTCAAAGTGAGTCTGTTGAATTTACTAAAGACACTCAA
ACAGGCATGAGTGGTCAAACAACTCCTCAGGTTGAGACAGAAGATA
CGAAAGAGCCAGAAGTGTTGATGGGAGGTCAAAGTGAGTCTGTTGA
ATTTACTAAAGACACTCAAACAGGCATGAGTGGTCAAACAACTCCT
CAGGTTGAGACAGAAGATACGAAAGAGCCAGGAGTGTTGATGGGAG
GCCAAAGTGAGTCTGTTGAATTTACTAAAGACACTCAAACAGGCAT
GAGTGGTCAAACAACTCCTCAGGTTGAGACAGAAGACACGAAAGAG
CCAGGAAATCGGGAAAAGCCTACAAAAAATATAACACCTATCCTTC
CTGCAACAGGAGATATTGAGAATGTTTTGGCCTTTCTTGGAATCCT
TATTTTGTCAGTACTTTCTATTTTTAGCCTTTTAAAAACAAACAAA
ACAATAAAGTCTGA

-continued

SEQ ID NO: 107

MVSSYMFARGEKMNNKMELNKEAGELVHTKRKRRFAVTLVGVFFLL
LACAGAIGEGQVAYAADEKTVPNFKSPDPDYPWYGYDSYRGIFARY
HNLKVNLKGSKEYQAYCFNLTKYFPRPTYSTTNNFYKKIDGSGSAF
KSYAANPRVLDENLDKLEKNILNVIYNGYKSNANGFMNGIEDLNAI
LVTQNAIWYYSDSAPLNDVNKMWEREVRNGEISESQVTLMREALKK
LTDPNLEATAANKIPSGYRLNIFKSENEDYQNLLSAEYVPDDPPKP
GDTSEHNPKTPELDGTPIPEDPKRPDESSEPALPPLMPELDGEEVP
EVPSESLEPALPPLMPELDGEEVPEVPSESLEPALPPLMPELDGEE
VPEVPSESLEPALPPLMPELDGEEVPEVPSESLEPALPPLMPELDG
EEVPEKPSVDLPIEVPRYEFNNKDQSPLAGESGETEYITEVYGNQQ
NPVDIDKKLPNETGFSGNMVETEDTKEPEVLMGGQSESVEFTKDTQ
TGMSGQTTPQVETEDTKEPEVLMGGQSESVEETKDTQTGMSGQTTP
QVETEDTKEPGVLMGGQSESVEFTKDTQTGMSGQTTPQVETEDTKE
PGVLMGGQSESVEFTKDTQTGMSFFSETVTIVEDTRPKLVEHEDNN
EPKVEENREKPTKNITPILPATGDIENVLAFLGILILSVLSIFSLL
KNKQNNKV 19224134 contains an amino acid motif indicative of a cell wall anchor: SEQ ID NO:181 LPATG (shown in italics in SEQ ID NO:107, above). In some recombinant host cell systems, it may be preferable to remove this motif to facilitate secretion of a recombinant 19224134 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in 19224134. The pilin motif sequence is underlined in SEQ ID NO:107, below. Conserved lysine (K) residues are also marked in bold, at amino acid residues 275, 285, and 299. The pilin sequence, in particular the conserved lysine residues, are thought to be important for the formation of oligomeric, pilus-like structures. Preferred fragments of 19224134 include at least one conserved lysine residue. Preferably, fragments include the pilin sequence.

SEQ ID NO: 107

MVSSYMFARGEKMNNKMFLNKEAGFLVHTKRKRRFAVTLVGVFFLL

LACAGAIGFGQVAYAADEKTVPNEKSPDPDYPWYGYDSYRGIFARY

HNLKVNLKGSKEYQAYCFNLTKYFPRPTYSTTNNFYKKIDGSGSAF

KSYAANPRVLDENLDKLEKNILNVIYNGYKSNANGFMNGIEDLNAI

LVTQNAIWYYSDSAPLNDVNKMWEREVRNGEISESQVTLMREALKK

LIDPNLEATAANKIPSGYRLNIFKSENEDYQNLLSAEYVPDDPPKP

GDTSEHNPKTPELDGTPIPEDPKRPDESSEPALPPLMPELDGEEVP

EVPSESLEPALPPLMPELDGEEVPEVPSESLEPALPPLMPELDGEE

VPEVPSESLEPALPPLMPELDGEEVPEVPSESLEPALPPLMPELDG

EEVPEKPSVDLPIEVPRYEFNNKDQSPLAGESGETEYITEVYGNQQ

NPVDIDKKLPNETGFSGNMVETEDTKEPEVLMGGQSESVEFTKDTQ

TGMSGQTTPQVETEDTKEPEVLMGGQSESVEFTKDTQTGMSGQTTP

QVETEDTKEPGVLMGGQSESVEFTKDTQTGMSGQTTPQVETEDTKE

PGVLMGGQSESVEFTKDTQTGMSGFSETVTIVEDTRPKLVFHFDNN

EPKVEENREKPTKNITPILPATGDIENVLAFLGILILSVLSIFSLL

KNKQNNKV

Two E boxes containing conserved glutamic residues have been identified in 19224134. The E-box motifs are underlined in SEQ ID NO:107, below. The conserved glutamic acid (E) residues, at amino acid residues 487 and 524, are marked in bold. The E box motifs, in particular the conserved glutamic acid residues, are thought to be important for the formation of oligomeric pilus-like structures of 19224134. Preferred fragments of 19224134 include at least one conserved glutamic acid residue. Preferably, fragments include at least one E box motif.

SEQ ID NO: 107

MVSSYMFARGEKMNNKMFLNKEAGFLVHTKRKRRFAVTLVGVFFLL
LACAGAIGFGQVAYAADEKTVPNEKSPDPDYPWYGYDSYRGIFARY
HNLKVNLKGSKEYQAYCFNLTKYFPRPTYSTTNNFYKKIDGSGSAF
KSYAANPRVLDENLDKLEKNILNVIYNGYKSNANGFMNGIEDLNAI
LVTQNAIWYYSDSAPLNDVNKMWEREVRNGEISESQVTLMREALKK
LIDPNLEATAANKIPSGYRLNIFKSENEDYQNLLSAEYVPDDPPKP
GDTSEHNPKTPELDGTPIPEDPKRPDESSEPALPPLMPELDGEEVP
EVPSESLEPALPPLMPELDGEEVPEVPSESLEPALPPLMPELDGEE
VPEVPSESLEPALPPLMPELDGEEVPEVPSESLEPALPPLMPELDG
EEVPEKPSVDLPIEVPRYEFNNKDQSPLAGESGETEYITEVYGNQQ
NPVDIDKKLPNETGFSGNMVETEDTKEPEVLMGGQSESVEFTKDTQ
TGMSGQTTPQVETEDTKEPEVLMGGQSESVEFTKDTQTGMSGQTTP
QVETEDTKEPGVLMGGQSESVEFTKDTQTGMSGQTTPQVETEDTKE
PGVLMGGQSESVEFTKDTQTGMSGFSETVTIVEDTRPKLVFHFDNN
EPKVEENREKPTKNITPILPATGDIENVLAFLGILILSVLSIFSLL
KNKQNNKV 19224135 is thought to be a capsular polysaccharide adhesin (Cpa) protein. An example of a nucleotide sequence encoding the Cpa protein (SEQ ID NO:108) and a Cpa protein amino acid sequence (SEQ ID NO:109) are set forth below.

SEQ ID NO: 108

ATGAATAACAAAAAAATTGCAAAAGAAGCAAGATGCTCCTCGGGTAT
CAAACAGAAAGCCAAAACAATTAACTGTCACTTTAGTGGGAGTATT
TTTAATGTTTTTGACCTTGGTAAGTTCCATGAGAGGTGCTCAAAGC
ATATTTGGAGAGGAAAAGAGAATTGAAGAAGTCAGTGTTCCTAAAA
TAAAAAGTCCAGATGATGCCTACCCTTGGTATGGCTATGATTCATA
TGACTCTAGTCATCCTTACTATGAACGTTTTAAAGTAGCACATGAT
TTAAGGGTTAATTTAAATGGAAGTAAGAGCTACCAAGTATATTGCT
TTAATATCAATTCTCATTATCCGAATAGAAAAAATGCTTTTTCTAA
ACAATGGTTTAAGAGAGTTGATGGGACAGGTGATGTGTTCACAAAT
TATGCTCAGACACCTAAGATTCGTGGAGAATCATTGAATAATAAAC
TTTTAAGTATTATGTACAACGCTTATCCTAAAAATGCTAATGGCTA
TATGGATAAGATAGAACCATTAAATGCTATTTTAGTAACTCAACAA
GCTGTTTGGTACTATTCTGACAGTTCTTATGGTAATATAAAAACGT
TATGGGCATCTGAGCTTAAAGACGGAAAAATAGATTTTGAACAAGT
AAAATTAATGCGTGAAGCTTACTCAAAACTAATTAGTGATGATTTA
GAAGAAACATCTAAAAATAAGCTACCTCAAGGATCTAAACTGAATA
TTTTTGTTCCGCAAGATAAATCTGTTCAAAATTTATTAAGTGCAGA
GTACGTGCCTGAATCCCCTCCGGCACCAGGTCAGTCTCCAGAACCG
CCAGTGCAAACAAAAAAAACATCAGTCATTATCAGAAAATATGCGG
AAGGTGACTACTCTAAACTTCTAGAGGGAGCAACTTTGCGTTTAAC
AGGGGAAGATATCCTAGATTTTCAAGAAAAAGTCTTCCAAAGTAAT
GGAACAGGAGAAAAGATTGAATTATCAAATGGGACTTATACCTTAA
CAGAAACATCATCTCCAGATGGATATAAAATTGCGGAGCCGATTAA
GTTTAGAGTAGTGAATAAAAAAGTATTTATCGTCCAAAAAGATGGT
TCTCAAGTGGAAAATCCAAACAAAGAAGTAGCAGAGCCATACTCAG
TGGAAGCGTACAGCGATATGCAAGATAGTAACTATATTAATCCAGA
AACGTTCACTCCTTATGGGAAATTTTATTACGCTAAAAATAAGGAT
AAAAGTTCACAAGTTGTCTACTGTTTTAATGCTGATTTACACTCTC

-continued

CACCTGAATCAGAGGATGGGGGAGGAACTATAGATCCTGATATTAG
TACGATGAAAGAAGTCAAGTACACACATACGGCAGGTAGTGATTTG
TTTAAATACGCGCTAAGACCGAGAGATACAAATCCAGAAGACTTCT
TAAAGCACATTAAAAAAGTAATTGAAAAAGGCTACAATAAAAAAGG
TGATAGCTATAATGGATTAACAGAAACACAGTTTCGCGCGGCTACT
CAGCTTGCTATCTATTACTTTACAGACAGCACTGACTTAAAAACCT
TAAAAACTTATAACAATGGGAAAGGTTACCATGGATTTGAATCTAT
GGATGAAAAAACCCTAGCTGTAACAAAAGAATTAATTAATTACGCT
CAAGATAATAGTGCCCCTCAACTAACAAATCTTGATTTCTTCGTAC
CTAATAATAGCAAATACCAATCTCTTATTGGGACAGAATACCATCC
AGATGATTTGGTTGACGTGATTCGTATGGAAGATAAAAAGCAAGAA
GTTATTCCAGTAACTCACAGTTTGACAGTGAAAAAAACAGTAGTCG
GTGAGTTGGGAGATAAAACTAAAGGCTTCCAATTTGAACTTGAGTT
GAAAGATAAAACTGGACAGCCTATTGTTAACACTCTAAAAACTAAT
AATCAAGATTTAGTAGCTAAAGATGGGAAATATTCATTTAATCTAA
AGCATGGTGACACCATAAGAATAGAAGGATTACCGACGGGATATTC
TTATACTCTGAAAGAGACTGAAGCTAAGGATTATATAGTAACCGTT
GATAACAAAGTTAGTCAAGAAGCTCAATCAGCAAGTGAGAATGTCA
CAGCAGACAAAGAAGTCACTTTTGAAAACCGTAAAGATCTTGTCCC
ACCAACTGGTTTTATTACTGATGGTGGAACCTATGTGTGGTTATTA
TTGCTTGTCGCATTTGGTTTGTTAGTGTGGTTCTTTGGTGGTAAAG
GACTAAAAAATGACTAA

SEQ ID NO: 109

MNNKKLQKKQDAPRVSNRKPKQLTVTLVGVFLMELTLVSSMRGAQS
IFGEEKRIEEVSVPKIKSPDDAYPWYGYDSYDSSHPYYERFKVAHD
LRVNLNGSKSYQVYCFNINSHYPNRKNAFSKQWFKRVDGTGDVFTN
YAQTPKIRGESLNNKLLSIMYNAYPKNANGYMDKIEPLNAILVTQQ
AVWYYSDSSYGNIKTLWASELKDGKIDFEQVKLMREAYSKLISDDL
EETSKNKLPQGSKLNIFVPQDKSVQNLLSAEYVPESPPAPGQSPEP
PVQTKKTSVIIRKYAEGDYSKLLEGATLRLTGEDILDFQEKVFQSN
GTGEKIELSNGTYTLTETSSPDGYKIAEPIKERVVNKKVFIVQKDG
SQVENPNKEVAEPYSVEAYSDMQDSNYINPETFTPYGKFYYAKNKD
KSSQVVYCFNADLHSPPESEDGGGTIDPDISTMKEVKYTHTAGSDL
EKYALRPRDTNPEDFLKHIKKVTEKGYNKKGDSYNGLTETQFRAAT
QLAIYYFTDSTDLKTLKTYNNGKGYHGFESMDEKTLAVTKELINYA
QDNSAPQLTNLDFFVPNNSKYQSLIGTEYHPDDLVDVIRMEDKKQE
VIPVTHSLTVKKTVVGELGDKTKGFQFELELKDKTGQPIVNTLKTN
NQDLVAKDGKYSFNLKHGDTIRIEGLPTGYSYTLKETEAKDYIVTV
DNKVSQEAQSASENVTADKEVTFENRKDLVPPTGFITDGGTYLWLL
LLVPFGLLVWFFGRKGLKND 19224135 contains an amino acid motif indicative of a cell wall anchor: SEQ ID NO:184 VPPTG (shown in italics in SEQ ID NO:109, above). In some recombinant host cell systems, it may be preferable to remove this motif to facilitate secretion of a recombinant 19224135 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in 19224135. The pilin motif sequence is underlined in SEQ ID NO:109, below. Conserved lysine (K) residues are also marked in bold, at amino acid residues 164 and 172. The pilin sequence, in particular the conserved lysine residues, are thought to be important for the formation of oligomeric, pilus-like structures. Preferred fragments of 19224135 include at least one conserved lysine residue. Preferably, fragments include the pilin sequence.

SEQ ID NO: 109

MNNKKLQKKQDAPRVSNRKPKQLTVTLVGVFLMFLTLVSSMRGAQS
IFGEEKRIEEVSVPKIKSPDDAYPWYGYDSYDSSHPYYERFKVAHD
LRVNLNGSKSYQVYCFNINSHYPNRKNAFSKQWFKRVDGTGDVFTN
YAQTPKIRGESLNNKLLSIMYNAYPKNANGYMDKIEPLNAILVTQQ

-continued

AVWYYSDSSYGNIKTLWASELKDGKIDFEQVKLMREAYSKLISDDL
EETSKNKLPQGSKLNIFVPQDKSVQNLLSAEYVPESPPAPGQSPEP
PVQTKKTSVIIRKYAEGDYSKLLEGATLRLTGEDILDFQEKVFQSN
GTGEKIELSNGTYTLTETSSPDGYKIAEPIKFRVVNKKVFIVQKDG
SQVENPNKEVAEPYSVEAYSDMQDSNYINPETFTPYGKFYYAKNKD
KSSQVVYCFNADLHSPPESEDGGGTIDPDISTMKEVKYTHTAGSDL
FKYALRPRDTNPEDFLKHIKKVIEKGYNKKGDSYNGLTETQFRAAT
QLAIYYFTDSTDLKTLKTYNNGKGYHGFESMDEKTLAVTKELINYA
QDNSAPQLTNLDFFVPNNSKYQSLIGTEYHPDDLVDVIRMEDKKQE
VIPVTHSLTVKKTVVGELGDKTKGFQFELELKDKTGQPIVNTLKTN
NQDLVAKDGKYSFNLKHGDTIRIEGLPTGYSYTLKETEAKDYIVTV
DNKVSQEAQSASENVTADKEVTFENRKDLVPPTGFITDGGTYLWLL
LLVPFGLLVWFFGRKGLKND

An E box containing a conserved glutamic residue has been identified in 19224135. The E-box motif is underlined in SEQ ID NO: 109, below. The conserved glutamic acid (E), at amino acid residue 339, is marked in bold. The E box motif, in particular the conserved glutamic acid residue, is thought to be important for the formation of oligomeric pilus-like structures of 19224135. Preferred fragments of 19224135 include the conserved glutamic acid residue. Preferably, fragments include the E box motif

SEQ ID NO: 109

MNNKKLQKKQDAPRVSNRKPKQLTVTLVGVFLMFLTLVSSMRGAQSIFGE
EKRIEEVSVPKIKSPDDAYPWYGYDSYDSSHPYYERFKVAHDLRVNLNGS
KSYQVYCFNINSHYPNRKNAFSKQWFKRVDGTGDVFTNYAQTPKIRGESL
NNKLLSIMYNAYPKNANGYMDKIEPLNAILVTQQAVWYYSDSSYGNIKTL
WASELKDGKIDFEQVKLMREAYSKLISDDLEETSKNKLPQGSKLNIFVPQ
DKSVQNLLSAEYVPESPPAPGQSPEPPVQTKKTSVIIRKYAEGDYSKLLE
GATLRLTGEDILDFQEKVFQSNGTGEKIELSNGTYTLTETSSPDGYKIAE
PIKFRVVNKKVFIVQKDGSQVENPNKEVAEPYSVEAYSDMQDSNYINPET
FTPYGKFYYAKNKDKSSQVVYCFNADLHSPPESEDGGGTIDPDISTMKEV
KYTHTAGSDLEKYALRPRDTNPEDFLKHIKKVIEKGYNKKGDSYNGLTET
QFRAATQLAIYYFTDSTDLKTLKTYNNGKGYHGFESMDEKTLAVTKELIN
YAQDNSAPQLTNLDFFVPNNSKYQSLIGTEYHPDDLVDVIRMEDKKQEVI
PVTHSLTVKKTVVGELGDKTKGFQFELELKDKTGQPIVNTLKTNNQDLVA
KDGKYSFNLKHGDTIRIEGLPTGYSYTLKETEAKDYIVTVDNKVSQEAQS
ASENVTADKEVTFENRKDLVPPTGFITDGGTYLWLLLLVPFGLLVWFFGR
KGLKND 19224136 is thought to be a LepA protein. An example of a nucleotide sequence encoding the LepA protein (SEQ ID NO:110) and a LepA protein amino acid sequence (SEQ ID NO:111) are set forth below.

SEQ ID NO: 110

ATGACTAATTACCTAAATCGCTTAAATGAGAATCCACTATTTAAAGCTTT
CATACGGTTAGTACTTAAGATTTCTATTATTGGATTTCTAGGTTACATTC
TATTTCAGTATGTTTTTGGCGTCATGATTGTTAACACAAATCAGATGAGT
CCTGCTGTAAGTGCTGGTGATGGAGTCTTATATTATCGTTTGACTGATCG
CTATCATATTAATGATGTGGTGGTCTATGAGGTTGATAACACTTTGAAAG
TTGGTCGAATTGCCGCTCAAGCTGGCGATGAGGTTAGTTTTACGCAAGAA
GGAGGACTGTTGATTAATGGGCATCCACCAGAAAAAGAGGTCCCTTACCT
GACGTATCCTCACTCAAGTGGTCCAAACTTTCCCTATAAAGTTCCTACGG
GTACGTATTTCATATTGAATGATTATCGTGAAGAACGTTTGGACAGTCGT
TATTATGGGGCGTTACCCATCAATCAAATCAAAGGGAAAATCTCAACTCT
ATTAAGAGTGAGAGGAATTTAA

SEQ ID NO: 111

MTNYLNRLNENPLFKAFIRLVLKISIIGFLGYILFQYVEGVMIVNTNQMS
PAVSAGDGVLYYRLTDRYHINDVVVYEVDNTLKVGRIAAQAGDEVSFTQE
GGLLINGHPPEKEVPYLTYPHSSGPNFPYKVPTGTYFILNDYREERLDSR
YYGALPINQIKGKISTLLRVRGI 19224137 is thought to be a fimbrial protein. An example of a nucleotide sequence encoding the fimbrial protein (SEQ ID NO:112) and a fimbrial protein amino acid sequence (SEQ ID NO:113) are set forth below.

SEQ ID NO: 112

ATGAAAAAAAAATAAATTATTACTTGCTACTGCAATCTTAGCAACTGCTTT
AGGAACAGCTTCTTTAAATCAAAACGTAAAAGCTGAGACGGCAGGGGTTG
TTAGCAGTGGTCAATTAACAATAAAAAAATCAATTACAAATTTTAATGAT
GATACACTTTTGATGCCTAAGACAGACTATACTTTTAGCGTTAATCCGGA
TAGTGCGGCTACAGGTACTGAAAGTAATTTACCAATTAAACCAGGTATTG
CTGTTAACAATCAAGATATTAAGGTTTCTTATTCTAATACTGATAAGACA
TCAGGTAAAGAAAAACAAGTTGTTGTTGACTTTATGAAAGTTACTTTTCC
TAGCGTTGGTATTTACCGTTATGTTGTTACCGAGAATAAAGGGACAGCAG
AAGGAGTTACATATGATGATACAAAATGGTTAGTTGACGTCTATGTTGGT
AATAATGAAAAGGGAGGTCTTGAACCAAAGTATATTGTATCTAAAAAAGG
AGATTCTGCTACTAAAGAACCAATCCAGTTTAATAATTCATTCGAAACAA
CGTCATTAAAAATTGAAAAGGAAGTTACTGGTAATACAGGAGATCATAAA
AAAGCATTTACCTTTACATTAACATTGCAACCAAATGAATACTATGAGGC
AAGTTCGGTTGTGAAAATTGAAGAGAACGGACAAACGAAAGATGTGAAAA
TTGGGGAGGCATATAAGTTTACTTGAACGAATAGTCAGAGTGTGATATTG
TCTAAATTACCAGTTGGTATTAATTATAAAGTTGAAGAAGCAGAAGCTAA
TCAAGGTGGATATACTACAACAGCAACTTTAAAAGATGGAGAAAAGTTAT
CTACTTATAACTTAGGTCAGGAACATAAAACAGACAAGACTGCTGATGAA
ATCGTTGTCACAAATAACCGTGACACTCAAGTTCCAACTGGTGTTGTAGG
CACCCTTGCTCCATTTGCAGTTCTTAGCATTGTGGCTATTGGTGGAGTTA
TCTATATTACAAAACGTAAAAAAGCTTAA

-continued

SEQ ID NO: 113

MKKNKLLLATAILATALGTASLNQNVKAETAGVVSSGQLTIKKSITNFND

DTLLMPKTDYTFSVNPDSAATGTESNLPIKPGIAVNNQDIKVSYSNTDKT

SGKEKQVVVDFMKVTFPSVGIYRYVVTENKGTAEGVTYDDTKWLVDVYVG

NNEKGGLEPKYIVSKKGDSATKEPIQFNNSFETTSLKIEKEVTGNTGDHK

KAFTFTLTLQPNEYYEASSVVKIEENGQTKDVKIGEAYKFTLNDSQSVIL

SKLPVGINYKVEEAEANQGGYTTTATLKDGEKLSTYNLGQEHKTDKTADE

IVVTNNRDT*QVPTG*VVGTLAPFAVLSIVAIGGVIYITKRKKA 19224137 contains an amino acid motif indicative of a cell wall anchor: SEQ ID NO:140 QVPTG (shown in italics in SEQ ID NO:113, above). In some recombinant host cell systems, it may be preferable to remove this motif to facilitate secretion of a recombinant 19224137 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in 19224137. The pilin motif sequence is underlined in SEQ ID NO:113, below. A conserved lysine (K) residue is also marked in bold, at amino acid residue 160. The pilin sequence, in particular the conserved lysine residues, are thought to be important for the formation of oligomeric, pilus-like structures. Preferred fragments of 19224137 include the conserved lysine residue. Preferably, fragments include the pilin sequence.

SEQ ID NO: 113

MKKNKLLLATAILATALGTASLNQNVKAETAGVVSSGQLTIKKSITNFND

DTLLMPKTDYTFSVNPDSAATGTESNLPIKPGIAVNNQDIKVSYSNTDKT

SGKEKQVVVDFMKVTFPSVGIYRYVVTENKGTAEGVTYDDIKWLVDVYVG

NNEKGGLEPKYIVSKKGDSATKEPIQFNNSFETTSLKIEKEVTGNTGDHK

KAFTFTLTLQPNEYYEASSVVKIEENGQTKDVKIGEAYKFTLNDSQSVIL

SKLPVGINYKVEEAEANQGGYTTTATLKDGEKLSTYNLGQEHKTDKTADE

IVVTNNRDTQVPTGVVGTLAPFAVLSIVAIGGVIYITKRKKA

An E box containing a conserved glutamic residue has been identified in 19224137. The E-box motif is underlined in SEQ ID NO:113, below. The conserved glutamic acid (E), at amino acid residue 263, is marked in bold. The E box motif, in particular the conserved glutamic acid residue, is thought to be important for the formation of oligomeric pilus-like structures of 19224137. Preferred fragments of 19224137 include the conserved glutamic acid residue. Preferably, fragments include the E box motif

SEQ ID NO: 113

MKKNKLLLATAILATALGTASLNQNVKAETAGVVSSGQLTIKKSITNFND

DTLLMPKTDYTFSVNPDSAATGTESNLPIKPGIAVNNQDIKVSYSNTDKT

SGKEKQVVVDFMKVTFPSVGIYRYVVTENKGTAEGVTYDDTKWLVDVYVG

NNEKGGLEPKYIVSKKGDSATKEPIQFNNSFETTSLKIEKEVTGNTGDHK

KAFTFTLTLQPNEYYEASSVVKIEENGQTKDVKIGEAYKFTLNDSQSVIL

SKLPVGINYKVEEAEANQGGYTTTATLKDGEKLSTYNLGQEHKTDKTADE

IVVTNNRDTQVPTGVVGTLAPFAVLSIVAIGGVIYITKRKKA 19224138 is thought to be a SrtC2-type sortase. An example of a nucleotide sequence encoding the SrtC2 sortase (SEQ ID NO:114) and a SrtC2 sortase amino acid sequence (SEQ ID NO:115) are set forth below.

SEQ ID NO: 114

ATGATGATGACAATTGTACAGGTTATCAATAAAGCCATTGATACTCTCAT

TCTTATCTTTTGTTTAGTCGTACTATTTTTAGCTGGTTTTGGTTTGTGGG

ATTCTTATCATCTCTATCAACAAGCAGACGCTTCTAATTTCAAAAAATTT

AAAACAGCTCAACAACAGCCTAAATTTGAAGACTTGTTAGCTTTGAATGA

GGATGTCATTGGTTGGTTAAATATCCCGGGGACTCATATTGATTATCCTC

TAGTTCAGGGAAAAACGAATTTAGAGTATATTAATAAAGCAGTTGATGGC

AGTGTTGCCATGTCTGGTAGTTTATTTTTAGATACACGGAATCATAATGA

TTTTACGGACGATTACTCTCTGATTTATGGCCATCATATGGCAGGTAATG

CCATGTTTGGCGAAATTCCAAAATTTTTAAAAAAGGATTTTTTCAACAAA

CATAATAAAGCTATCATTGAAACAAAAGAGAGAAAAAAACTAACCGTCAC

TATTTTTGCTTGTCTCAAGACAGATGCCTTTGACCAGTTAGTTTTTAATC

CTAATGCTATTACCAATCAAGACCAACAAAGGCAGCTCGTTGATTATATC

AGTAAAAGATCAAAACAATTTAAACCTGTTAAATTGAAGCATCATACAAA

GTTCGTTGCTTTTTCAACGTGTGAAAATTTTTCTACTGACAATCGTGTTA

TCGTTGTCGGTACTATTCAAGAATAA

SEQ ID NO: 115

MMMTIVQVINKAIDTLILIFCLVVLFLAGFGLWDSYHLYQQADASNFKKF

KTAQQQPKFEDLLALNEDVIGWLNIPGTHIDYPLVQGKTNLEYINKAVDG

SVAMSGSLFLDTRNHNDFTDDYSLIYGHHMAGNAMFGEIPKFLKKDFFNK

HNKAIIETKERKKLTVTIFACLKTDAFDQLVFNPNAITNQDQQRQLVDYI

SKRSKQFKPVKLKHHTKFVAFSTCENFSTDNRVIVVGTIQE 19224139 is an open reading frame that encodes a sortase substrate motif LPXAG shown in italics in SEQ ID NO:117. An example of a nucleotide sequence of the open reading frame (SEQ ID NO:116) and the amino acid sequence encoded by the open reading frame (SEQ ID NO:117) are set forth below.

SEQ ID NO: 116

ATGTTATTTTCTGTCGTAATGATATTAACCATGCTGGCCTTTAATCAGAC

TGTTTTAGCAAAAGACAGCACTGTTCAAACTAGCATTAGTGTCGAAAATG

TCTTAGAGAGAGCAGGCGATAGTACCCCATTTTCGATTGCATTAGAATCA

-continued

ATTGATGCGATGAAAACAATAGAAGAAATAACAATTGCTGGTTCTGGAAA

AGCAAGCTTTTCCCCTCTGACCTTCACAACAGTTGGGCAATATACTTATC

GTGTTTATCAGAAGCCTTCACAAAATAAAGATTATCAAGCAGATACTACT

GTATTTGACGTTCTTGTCTATGTGACCTATGATGAAGATGGGACTCTAGT

CGCAAAAGTTATTTCTCGAAGGGCTGGAGACGAAGAAAAATCAGCGATTA

CTTTTAAGCCCAAACGGTTAGTAAAACCAATACCGCCTAGACAACCTAAC

ATCCCTAAAACCCCATTACCATTAGCTGGTGAAGTAAAAAGTTTATTGGG

TATCTTAAGTATCGTATTACTGGGGTTACTAGTTCTTCTTTATGTTAAAA

AACTGAAGAG

EQ ID NO: 117

MLFSVVMILTMLAFNQTVLAKDSTVQTSISVENVLERAGDSTPFSIALES

IDAMKTIEEITIAGSGKASFSPLTFTTVGQYTYRVYQKPSQNKDYQADTT

VFDVLVYVTYDEDGTLVAKVISRRAGDEEKSAITFKPKRLVKPIPPRQPN

IPKTPLPLAGEVKSLLGILSIVLLGLLVLLYVKKLKSKL 19224139 contains an amino acid motif indicative of a cell wall anchor: SEQ ID NO:185 LPLAG (shown in italics in SEQ ID NO:117, above). In some recombinant host cell systems, it may be preferable to remove this motif to facilitate secretion of a recombinant 19224139 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

A pilin motif, discussed above, containing a conserved lysine (K) residue has also been identified in 19224139. The pilin motif sequence is underlined in SEQ ID NO:117, below. A conserved lysine (K) residue is also marked in bold, at amino acid residue 138. The pilin sequence, in particular the conserved lysine residue, is thought to be important for the formation of oligomeric, pilus-like structures. Preferred fragments of 19224139 include the conserved lysine residue. Preferably, fragments include the pilin sequence.

SEQ ID NO: 117

MLFSVVMILTMLAFNQTVLAKDSTVQTSISVENVLERAGDSTPFSIALES

IDAMKTIEEITIAGSGKASFSPLTFTTVGQYTYRVYQKPSQNKDYQADTT

VFDVLVYVTYDEDGTLVAKVISRRAGDEEKSAITFKPKRLVKPIPPRQPN

IPKTPLPLAGEVKSLLGILSIVLLGLLVLLYVKKLKSKL

Two E boxes containing conserved glutamic residues have been identified in 19224139. The E-box motifs are underlined in SEQ ID NO: 117, below. The conserved glutamic acid (E) residues, at amino acid residues 58 and 128, are marked in bold. The E box motifs, in particular the conserved glutamic acid residues, are thought to be important for the formation of oligomeric pilus-like structures of 19224139. Preferred fragments of 19224139 include at least one conserved glutamic acid residue. Preferably, fragments include at least one E box motif.

SEQ ID NO: 117

MLFSVVMILTMLAFNQTVLAKDSTVQTSISVENVLERAGDSTPFSIALES

IDAMKTIEEITIAGSGKASFSPLTFTTVGQYTYRVYQKPSQNKDYQADTT

VFDVLVYVTYDEDGTLVAKVISRRAGDEEKSAITFKPKRLVKPIPPRQPN

IPKTPLPLAGEVKSLLGILSIVLLGLLVLLYVKKLKSKL 19224140 is thought to be a MsmRL protein. An example of a nucleotide sequence encoding the MsmRL protein (SEQ ID NO:118) and a MsmRL protein amino acid sequence (SEQ ID NO:119) are set forth below.

SEQ ID NO: 118

ATGGTTATATTCGATTTAAAACATGTGCAAACATTACACAGCTTGTCTCA

ATTACCTATTTCAGTGATGTCACAAGATAAGGCACTTATTCAAGTATATG

GTAATGACGACTATTTATTATGTTACTATCAATTTTTAAAGCATCTAGCT

ATTCCTCAAGCTGCACAAGATGTTATTTTTTATGAGGGTTTATTTGAAGA

GTCCTTTATGATTTTTCCTCTTTGTCACTACATTATTGCCATTGGACCTT

TCTACCCTTATTCACTTAATAAAGACTATCAGGAACAATTAGCTAATAAT

TTTTTAAAACATTCTTCTCATCGTAGCAAAGAAGAGCTCTTATCCTATAT

GGCACTTGTCCCACATTTTCCAATTAATAATGTGCGGAACCTTTTGATAG

CTATTGACGCTTTTTTTGACACACAATTTGAGACGACTTGCCAACAAACA

ATTCATCAATTGTTGCAGCATTCAAAACAGATGACTGCTGATCCTGATAT

CATTCATCGCCTTAAGCATATTAGCAAAGCATCTAGCCAACTACCGCCTG

TTTTAGAGCACCTAAATCATATTATGGATCTGGTAAAGCTAGGCAATCCA

CAATTGCTCAAGCAAGAAATCAATCGCATCCCCTTATCAAGTATCACCTC

ATCTTCTATTTCTGCTCTAAGGGCGGAAAAGAACCTCACTGTTATCTATT

TAACTAGGTTACTGGAATTCAGTTTTGTAGAAAATACTGACGTAGCAAAG

CATTATAGCCTTGTCAAATACTACATGGCCTTAAATGAAGAAGCGAGTGA

CTTGCTCAAAGTTTTGAGAATTCGCTGTGCAGCCATCATCCATTTTTCCG

AATCATTAACCAATAAAAGTATTTCTGATAAACGTCAAATGTACAATAGT

GTGCTTCATTATGTCGATAGTCACCTGTATTCCAAATTAAAGGTATCTGA

TATCGCTAAGCGCCTATATGTTTCCGAATCTCACTTACGTTCAGTCTTTA

AAAAATACTCAAATGTTTCCTTACAACATTATATTCTAAGTACAAAAATC

AAAGAAGCTCAACTACTCTTAAAACGAGGAATTCCTGTTGGAGAAGTGGC

TAAAAGCTTATATTTTTATGACACTACCCATTTTCATAAAATCTTTAAAA

AATACACGGGTATTTCTTCAAAAGACTATCTTGCTAAATACCGAGATAAT

ATTTAA

SEQ ID NO: 119

MVIFDLKHVQTLHSLSQLPISVMSQDKALIQVYGNDDYLLCYYQFLKHLA

TPQAAQDVIFYEGLFEESFMIFPLCHYIIAIGPFYPYSLNKDYQEQLANN

FLKHSSHRSKEELLSYMALVPHFPINNVRNLLIAIDAFFDTQFETTCQQT

IHQLLQHSKQMTADPDIIHRLKHISKASSQLPPVLEHLNHIMDLVKLGNP

QLLKQEINRIPLSSITSSSISALRAEKNLTVIYLTRLLEFSFVENTDVAK

HYSLVKYYMALNEEASDLLKVLRIRCAAIIHFSESLTNKSISDKRQMYNS

-continued

VLHYVDSHLYSKLKVSDIAKRLYVSESHLRSVFKKYSNVSLQHYILSTKI

KEAQLLLKRGIPVGEVAKSLYFYDTTHFHKIFKKYTGISSKDYLAKYRDN

I 19224141 is thought to be a protein F2 fibronectin binding protein. An example of a nucleotide sequence encoding the protein F2 fibronectin binding protein (SEQ ID NO:120) and a protein F2 fibronectin binding protein amino acid sequence (SEQ ID NO:121) are set forth below.

SEQ ID NO: 120

ATGACACAAAAAAAATAGCTATAAGTTAAGCTTCCTGTTATCCCTAACAGG

ATTTATTTTAGGTTTATTATTGGTTTTTATAGGATTGTCCGGAGTATCAG

TAGGACATGCGGAAACAAGAAATGGAGCAAACAAACAAGGATCTTTTGAA

ATCAAGAAAGTCGAGCAAAAGAATAAGGCTTTACCGGGAGCAAGTTTTTC

AGTGACATCAAAGGATGGCAAGGGAACATGTGTTCAAAGGTTGACTTGAA

ATGATAAAGGTATTGTAGATGGTCAAAATCTCGAACCAGGGACTTATAGC

TTAAAAGAAGAAACAGCACCAGATGGTTATGATAAAACCAGCCGGAGTTG

GACAGTGACTGTTTATGAGAACGGCTATAGCAAGTTGGTTGAAAATCCCT

ATAATGGGGAAATCATCAGTAAAGCAGGGTCAAAAGATGTTAGTAGTTCT

TTACAGTTGGAAAATCCGAAAATGTCAGTTGTTTCTAAATATGGGAAAAC

AGAGGTTAGTAGTGGCGCAGCGGATTTCTAGCGGAAGGATGCCGCCTATT

TTAAAATGTGTTTTGAGTTGAAACAAAAGGATAAATCTGAAACAATCAAC

CCAGGTGATACCTTTGTGTTACAGCTGGATAGACGTCTGAATCCTAAAGG

TATCAGTCAAGATATCCCTAAAATCATTTACGACAGTGGAAATAGTCGGG

TTGCGATTGGAAAATACCATGGTGAGAACCATCAACTTATCTATACTTTC

ACAGATTATATTGCGGGTTTAGATAAAGTCCAGTTGTCTGCAGAATTGAG

CTTATTCCTAGAGAATAAGGAAGTGTTGGAAAATACTAGTATGTCAAATT

TTAAGAGTAGCATAGGTGGGCAGGAGATCAGCTATAAAGGAACGGTTAAT

GTTCTTTATGGAAATGAGAGCACTAAAGAAAGCAATTATATTAGTAATGG

ATTGAGGAATGTGGGTGGGAGTATTGAAAGCTACAACACCGAAACGGGAG

AATTTGTCTGGTATGTTTATGTCAATCCAAACCGTACCAATATTCCTTAT

GCGACGATGAATTTATGGGGATTTGGAAGGGCTCGTTCAAATACAAGCGA

CTTAGAAAACGACGCTAATACAAGTAGTGCTGAGCTTGGAGAGATTCAGG

TCTATGAAGTACCTGAAGGAGAAAAATTACCATCAAGTTATGGGGTTGAT

GTTAGAAAAGTTACTTTAAGAACGGATATCACAGCAGGCCTAGGAAATGG

TTTTCAAATGAGCAAACGTCAGCGAATTGACTTTGGAAATAATATCCAAA

ATAAAGCATTTATCATCAAAGTAACAGGGAAAACAGACCAATCTGGTAAG

CCATTGGTTGTTCAATCCAATTTGGCAAGTTTTCGTGGTGCTTCTGAATA

TGCTGCTTTTACTCCAGTTGGAGGAAATGTCTACTTCCAAAACGAAATTG

CCTTGTCTCCTTCTAAGGGTAGTGGTTCTGGGAAAAGTGAATTTACTAAG

CCCTCTATTACAGTAGCAAATCTAAAACGAGTGGCTCAGCTTCGCTTTAA

GAAAATGTCAACTGAGAATGTGCCATTGCCAGAAGCGGCTTTTGAGCTGC

GTTCATCAAATGGTAATAGTCAGAAATTAGAAGCCAGTTCAAACACACAA

-continued

GGAGAGGTTCACTTTAAGGACCTGACCTCGGGCACATATGACCTGTATGA

AACAAAAGCGCCAAAAGGTTATCAGCAGGTGACAGAGAAATTGGCGACCG

TTACTGTTGATACTACCAAACCTGCTGAGGAAATGGTCACTTGGGGAAGC

CCACATTCGTCTGTAAAAGTAGAAGCTAACAAAGAAGTCACGATTGTCAA

CCATAAAGAAACCCTTACGTTTTCAGGGAAGAAAATTTGGGAGAATGACA

GACCAGATCAACGCCCAGCAAAGATTCAAGTGCAACTGTTGCAAAATGGT

CAAAAGATGCCTAACCAGATTCAAGAAGTAACGAAGGATAACGATTGGTC

TTATCACTTCAAAGACTTGCCTAAGTACGATGCCAAGAATCAGGAGTATA

AGTACTCAGTTGAAGAAGTAAATGTTCCAGACGGCTACAAGGTGTCGTAT

TTAGGAAATGATATATTTAACACCAGAGAAACAGAATTTGTGTTTGAACA

GAATAACTTTAACCTTGAATTTGGAAATGCTGAAATAAAAGGTCAATCTG

GGTCAAAAATCATTGATGAAGACACGCTAACGTCTTTCAAAGGTAAGAAA

ATTTGGAAAAATGATACGGCAGAAAATCGTCCCCAAGCCATTCAAGTGCA

GCTTTATGCTGATGGAGTGGCTGTGGAAGGTCAAACCAAATTTATTTCTG

GCTCAGGTAATGAGTGGTCATTTGAGTTTAAAAACTTGAAGAAGTATAAT

GGAACAGGTAATGACATCATTTACTCAGTTAAAGAAGTAACTGTTCCAAC

AGGTTATGATGTGACTTACTCAGCTAATGATATTATTAATACCAAACGTG

AGGTTATTACACAACAAGGACCGAAACTAGAGATTGAAGAAACGCTTCCG

CTAGAATCAGGTGCTTCAGGCGGTACCACTACTGTCGAAGACTCACGCCC

AGTTGATACCTTATCAGGTTTATCAAGTGAGCAAGGTCAGTCCGGTGATA

TGACAATTGAAGAAGATAGTGCTACCCATATTAAATTCTCAAAACGTGAT

ATTGACGGCAAAGAGTTAGCTGGTGCAACTATGGAGTTGCGTGATTCATC

TGGTAAAACTATTAGTACATGGATTTCAGATGGACAAGTGAAAGATTTCT

ACCTGATGCCAGGAAAATATACATTTGTCGAAACCGCAGCACCAGACGGT

TATGAGATAGCAACTGCTATTACCTTTACAGTTAATGAGCAAGGTCAGGT

TACTGTAAATGGCAAAGCAACTAAAGGTGACACTCATATTGTCATGGTTG

ATGCTTACAAGCCAACTAAGGGTTCAGGTCAGGTTATTGATATTGAAGAA

AAGCTTCCAGACGAGCAAGGTCATTCTGGTTCAACTACTGAAATAGAAGA

CAGTAAATCTTCAGACCTTATCATTGGCGGTCAAGGTGAAGTTGTTGACA

CAACAGAAGACACACAAAGTGGTATGACGGGCCATTCTGGCTCAACTACT

GAAATAGAAGATAGCAAGTCTTCAGACCTTATCATTGGTGGTCAGGGGCA

GGTTGTCGAGACAACAGAGGATACCCAAACTGGCATGTACGGGGATTCTG

GTTGTAAAACGGAAGTCGAAGATACTAAACTAGTACAATCCTTCCACTTT

GATAACAAGGAACCAGAAAGTAACTCTGAGATTCCTAAAAAAGATAAGCC

AAAGAGTAATAGTAGTTTACCAGCAACTGGTGAGAAGCAACATAATATGT

TCTTTTGGATGGTTACTTCTTGCTCACTTATTAGTAGTGTTTTTGTAATA

TCACTAAAATCCAAAAAACGCCTATCATCATGTTAA

SEQ ID NO: 121

MTQKNSYKLSELLSLTGFILGLLLVFIGLSGVSVGHAETRNGANKQGSFE

IKKVDQNNKPLPGATFSLTSKDGKGTSVQTFTSNDKGIVDAQNLQPGTYT

LKEETAPDGYDKTSRTWTVTVYENGYTKLVENPYNGETISKAGSKDVSSS

-continued

LQLENPKMSVVSKYGKTEVSSGAADFYRNHAAYFKMSFELKQKDKSETIN

PGDTFVLQLDRRLNPKGISQDIPKITYDSANSPLAIGKYHAENHQLTYTF

TDYIAGLDKVQLSAELSLFLENKEVLENTSISNFKSTIGGQEITYKGTVN

VLYGNESTKESNYITNGLSNVGGSIESYNTETGEFVWYVYVNPNRTNTPY

ATMNLWGFGRARSNTSDLENDANTSSAELGEIQVYEVPEGEKLPSSYGVD

VTKLTLRTDITAGLGNGFQMTKRQRIDEGNNIQNKAFIIKVTGKTDQSGK

PLVVQSNLASERGASEYAAFTPVGGNVYFQNEIALSPSKGSGSGKSEFTK

PSITVANLKRVAQLRFKKMSTDNVPLPEAAFELRSSNGNSQKLEASSNTQ

GEVHFKDLTSGTYDLYETKAPKGYQQVTEKLATVTVDTTKPAEEMVTWGS

PHSSVKVEANKEVTIVNHKETLTFSGKKIWENDRPDQRPAKIQVQLLQNG

QKMPNQIQEVTKDNDWSYHEKDLPKYDAKNQEYKYSVEEVNVPDGYKVSY

LGNDIENTRETEFVFEQNNENLEFGNAETKGQSGSKIIDEDTLTSFKGKK

IWKNDTAENRPQATQVQLYADGVAVEGQTKFISGSGNEWSFEEKNLKKYN

GTGNDTIYSVKEVTVPTGYDVTYSANDIINTKREVITQQGPKLEIEETLP

LESGASGGTTTVEDSRPVDTLSGLSSEQGQSGDMTIEEDSATHIKFSKRD

IDGKELAGATMELRDSSGKTISTWISDGQVKDFYLMPGKYTEVETAAPDG

YEIATAITFTVNEQGQVTVNGKATKGDTHTVMVDAYKPTKGSGQVIDIEE

KLPDEQGHSGSTTEIEDSKSSDLIIGGQGEVVDTTEDTQSGMTGHSGSTT

EIEDSKSSDVIIGGQGQVVETTEDTQTGMYGDSGCKTEVEDTKLVQSFHE

DNKEPESNSEIPKKDKPKSNTSLPATGEKQHNMFFWMVTSCSLISSVFVI

SLKSKKRLSSC 19224141 contains an amino acid motif indicative of a cell wall anchor: SEQ ID NO:181 LPATG (shown in italics in SEQ ID NO:121, above). In some recombinant host cell systems, it may be preferable to remove this motif to facilitate secretion of a recombinant 19224141 protein from the host cell. Alternatively, in other recombinant host cell systems, it may be preferable to use the cell wall anchor motif to anchor the recombinantly expressed protein to the cell wall. The extracellular domain of the expressed protein may be cleaved during purification or the recombinant protein may be left attached to either inactivated host cells or cell membranes in the final composition.

Two pilin motifs, discussed above, containing conserved lysine (K) residues have also been identified in 19224141. The pilin motif sequences are underlined in SEQ ID NO:121, below. Conserved lysine (K) residues are also marked in bold, at amino acid residues 157 and 163 and at amino acid residues 216, 224, and 238. The pilin sequence, in particular the conserved lysine residues, are thought to be important for the formation of oligomeric, pilus-like structures. Preferred fragments of 19224141 include at least one conserved lysine residue. Preferably, fragments include at least one pilin sequence.

SEQ ID NO: 121

MTQKNSYKLSFLLSLTGFILGLLLVFIGLSGVSVGHAETRNGANKQGSFE

IKKVDQNNKPLPGATFSLTSKDGKGTSVQTFTSNDKGIVDAQNLQPGTYT

LKEETAPDGYDKTSRTWTVTVYENGYTKLVENPYNGEIISKAGSKDVSSS

-continued

LQLENPKMSVVSKYGKTEVSSGAADFYRNHAAYFKMSFELKQKDKSETIN

PGDTFVLQLDRRLNPKGISQDIPKIIYDSANSPLAIGKYHAENHQLIYTF

TDYIAGLDKVQLSAELSLFLENKEVLENTSISNFKSTIGGQEITYKGTVN

VLYGNESTKESNYITNGLSNVGGSIESYNTETGEFVWYVYVNPNRTNIPY

ATMNLWGFGRARSNTSDLENDANTSSAELGEIQVYEVPEGEKLPSSYGVD

VTKLTLRTDITAGLGNGFQMTKRQRIDFGNNIQNKAFIIKVTGKTDQSGK

PLVVQSNLASFRGASEYAAFTPVGGNVYFQNEIALSPSKGSGSGKSEFTK

PSITVANLKRVAQLRFKKMSTDNVPLPEAAFELRSSNGNSQKLEASSNTQ

GEVHFKDLTSGTYDLYETKAPKGYQQVTEKLATVTVDTTKPAEEMVTWGS

PHSSVKVEANKEVTIVNHKETLTFSGKKIWENDRPDQRPAKIQVQLLQNG

QKMPNQIQEVTKDNDWSYHFKDLPKYDAKNQEYKYSVEEVNVPDGYKVSY

LGNDIFNTRETEFVFEQNNFNLEFGNAEIKGQSGSKIIDEDTLTSFKGKK

IWKNDTAENRPQAIQVQLYADGVAVEGQTKFISGSGNEWSFEFKNLKKYN

GTGNDIIYSVKEVTVPTGYDVTYSANDIINTKREVITQQGPKLEIEETLP

LESGASGGTTTVEDSRPVDTLSGLSSEQGQSGDMTIEEDSATHIKFSKRD

IDGKELAGATMELRDSSGKTISTWISDGQVKDFYLMPGKYTFVETAAPDG

YEIATAITFTVNEQGQVTVNGKATKGDTHIVMVDAYKPTKGSGQVIDIEE

KLPDEQGHSGSTTEIEDSKSSDLIIGGQGEVVDTTEDTQSGMTGHSGSTT

EIEDSKSSDVIIGGQGQVVETTEDTQTGMYGDSGCKTEVEDTKLVQSFHF

DNKEPESNSEIPKKDKPKSNTSLPATGEKQHNMFFWMVTSCSLISSVFVI

SLKSKKRLSSC

Two E boxes containing conserved glutamic residues have been identified in 19224141. The E-box motifs are underlined in SEQ ID NO: 121, below. The conserved glutamic acid (E) residues, at amino acid residues 567 and 944, are marked in bold. The E box motifs, in particular the conserved glutamic acid residues, are thought to be important for the formation of oligomeric pilus-like structures of 19224141. Preferred fragments of 19224141 include at least one conserved glutamic acid residue. Preferably, fragments include at least one E box motif

SEQ ID NO: 121

MTQKNSYKLSFLLSLTGFILGLLLVFIGLSGVSVGHAETRNGANKQGSFE

IKKVDQNNKPLPGATFSLTSKDGKGTSVQTFTSNDKGIVDAQNLQPGTYT

LKEETAPDGYDKTSRTWTVTVYENGYTKLVENPYNGEIISKAGSKDVSSS

LQLENPKMSVVSKYGKTEVSSGAADFYRNHAAYFKMSFELKQKDKSETIN

PGDTFVLQLDRRLNPKGISQDIPKIIYDSANSPLATGKYHAENHQLTYTF

TDYIAGLDKVQLSAELSLFLENKEVLENTSISNFKSTIGGQEITYKGTVN

VLYGNESTKESNYITNGLSNVGGSIESYNTETGEFVWYVYVNPNRTNIPY

ATMNLWGFGRARSNTSDLENDANTSSAELGEIQVYEVPEGEKLPSSYGVD

VTKLTLRTDITAGLGNGFQMTKRQRIDFGNNIQNKAFIIKVTGKTDQSGK

PLVVQSNLASFRGASEYAAFTPVGGNVYFQNEIALSPSKGSGSGKSEFTK

PSITVANLKRVAQLRFKKMSTDNVPLPEAAFELRSSNGNSQKLEASSNTQ

GEVHFKDLTSGTYDLYETKAPKGYQQVTEKLATVTVDTTKPAEEMVTWGS

-continued

PHSSVKVEANKEVTIVNHKETLTFSGKKIWENDRPDQRPAKIQVQLLQNG

QKMPNQIQEVTKDNDWSYHFKDLPKYDAKNQEYKYSVEEVNVPDGYKVSY

LGNDIENTRETEFVFEQNNENLEFGNAEIKGQSGSKIIDEDTLTSFKGKK

IWKNDTAENRPQAIQVQLYADGVAVEGQTKFISGSGNEWSFEFKNLKKYN

GTGNDITYSVKEVTVPTGYDVTYSANDIINTKREVITQQGPKLEIEETLP

LESGASGGTTTVEDSRPVDTLSGLSSEQGQSGDMTIEEDSATHIKFSKRD

IDGKELAGATMELRDSSGKTISTWISDGQVKDFYLMPGKYTFVETAAPDG

YEIATAITFTVNEQGQVTVNGKATKGDTHIVMVDAYKPTKGSGQVIDIEE

KLPDEQGHSGSTTEIEDSKSSDLIIGGQGEVVDTTEDTQSGMTGHSGSTT

EIEDSKSSDVIIGGQGQVVETTEDTQTGMYGDSGCKTEVEDTKLVQSFHE

DNKEPESNSEIPKKDKPKSNTSLPATGEKQHNMFFWMVTSCSLISSVFVI

SLKSKKRLSSC

As discussed above, applicants have also determined the nucleotide and encoded amino acid sequence of fimbrial structural subunits in several other GAS AI-4 strains of bacteria. Examples of sequences of these fimbrial structural subunits are set forth below.

M12 strain isolate 20010296 is a GAS AI-4 strain of bacteria. 20010296_fimbrial is thought to be a fimbrial structural subunit of M12 strain isolate 20010296. An example of a nucleotide sequence encoding the 20010296_fimbrial protein (SEQ ID NO:257) and a 20010296_fimbrial protein amino acid sequence (SEQ ID NO:258) are set forth below.

SEQ ID NO: 257 agcagtggtcaattaacaataaaaaaatcaattacaaattttaatgatga tacacttttgatgcctaagacagactatacttttagcgttaatccggata gtgcggctacaggtactgaaagtaatttaccaattaaaccaggtattgct gttaacaatcaagatattaaggtttcttattctaatactgataagacatc aggtaaagaaaaacaagttgttgttgactttatgaaagttacttttccta gcgttggtatttaccgttatgttgttaccgagaataaagggacagcagaa ggagttacatatgatgatacaaaatggttagttgacgtctatgttggtaa taatgaaaagggaggtcttgaaccaaagtatattgtatctaaaaaaggag attctgctactaaagaaccaatccagtttaataattcattcgaaacaacg tcattaaaaattgaaaaggaagttactggtaatacaggagatcataaaaa agcatttaactttacattaacattgcaaccaaatgaatactatgaggcaa gttcggttgtgaaaattgaagagaacggacaaacgaaagatgtgaaaatt ggggaggcatataagtttactttgaacgatagtcagagtgtgatattgtc taaattaccagttggtattaattataaagttgaagaagcagaagctaatc aaggtggatatactacaacagcaactttaaaagatggagaaaagttatct acttataacttaggtcaggaacataaaacagacaagactgctgatgaaat cgt

SEQ ID NO: 258

SSGQLTIKKSITNFNDDTLLMPKTDYTFSVNPDSAATGTESNLPIKPGIA

VNNQDIKVSYSNTDKTSGKEKQVVVDFMKVTFPSVGIYRYVVTENKGTAE

-continued

GVTYDDTKWLVDVYVGNNEKGGLEPKYIVSKKGDSATKEPIQFNNSFETT

SLKIEKEVTGNTGDHKKAFNFTLTLQPNEYYEASSVVKIEENGQTKDVKI

GEAYKFTLNDSQSVILSKLPVGINYKVEEAEANQGGYTTTATLKDGEKLS

TYNLGQEHKTDKTADEIV

M12 strain isolate 20020069 is a GAS AI-4 strain of bacteria. 20020069_fimbrial is thought to be a fimbrial structural subunit of M12 strain isolate 20020069. An example of a nucleotide sequence encoding the 20020069_fimbrial protein (SEQ ID NO:259) and a 20020069_fimbrial protein amino acid sequence (SEQ ID NO:260) are set forth below.

SEQ ID NO: 259 agcagtggtcaattaacaataaaaaaatcaattacaaattttaatgatga tacacttttgatgcctaagacagactatacttttagcgttaatccggata gtgcggctacaggtactgaaagtaatttaccaattaaaccaggtattgct gttaacaatcaagatattaaggtttcttattctaatactgataagacatc aggtaaagaaaaacaagttgttgttgactttatgaaagttacttttccta gcgttggtatttaccgttatgttgttaccgagaataaagggacagcagaa ggagttacatatgatgatacaaaatggttagttgacgtctatgttggtaa taatgaaaagggaggtcttgaaccaaagtatattgtatctaaaaaaggag attctgctactaaagaaccaatccagtttaataattcattcgaaacaacg tcattaaaaattgaaaaggaagttactggtaatacaggagatcataaaaa agcatttaactttacattaacattgcaaccaaatgaatactatgaggcaa gttcggttgtgaaaattgaagagaacggacaaacgaaagatgtgaaaatt ggggaggcatataagtttactttgaacgatagtcagagtgtgatattgtc taaattaccagttggtattaattataaagttgaagaagcagaagctaatc aaggtggatatactacaacagcaactttaaaagatggagaaaagttatct acttataacttaggtcaggaacataaaacagacaagactgctgatgaaat cgt

SEQ ID NO: 260

SSGQLTIKKSITNFNDDTLLMPKTDYTFSVNPDSAATGTESNLPIKPGIA

VNNQDIKVSYSNTDKTSGKEKQVVVDEMKVTFPSVGIYRYVVTENKGTAE

GVTYDDTKWLVDVYVGNNEKGGLEPKYIVSKKGDSATKEPIQFNNSEETT

SLKIEKEVTGNTGDHKKAFNFTLTLQPNEYYEASSVVKIEENGQTKDVKI

GEAYKFTLNDSQSVILSKLPVGINYKVEEAEANQGGYTTTATLKDGEKLS

TYNLGQEHKTDKTADEIV

M12 strain isolate CDC SS 635 is a GAS AI-4 strain of bacteria. CDC SS 635_fimbrial is thought to be a fimbrial structural subunit of M12 strain isolate CDC SS 635.

An example of a nucleotide sequence encoding the CDC SS 635_fimbrial protein (SEQ ID NO:261) and a CDC SS 635_fimbrial protein amino acid sequence (SEQ ID NO:262) are set forth below.

SEQ ID NO: 261 gagacggcaggggttgttagcagtggtcaattaacaataaaaaaatcaat tacaaattttaatgatgatacacttttgatgcctaagacagactatactt -continued ttagcgttaatccggatagtgcggctacaggtactgaaagtaatttacca attaaaccaggtattgctgttaacaatcaagatattaaggtttcttattc taatactgataagacatcaggtaaagaaaaacaagttgttgttgacttta tgaaagttacttttcctagcgttggtatttaccgttatgttgttaccgag aataaagggacagcagaaggagttacatatgatgatacaaaatggttagt tgacgtctatgttggtaataatgaaaagggaggtcttgaaccaaagtata ttgtatctaaaaaaggagattctgctactaaagaaccaatccagtttaat aattcattcgaaacaacgtcattaaaaattgaaaaggaagttactggtaa tacaggagatcataaaaaagcatttaactttacattaacattgcaaccaa atgaatactatgaggcaagttcggttgtgaaaattgaagagaacggacaa acgaaagatgtgaaaattggggaggcatataagtttactttgaacgatag tcagagtgtgatattgtctaaattaccagttggtattaattataaagttg aagaagcagaagctaatcaaggtggatatactacaacagcaactttaaaa gatggagaaaagttatctacttataacttaggtcaggaacataaaacaga caagactgctgatgaaatcgttgtcacaaataaccgtgacact

SEQ ID NO: 262

ETAGVVSSGQLTTKKSITNFNDDTLLMPKTDYTFSVNPDSAATGTESNLP

IKPGIAVNNQDIKVSYSNTDKTSGKEKQVVVDPMKVTFPSVGIYRYVVTE

NKGTAEGVTYDDTKWLVDVYVGNNEKGGLEPKYIVSKKGDSATKEPIQFN

NSFETTSLKIEKEVTGNTGDHKKAFNFTLTLQPNEYYEASSVVKIEENGQ

TKDVKIGEAYKFTLNDSQSVILSKLPVGINYKVEEAEANQGGYTTTATLK

DGEKLSTYNLGQEHKTDKTADEIVVTNNRDT

M5 strain isolate ISS 4883 is a GAS AI-4 strain of bacteria. ISS4883_fimbrial is thought to be a fimbrial structural subunit of M5 strain isolate ISS 4883. An example of a nucleotide sequence encoding the ISS4883_fimbrial protein (SEQ ID NO:265) and an ISS4883_fimbrial protein amino acid sequence (SEQ ID NO:266) are set forth below.

SEQ ID NO: 265 gagacggcaggggttgtaacaggaaaatcactacaagttacaaagacaat gacttatgatgatgaagaggtgttaatgcccgaaaccgcctttactttta ctatagagcctgatatgactgcaagtggaaaagaaggcgacctagatatt aaaaatggaattgtagaaggcttagacaaacaagtaacagtaaaatataa gaatacagataaaacatctcaaaaaactaaaatagcacaatttgattttt ctaaggttaaatttccagctataggtgtttaccgctatatggtttcagag aaaaacgataaaaaagacggaattaggtacgatgataaaaagtggactgt agatgtttatgttgggaataaggccaataacgaagaaggtttcgaagttc tatatattgtatcaaaagaaggtacttctagtactaaaaaaccaattgaa tttacaaactctattaaaactacttccttaaaaattgaaaaacaaataac tggcaatgcaggagatcgtaaaaaatcattcaacttcacattaacattac aaccaagtgaatattataaaaccggatcagttgtgaaaatcgaacaggat ggaagtaaaaaagatgtgacgataggaacgccttacaaatttactttggg -continued acacggtaagagtgtcatgttatcgaaattaccaattggtatcaattact atcttagtgaagacgaagcgaataaagacggttacactacaacggcaaca ttaaaagaacaaggcaaagaaaagagttccgatttcactttgagtactca aaaccagaaaacagacgaatctgctgacgaaatcgttgtcacaaataagc gtgacactctcgag

SEQ ID NO: 266

ETAGVVTGKSLQVTKTMTYDDEEVLMPETAFTFTIEPDMTASGKEGDLDI

KNGIVEGLDKQVTVKYKNTDKTSQKTKIAQFDFSKVKFPAIGVYRYMVSE

KNDKKDGIRYDDKKWTVDVYVGNKANNEEGFEVLYIVSKEGTSSTKKPIE

FTNSIKTTSLKIEKQITGNAGDRKKSFNFTLTLQPSEYYKTGSVVKIEQD

GSKKDVTIGTPYKFTLGHGKSVMLSKLPIGINYYLSEDEANKDGYTTTAT

LKEQGKEKSSDFTLSTQNQKTDESADEIVVTNKRDTLE

M50 strain isolate ISS4538 is a GAS AI-4 strain of bacteria. ISS4538_fimbrial is thought to be a fimbrial structural subunit of M50 strain ISS 4538. An example of a nucleotide sequence encoding the ISS4538_fimbrial protein (SEQ ID NO:255) and an ISS4538_fimbrial protein amino acid sequence (SEQ ID NO:256) are set forth below.

SEQ ID NO: 255 atgaaaaaaaataaattattacttgctactgcaatcttagcaactgcttt aggaacagcttctttaaatcaaaacgtaaaagctgagacggcaggggttg ttagcagtggtcaattaacaataaaaaaatcaattacaaattttaatgat gatacacttttgatgcctaagacagactatacttttagcgttaatccgga tagtgcggctacaggtactgaaagtaatttaccaattaaaccaggtattg ctgttaacaatcaagatattaaggtttcttattctaatactgataagaca tcaggtaaagaaaaacaagttgttgttgactttatgaaagttacttttcc tagcgttggtatttaccgttatgttgttaccgagaataaagggacagcag aaggagttacatatgatgatacaaaatggttagttgacgtctatgttggt aataatgaaaagggaggtcttgaaccaaagtatattgtatctaaaaaagg agattctgctactaaagaaccaatccagtttaataattcattcgaaacaa cgtcattaaaaattgaaaagaaagttactggtaatacaggagatcataaa aaagcatttaactttacattaacattgcaaccaaatgaatactatgaggc aagttcggttgtgaaaattgaagagaacggacaaacgaaagatgtgaaaa ttggggaggcatataagtttactttgaacgatagtcagagtgtgatattg tctaaattaccagttggtattaattataaagttgaagaagcagaagctaa tcaaggtggatatactacaacagcaactttaaaagatggagaaaagttat ctacttataacttaggtcaggaacataaaacagacaagactgctgatgaa atcgttgtcacaaataancgngacactcnagttccaacnggtgtngtagg caccccncctccattcncagttcttancattgnggctantggtggngtna tntatnttacaaaacgnaaaaaagnataa

SEQ ID NO: 256

MKKNKLLLATAILATALGTASLNQNVKAETAGVVSSGQLTIKKSITNFND

DTLLMPKTDYTFSVNPDSAATGTESNLPIKPGIAVNNQDIKVSYSNTDKT

-continued

SGKEKQVVVDFMKVTFPSVGIYRYVVTENKGTAEGVTYDDTKWLVDVYVG

NNEKGGLEPKYIVSKKGDSATKEPIQFNNSFETTSLKIEKKVTGNTGDHK

KAFNFTLTLQPNEYYEASSVVKTEENGQTKDVKIGEAYKFTLNDSQSVIL

SKLPVGINYKVEEAEANQGGYTTTATLKDGEKLSTYNLGQEHKTDKTADE

IVVTNXRDTXVPTGVVGTPPPFXVLXIXAXGGVXYXTKRKKX

There may be an upper limit to the number of GAS proteins which will be in the compositions of the invention. Preferably, the number of GAS proteins in a composition of the invention is less than 20, less than 19, less than 18, less than 17, less than 16, less than 15, less than 14, less than 13, less than 12, less than 11, less than 10, less than 9, less than 8, less than 7, less than 6, less than 5, less than 4, or less than 3. Still more preferably, the number of GAS proteins in a composition of the invention is less than 6, less than 5, or less than 4. Still more preferably, the number of GAS proteins in a composition of the invention is 3.

The GAS proteins and polynucleotides used in the invention are preferably isolated, i.e., separate and discrete, from the whole organism with which the molecule is found in nature or, when the polynucleotide or polypeptide is not found in nature, is sufficiently free of other biological macromolecules so that the polynucleotide or polypeptide can be used for its intended purpose.

Examples Other Gram Positive Bacterial Adhesin Island Sequences

The Gram positive bacteria AI polypeptides of the invention can, of course, be prepared by various means (e.g. recombinant expression, purification from a gram positive bacteria, chemical synthesis etc.) and in various forms (e.g. native, fusions, glycosylated, non-glycosylated etc.). They are preferably prepared in substantially pure form (i.e. substantially free from other streptococcal or host cell proteins) or substantially isolated form.

The Gram positive bacteria AI proteins of the invention may include polypeptide sequences having sequence identity to the identified Gram positive bacteria proteins. The degree of sequence identity may vary depending on the amino acid sequence (a) in question, but is preferably greater than 50% (e.g. 60%, 65%, 70%, 75%, 80%, 85%, 90%, 91%, 92%, 93%, 94%, 95%, 96%, 97%, 98%, 99%, 99.5% or more). Polypeptides having sequence identity include homologs, orthologs, allelic variants and mutants of the identified Gram positive bacteria proteins. Typically, 50% identity or more between two proteins is considered to be an indication of functional equivalence. Identity between proteins is preferably determined by the Smith-Waterman homology search algorithm as implemented in the MPSRCH program (Oxford Molecular), using an affinity gap search with parameters gap open penalty=12 and gap extension penalty=1.

The Gram positive bacteria adhesin island polynucleotide sequences may include polynucleotide sequences having sequence identity to the identified Gram positive bacteria adhesin island polynucleotide sequences. The degree of sequence identity may vary depending on the polynucleotide sequence in question, but is preferably greater than 50% (e.g. 60%, 65%, 70%, 75%, 80%, 85%, 90%, 91%, 92%, 93%, 94%, 95%, 96%, 97%, 98%, 99%, 99.5% or more).

The Gram positive bacteria adhesin island polynucleotide sequences of the invention may include polynucleotide fragments of the identified adhesin island sequences. The length of the fragment may vary depending on the polynucleotide sequence of the specific adhesin island sequence, but the fragment is preferably at least 10 consecutive polynucleotides, (e.g. at least 10, 12, 14, 16, 18, 20, 25, 30, 35, 40, 50, 60, 70, 80, 90, 100, 150, 200 or more).

The Gram positive bacteria adhesin island amino acid sequences of the invention may include polypeptide fragments of the identified Gram positive bacteria proteins. The length of the fragment may vary depending on the amino acid sequence of the specific Gram positive bacteria antigen, but the fragment is preferably at least 7 consecutive amino acids, (e.g. 8, 10, 12, 14, 16, 18, 20, 25, 30, 35, 40, 50, 60, 70, 80, 90, 100, 150, 200 or more). Preferably the fragment comprises one or more epitopes from the sequence. The fragment may comprise at least one T-cell or, preferably, a B-cell epitope of the sequence. T- and B-cell epitopes can be identified empirically (e.g., using PEPSCAN Geysen et al. (1984) PNAS USA 81:39984002; Carter (1994) Methods Mol. Biol. 36:2 July 223, or similar methods, or they can be predicted (e.g., using the Jameson-Wolf antigenic index Jameson, B A et al. 1988, CABIOS 4 (1):1818-186, matrix-based approaches Raddrizzani and Hammer (2000) Brief Bioinform. 1 (2):179-189, TEPITOPE De Lalla et al. (199) J. Immunol. 163:1725-1729, neural networks Brusic et al. (1998) Bioinformatics 14 (2): 121-130, OptiMer & EpiMer Meister et al. (1995) Vaccine 13 (6):581-591; Roberts et al. (1996) AIDS Res. Hum. Retroviruses 12 (7):593-610, ADEPT Maksyutov & Zagrebelnaya (1993) Comput. Appl. Biosci. 9 (3):291-297, Tsites Feller & de la Cruz (1991) Nature 349 (6311):720-721, hydrophilicity Hopp (1993) Peptide Research 6:183-190, antigenic index Welling et al. (1985) FEBS Lett. 188:215-218 or the methods disclosed in Davenport et al. (1995) Immunogenetics 42:392-297, etc. Other preferred fragments include (1) the N-terminal signal peptides of each identified Gram positive bacteria protein, (2) the identified Gram positive bacteria protein without their N-terminal signal peptides, (3) each identified Gram positive bacteria protein wherein up to 10 amino acid residues (e.g. 1, 2, 3, 4, 5, 6, 7, 8, 9, 10, 15, 20, or more) are deleted from the N-terminus and/or the C-terminus e.g. the N-terminal amino acid residue may be deleted. Other fragments omit one or more domains of the protein (e.g. omission of a signal peptide, of a cytoplasmic domain, of a transmembrane domain, or of an extracellular domain), and (4) the polypeptides, but without their N-terminal amino acid residue.

As indicated in the above text, nucleic acids and polypeptides of the invention may include sequences that: 67 (a) are identical (i.e., 100% identical) to the sequences disclosed in the sequence listing; 68 (b) share sequence identity with the sequences disclosed in the sequence listing; 69 (c) have 1, 2, 3, 4, 5, 6, 7, 8, 9, or 10 single nucleotide or amino acid alterations (deletions, insertions, substitutions), which may be at separate locations or may be contiguous, as compared to the sequences of (a) or (b); 70 (d) when aligned with a particular sequence from the sequence listing using a pairwise alignment algorithm, a moving window of x monomers (amino acids or nucleotides) moving from start (N-terminus or 5') to end (C-terminus or 3'), such that for an alignment that extends top monomers (where p>x) there are p−x+1 such windows, each window has at least xy identical aligned monomers, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if xy is not an integer then it is rounded up to the nearest integer. The preferred pairwise alignment algorithm is the Needleman-Wunsch global alignment algorithm Needlman & Wunsch (1970) J. Mol. Biol. 48, 443-453, using default parameters (e.g., with Gap opening penalty=10.0, and with Gap extension penalty=0.5, using the EBLOSUM62 scoring matrix). This algorithm is conveniently implemented in the needle tool in the EMBOSS package Rice et al. (2000) Trends Genet. 16:276-277.

The nucleic acids and polypeptides of the invention may additionally have further sequences to the N-terminus/5' and/or C-terminus/3' of these sequences (a) to (d).

All of the Gram positive bacterial sequences referenced herein are publicly available through PubMed on GenBank.

*Streptococcus pneumoniae* Adhesin Island Sequences

As discussed above, a *S. pneumoniae* AI sequence is present in the TIGR4 *S. pneumoniae* genome. Examples of *S. pneumoniae* AI sequences are set forth below.

SrtD (Sp0468) is a sortase. An example of an amino acid sequence of SrtD is set forth in SEQ ID NO:80.

SEQ ID NO: 80

MSRTKLRALLGYLLMLVACLIPIYCFGQMVLQSLGQVKGHATFVKSMTTE

MYQEQQNHSLAYNQRLASQNRTVDPFLAEGYEVNYQVSDDPDAVYGYLSI

PSLEIMEPVYLGADYHHLGMGLAHVDGTPLPLDGTGIRSVIAGHRAEPSH

VFFRHLDQLKVGDALYYDNGQEIVEYQMMDTEIILPSEWEKLESVSSKNI

MTLITCDPIPTFNKRLLVNFERVAVYQKSDPQTAAVARVAFTKEGQSVSR

VATSQWLYRGLVVLAFLGILFVLWKLARLLRGK

SrtC (Sp0467) is a sortase. An example of an amino acid sequence of SrtC is set forth in SEQ ID NO:81.

SEQ ID NO: 81

MSRYYYRIESNEVIKEFDETVSQMDKAELEERWRLAQAENATLKPSEILD

PFTEQEKKKGVSEYANMLKVHERIGYVEIPAIDQEIPMYVGTSEDILQKG

AGLLEGASLPVGGENTHTVITAHRGLPTAELFSQLDKMKKGDIFYLHVLD

QVLAYQVDQIVIVEPNDEEPVLIQHGEDYATLLTCTPYMINSHRLLVRGK

RIPYTAPIAERNRAVRERGQFWLWLLLGAMAVILLLLYRVYRNRRIVKGL

EKQLEGRHVKD

SrtB (SP0466) is a sortase. An example of an amino acid sequence of SrtB is set forth in SEQ ID NO:82.

SEQ ID NO: 82

MAVMAYPLVSRLYYRVESNQQIADFDKEKATLDEADIDERMKLAQAFNDS

LNNVVSGDPWSEEMKKKGRAEYARMLEIHERMGHVEIPVIDVDLPVYAGT

AEEVLQQGAGHLEGTSLPIGGNSTHAVITAHTGLPTAKMFTDLTKLKVGD

KEYVHNIKEVMAYQVDQVKVIEPTNFDDLLIVPGHDYVTLLTCTPYMINT

HRLLVRGHRIPYVAEVEEEFIAANKLSHLYRYLFYVAVCLIVTLLWITRR

LRKKKKQPEKALKALKAARKEVKVEDGQQ

Sp0465 is a hypothetical protein. An example of an amino acid sequence of Sp0465 is set forth in SEQ ID NO:83.

SEQ ID NO: 83

MFLPFLSASLYLQTHHFIAFPNRQSYLLRETRKSHFFLIHHPF

RrgC (SP0464) is a cell wall surface anchor family protein. RrgC contains a sortase substrate motif VPXTG (SEQ ID NO:137), shown in italics in SEQ ID NO:84.

SEQ ID NO: 84

MISRIFFVMALCFSLVWGAHAVQAQEDHTLVLQLENYQEVVSQLPSRDGH

RLQVWKLDDSYSYDDRVQIVRDLHSWDENKLSSFKKTSFEMTFLENQIEV

SHIPNGLYYVRSIIQTDAVSYPAEFLFEMTDQTVEPLVIVAKKTDTMTTK

VKLIKVDQDHNRLEGVGFKLVSVARDVSEKEVPLIGEYRYSSSGQVGRTL

YTDKNGEIFVTNLPLGNYRFKEVEPLAGYAVTTLDTDVQLVDHQLVTITV

VNQKLPRGNVDFMKVDGRTNTSLQGAMFKVMKEESGHYTPVLQNGKEVVV

TSGKDGRFRVEGLEYGTYYLWELQAPTGYVQLTSPVSFTIGKDTRKELVT

VVKNNKRPRID*VPDTG*EETLYILMLVAILLFGSGYYLTKKPNN

RrgB (Sp0463) is a cell wall surface anchor protein. RrgB contains a sortase substrate motif IPXTG (SEQ ID NO:133), shown in italics in SEQ ID NO:85.

SEQ ID NO: 85

MKSINKFLTMLAALLLTASSLFSAATVFAAGTTTTSVTVHKLLATDGDMD

KIANELETGNYAGNKVGVLPANAKEIAGVMFVWTNTNNEIIDENGQTLGV

NIDPQTFKLSGAMPATAMKKLTEAEGAKFNTANLPAAKYKIYEIHSLSTY

VGEDGATLTGSKAVPIEIELPLNDVVDAHVYPKNTEAKPKIDKDFKGKAN

PDTPRVDKDTPVNHQVGDVVEYEIVTKIPALANYATANWSDRMTEGLAFN

KGTVKVTVDDVALEAGDYALTEVATGFDLKLTDAGLAKVNDQNAEKTVKI

TYSATLNDKAIVEVPESNDVTFNYGNNPDHGNTPKPNKPNENGDLTLTKT

WVDATGAPIPAGAEATFDLVNAQTGKVVQTVTLTTDKNTVTVNGLDKNTE

YKFVERSIKGYSADYQEITTAGEIAVKNWKDENPKPLDPTEPKVVTYGKK

FVKVNDKDNRLAGAEFVIANADNAGQYLARKADKVSQEEKQLVVTTKDAL

DRAVAAYNALTAQQQTQQEKEKVDKAQAAYNAAVIAANNAFEWVADKDNE

NVVKLVSDAQGRFEITGLLAGTYYLEETKQPAGYALLTSRQKFEVTATSY

SATGQGIEYTAGSGKDDATKVVNKKIT*IPQTG*GIGTIIFAVAGAAIMGIA

VYAYVKNNKDEDQLA

RrgA (Sp0462) is a cell wall surface anchor protein. RrgA contains a sortase substrate motif YPXTG (SEQ ID NO:186), indicated in italics in SEQ ID NO:86.

SEQ ID NO: 86

MLNRETHMKKVRKIFQKAVAGLCCISQLTAFSSIVALAETPETSPAIGKV

VIKETGEGGALLGDAVFELKNNTDGTTVSQRTEAQTGEAIFSNIKPGTYT

LTEAQPPVGYKPSTKQWTVEVEKNGRTTVQGEQVENREEALSDQYPQTGT

YPDVQTPYQIIKVDGSEKNGQHKALNPNPYERVIPEGTLSKRIYQVNNLD

DNQYGIELTVSGKTVYEQKDKSVPLDVVILLDNSNSMSNIRNKNARRAER

AGEATRSLIDKITSDSENRVALVTYASTIFDGTEFTVEKGVADKNGKRLN

DSLFWNYDQTSFTTNTKDYSYLKLTNDKNDIVELKNKVPTEAEDHDGNRL

MYQFGATFTQKALMKADEILTQQARQNSQKVIFHITDGVPTMSYPINFNH

ATFAPSYQNQLNAFFSKSPNKDGILLSDFITQATSGEHTIVRGDGQSYQM

FTDKTVYEKGAPAAFPVKPEKYSEMKAAGYAVIGDPINGGYIWLNWRESI

LAYPFNSNTAKITNHGDPTRWYYNGNIAPDGYDVFTVGIGINGDPGTDEA

-continued

TATSFMQSISSKPENYTNVTDTTKILEQLNRYFHTIVTEKKSIENGTITD

PMGELIDLQLGTDGRFDPADYTLTANDGSRLENGQAVGGPQNDGGLLKNA

KVLYDTTEKRIRVTGLYLGTDEKVTLTYNVRLNDEFVSNKFYDTNGRTTL

HPKEVEQNTVRDFPIPKIRDVRKYPEITISKEKKLGDIEFIDVNDNDKKP

LRGAVFSLQKQHPDYPDIYGAIDQNGTYQNVRTGEDGKLTFKNLSDGKYR

LFENSEPAGYKPVQNKPIVAFQIVNGEVRDVTSIVPQDIPAGYEFTNDKH

YITNEPIPPKRE*YPRTG*GIGMLPFYLIGCMMMGGVLLYTRKHP

RlrA (Sp0461) is a transcriptional regulator. An example of an amino acid sequence for RlrA is set forth in SEQ ID NO:87.

SEQ ID NO: 87

MLNKYIEKRITDKITILNILLDIRSIELDELSTLTSLQSKSLLSILQELQ

ETFEEELTFNLDTQQVQLIEHHSHQTNYYFHQLYNQSTILKILRFFLLQG

NQSFNEFTQKEYISIATGYRVRQKCGLLLRSVGLDLVKNQVVGPEYRIRF

LIALLQFHEGTEIYDLNDGSMDWVTHMIVQSNSQLSHELLEITPDEYVHF

SILVALTWKRREFPLEFPESKEFEKLKNLEMYPILMEHCQTYLEPHANMT

FTQEELDYIFLVYCSANSSFSKDKWNQEKKTHTIQLILQHTRGKHLLSKE

KNILGNDISNSLSFLTALTFLTRTFLEGLQNLVPYYNYYEHYGIESDKPL

YHISKAIVQEWMTEQKIEGVIDQHRLYLESLYLTETIFSSLPAIPIKIIL

NNQADVNLTKSIILRNFTDKVASVTGYNILISPPPSEEHLTEPLIIITTK

EYLPYVKKQYPKGKHHFLTIALDLHVSQQRLIYQTIVDIRKEAFDKRVAM

IAKKAHYLL

As discussed above, a *S. pneumoniae* AI sequence is present in the *S. pneumoniae* strain 670 genome. Examples of *S. pneumoniae* AI sequences are set forth below.

Orf1_670 is a transposase. An example of an amino acid sequence of orf1_670 is set forth in SEQ ID NO:171.

SEQ ID NO: 171

MEHINHTTLLIGIKDKNITLNKAIQHDTHIEVFATLDYHPPKCKHCKGKQ

IKYDFQKPSKIPFIEIGGFPSLIHLKKRRFQCKSCRKVTVAETTLVQKNC

QISEMVRQKIAQLLLNREALTHIASKLAISTSTSTVYRKLKQFHFQEDYT

TLPEILSWDEFSYQKGKLAFIAQDFNTKKIMTILDNRRQTTIRNHFFKYS

KEARKKVKVVTVDMSGSYIPLIKKLFPNAKIVLDRFHIVQHMSRALNQTR

INIMKQFDDKSLEYRALKYYWKFILKDSRKLSLKPFYARTFRETLTPREC

LKKTFTLVPELKDYYDLYQLLLFHLQEKNTDQFWGLIQDTLPHLNRTFKT

TLSTFICYKNYITNAIELPYSNAKLEATNKLIKDIKRNAFGFRNFENFKK

RIFIALNTKKERTKFVLSRA

Orf2_670 is a transcriptional regulator. An example of an amino acid sequence of Orf2_670 is set forth in SEQ ID NO:172.

SEQ ID NO: 172

MLNKYIEKRITDKITILNILLDIRSIELDELSTLTSLQSKSLLSILQELQ

ETFEEELTFNLDTQQVQLIEHHSHQTNYYFHQLYNQSTILKILRFFLLQG

-continued

NQSFNEFTQKEYISIATGYRVRQKCGLLLRSVGLDLVKNQVVGPEYRIRF

LIALLQFHEGIEIYDLNDGSMDWVIHMIVQSNSQLSHELLEITPDEYVHF

SILVALTWKRREFPLEFPESKEFEKLKNLFMYPILMEHCQTYLEPHANMT

FTQEELDYIFLVYCSANSSFSKDKWNQEKKTHTIQLILQHTRGKHLLSKF

KNILGNDISNSLSFLTALTFLTRTFLEGLQNLVPYYNYYEHYGIESDKPL

YHISKAIVQEWMTEQKIEGVIDQHRLYLFSLYLTETIFSSLPAIPIFIIL

NNQADVNLIKSIILRNETDKVASVTGYNILISPPPSEEHLTEPLIIITTK

EYLPYVKKQYPKGKHHFLTIALDLHVSQQRLIYQTIVDIRKEAFDKRVAM

IAKKAHYLL

Orf3_670 is a cell wall surface anchor family protein. An example of an amino acid sequence of Orf3_670 is set forth in SEQ ID NO:173.

SEQ ID NO: 173

MLNRETHMKKVRKIFQKAVAGLCCISQLTAFSSIVALAETPETSPAIGKV

VIKETGEGGALLGDAVFELKNNTDGTTVSQRTEAQTGEAIFSNIKPGTYT

LTEAQPPVGYKPSTKQWTVEVEKNGRTTVQGEQVENREEALSDQYPQTGT

YPDVQTPYQIIKVDGSEKNGQHKALNPNPYERVIPEGTLSKRIYQVNNLD

DNQYGIELTVSGKTTVETKEASTPLDVVILLDNSNSMSNIRHNHAHRAEK

AGEATPALVDKITSNPDNRVALVTYGSTIFDGSEATVEKGVADANGKILN

DSALWTEDRTTFTAKTYNYSFLNLTSDPTDIQTIKDRIPSDAEELNKDKL

MYQFGATFTQKALMTADDILTKQARPNSKKVIFHITDGVPTMSYPINFKY

TGTTQSYRTQLNNFKAKTPNSSGILLEDFVTWSADGEHKIVRGDGESYQM

FTKKPVTDQYGVHQILSITSMEQRAKLVSAGYRFYGTDLYLYWRDSILAY

PFNSSTDWITNHGDPTTWYYNGNMAQDGYDVFTVGVGVNGDPGTDEATAT

RFMQSISSSPDNYTNVADPSQILQELNRYFYTIVNEKKSIENGTITDPMG

ELIDFQLGADGRFDPADYTLTANDGSSLVNNVPTGGPQNDGGLLKNAKVE

YDTTEKRIRVTGLYLGTGEKVTLTYNVRLNDQFVSNKEYDTNGRTTLHPK

EVEKNTVRDEPIPKIRDVRKYPEITIPKEKKLGEIEFIKINKNDKKPLRD

AVFSLQKQHPDYPDIYGAIDQNGTYQNVRTGEDGKLTFKNLSDGKYRLFE

NSEPAGYKPVQNKPIVAFQIVNGEVRDVTSIVPQDIPAGYEFTNDKHYIT

NEPIPPKREYPRTGGIGMLPFYLIGCMMMGGVLLYTRKHP

Orf4_670 is a cell wall surface anchor family protein. An example of an amino acid sequence of orf4_670 is set forth in SEQ ID NO:174.

SEQ ID NO: 174

MKSINKFLTMLAALLLTASSLFSAATVFAADNVSTAPDAVTKTLTIHKLL

LSEDDLKTWDTNGPKGYDGTQSSLKDLTGVVAEEIPNVYFELQKYNLTDG

KEKENLKDDSKWTTVHGGLTTKDGLKIETSTLKGVYRIREDRTKTTYVGP

NGQVLTGSKAVPALVTLPLVNNNGTVIDAHVFPKNSYNKPVVDKRIADTL

NYNDQNGLSIGTKIPYVVNTTIPSNATFATSFWSDEMTEGLTYNEDVTIT

LNNVAMDQADYEVTKGNNGFNLKLTEAGLAKINGKDADQKIQITYSATLN

-continued

```
SLAVADIPESNDITYHYGNHQDHGNTPKPTKPNNGQITVTKTWDSQPAPE

GVKATVQLVNAKTGEKVGAPVELSENNWTYTWSGLDNSIEYKVEEEYNGY

SAEYTVESKGKLGVKNWKDNNPAPINPEEPRVKTYGKKFVKVDQKDTRLE

NAQFVVKKADSNKYIAFKSTAQQAADEKAAATAKQKLDAAVAAYTNAADK

QAAQALVDQAQQEYNVAYKEAKFGYVEVAGKDEAMVLTSNTDGQFQISGL

AAGTYKLEEIKAPEGFAKIDDVEFVVGAGSWNQGEFNYLKDVQKNDATKV

VNKKITIPQTGGIGTIIFAVAGAAIMGIAVYAYVKNNKDEDQLA
```

Orf5__670 is a cell wall surface anchor family protein. An example of an amino acid sequence of orf5__670 is set forth in SEQ ID NO:175.

```
                                          SEQ ID NO: 175
MTMQKMQKMISRIFFVMALCFSLVWGAHAVQAQEDHTLVLQLENYQEV

VSQLPSRDGHRLQVWKLDDSYSYDDRVQIVRDLHSWDENKSLLFKKTS

FEMTFLENQIEVSHIPNGLYYVRSIIQTDAVSYPAEFLFEMTDQTVEP

LVIVAKKTDTMTTKVKLIKVDQDHNRLEGVGFKLVSVARDGSEKEVPL

IGEYRYSSSGQVGRTLYTDKNGEIFVTNLPLGNYRFKEVEPLAGYAVT

TLDTDVQLVDHQLVTTTVVNQKLPRGNVDFMKVDGRTNTSLQGAMFKV

MKEESGHYTPVLQNGKEVVVTSGKDGRFRVEGLEYGTYYLWELQAPTG

YVQLTSPVSFTIGKDTRKELVTVVKNNKRPRIDVPDTGEETLYILMLV

AILLFGSGYYLTKKPNN
```

Orf6__670 is a sortase. An example of an amino acid sequence of orf6__670 is set forth in SEQ ID NO:176.

```
                                          SEQ ID NO: 176
MLIKMVKTKKQKRNNLLLGVVFFIGMAVMAYPLVSRLYYRVESNQQIA

DFDKEKATLDEADIDERMKLAQAFNDSLNNVVSGDPWSEEMKKKGRAE

YARMLEIHERMGHVEIPVIDVDLPVYAGTAEEVLQQGAGHLEGTSLPI

GGNSTHAVITAHTGLPTAKMFTDLTKLKVGDKFYVHNIKEVMAYQVDQ

VKVIEPTNFDDLLIVPGHDYVTLLTCTPYMINTHRLLVRGHRIPYVAE

VEEEFIAANKLSHLYRYLFYVAVGLIVILLWIIRRLRKKKKQPEKALK

ALKAARKEVKVEDGQQ
```

Orf7__670 is a sortase. An example of an amino acid sequence of orf7__670 is set forth in SEQ ID NO:177.

```
                                          SEQ ID NO: 177
VSRYYYRIESNEVIKEFDETVSQMDKAELEERWRLAQAFNATLKPSEI

LDPFTEQEKKKGVSEYANMLKVHERIGYVEIPAIDQEIPMYVGTSEEI

LQKGAGLLEGASLPVGGENTHTVVTAHRGLPTAELFSQLDKMKKGDVF

YLHVLDQVLAYQVDQILTVEPNDEEPVLIQHGEDYATLLTCTPYMINS

HRLLVRGKRIPYTAPTAERNRAVRERGQFWLWLLLAALVMILVLSYGV

YRHRRIVKGLEKQLEEHHVKG
```

Orf8__670 is a sortase. An example of an amino acid sequence of orf8__670 is set forth in SEQ ID NO:178.

```
                                          SEQ ID NO: 178
MSKAKLQKLLGYLLMLVALVIPVYCEGQMVLQSLGQVKGHEIFSESVT

ADSYQEQLQRSLDYNQRLDSQNRIVDPFLAEGYEVNYQVSDDPDAVYG

YLSIPSLEIMEPVYLGADYHHLAMGLAHVDGTPLPVEGKGIRSVIAGH

RAEPSHVFFRHLDQLKVGDALYYDNGQEIVEYQMMDTEIILPSEWEKL

ESVSSKNIMTLITCDPIPTFNKRLLVNFERVAVYQKSDPQTAAVARVA

FTKEGQSVSRVATSQWLYRGLVVLAFLGILFVLWKLARLLRGK
```

As discussed above, a *S. pneumoniae* AI sequence is present in the 19A Hungary 6 *S. pneumoniae* genome. Examples of *S. pneumoniae* AI sequences from 19A Hungary 6 are set forth below.

ORF2__19AH is a transcriptional regulator. An example of an amino acid sequence of ORF2__19AH is set forth in SEQ ID NO:187.

```
                                          SEQ ID NO: 187
MLNKYIEKRITDKITILNILLDIRSIELDELSTLTSLQSKSLLSILQE

LQETFEEELTFNLDTQQVQLIEHHSHQTNYYFHQLYNQSTILKILRFF

LLQGNQSFNEFTQKEYISIATGYRVRQKCGLLLRSVGLDLVKNQVVGP

EYRIRFLIALLQFHFGIEIYDLNDGSMDWVTHMIVQSNSQLSHELLEI

TPDEYVHFSILVALTWKRREFPLEFPESKEFEKLKNLFMYPILMEHCQ

TYLEPHANMTFTQEELDYIFLVYCSANSSFSKDKWNQEKKTHTIQLIL

QHTRGKHLLSKFKNILGNDISNSLSFLTALTFLTRTFLFGLQNLVPYY

NYYEHYGIESDKPLYHISKAIVQEWMTEQKIEGVTDQHRLYLFSLYLT

ETIFSSLPAIPIFIILNNQADVNLIKSTILRNFTDKVASVTGYNILIS

PPPSEEHLTEPLIIITTKEYLPYVKKQYPKGKHHFLTIALDLHVSQQR

LIYQTIVDIRKEAFDKRVAMIAKKAHYLL
```

ORF3__19AH is a cell wall surface protein. An example of an amino acid sequence of ORF3__19AH is set forth in SEQ ID NO:188.

```
                                          SEQ ID NO: 188
MKKVRKIFQKAVAGLCCISQLTAFSSIVALAETPETSPAIGKVVIKET

GEGGALLGDAVFELKNNTDGTTVSQRTEAQTGEAIFSNIKPGTYTLTE

AQPPVGYKPSTKQWTVEVEKNGRTTVQGEQVENREEALSDQYPQTGTY

PDVQTPYQIIKVDGSEKNGQHKALNPNPYERVIPEGTLSKRIYQVNNL

DDNQYGIELTVSGKTTVETKEASTPLDVVILLDNSNSMSNTRHNHAHR

AEKAGEATRALVDKITSNPDNRVALVTYGSTIFDGSEATVEKGVADAN

GKILNDSALWTFDRTTFTAKTYNYSFLNLTSDPTDIQTIKDRIPSDAE

ELNKDKLMYQFGATFTQKALMTADDILTKQARPNSKKVIFHITDGVPT

MSYPINFKYTGTTQSYRTQLNNFKAKTPNSSGILLEDFVTWSADGEHK

IVRGDGESYQMFTKKPVTDQYGVHQILSITSMEQRAKLVSAGYRFYGT

DLYLYWRDSILAYPFNSSTDWITNHGDPTTWYYNGNMAQDGYDVFTVG

VGVNGDPGTDEATATRFMQSISSSPDNYTNVADPSQILQELNRYFYTT

VNEKKSIENGTITDPMGELIDFQLGADGRFDPADYTLTANDGSSLVNN

VPTGGPQNDGGLLKNAKVFYDTTEKRIRVTGLYLGTGEKVTLTYNVRL
```

-continued

NDQFVSNKFYDTNGRTTLHPKEVEKNTVRDFPIPKIRDVRKYPEITIP

KEKKLGETEFIKINKNDKKPLRDAVFSLQKQHPDYPDIYGAIDQNGTY

QNVRTGEDGKLTFKNLSDGKYRLFENSEPAGYKPVQNKPIVAFQIVNG

EVRDVTSIVPQDIPAGYEFTNDKHYITNEPIPPKREYPRTGGIGMLPF

YLIGCMMMGGVLLYTRKNP

ORF4__19AH is a cell wall surface protein. An example of an amino acid sequence of ORF4__19AH is set forth in SEQ ID NO:189.

SEQ ID NO: 189

MKSINKFLTMLAALLLTASSLFSAATVFAADNVSTAPDAVTKTLTIHK

LLLSEDDLKTWDTNGPKGYDGTQSSLKDLTGVVAEEIPNVYFELQKYN

LTDGKEKENLKDDSKWTTVHGGLTTKDGLKIETSTLKGVYRIREDRTK

TTYVGPNGQVLTGSKAVPALVTLPLVNNNGTVTDAHVFPKNSYNKPVV

DKRIADTLNYNDQNGLSIGTKTPYVVNTTIPSNATFATSFWSDEMTEG

LTYNEDVTITLNNVAMDQADYEVTKGXNGFNLKLTEAGLAKINGKDAD

QKIQITYSATLNSLAVADIPESNDITYHYGNHQDHGNTPKPTKPNNGQ

ITVTKTWDSQPAPEGVKATVQLVNAKTGEKVGAPVELSENNWTYTWSG

LDNSIEYKVEEEYNGYSAEYTVESKGKLGVKNWKDNNPAPINPEEPRV

KTYGKKFVKVDQKDTRLENAQFVVKKADSNKYIAFKSTAQQAADEKAA

ATAKQKLDAAVAAYTNAADKQAAQALVDQAQQEYNVAYKEAKEGYVEV

AGKDEAMVLTSNTDGQFQISGLAAGTYKLEEIKAPEGFAKIDDVEFVV

GAGSWNQGEFNYLKDVQKNDATKVVNKKITIPQTGGIGTIIFAVAGAA

IMGIAVYAYVKNNKDEDQLA

ORF5__19AH is a cell wall surface protein. An example of an amino acid sequence of ORF5__19AH is set forth in SEQ ID NO:190.

SEQ ID NO: 190

MTMQKMQKMISRIFFVMALCPSLVWGAHAVQAQEDHTLVLQLENYQEV

VSQLPSRDGHRLQVWKLDDSYSYDDRVQIVRDLHSWDENKLSSEKKTS

FEMTFLENQIEVSHIPNGLYYVRSIIQTDAVSYPAEELFEMTDQTVEP

LVIVAKKTDTMTTKVKLIKVDQDHNRLEGVGFKLVSVARDGSEKEVPL

IGEYRYSSSGQVGRTLYTDKNGEIFVTNLPLGNYRFKEVEPLAGYAVT

TLDTDVQLVDHQLVTITVVNQKLPRGNVDEMKVDGRTNTSLQGAMFKV

MKEESGHYTPVLQNGKEVVVTSGKDGRFRVEGLEYGTYYLWELQAPTG

YVQLTSPVSETIGKDTRKELVTVVKNNKRPRTDVPDTGEETLYILMLV

AILLFGSGYYLTKKPNN

ORF6__19AH is a putative sortase. An example of an amino acid sequence of ORF6__19AH is set forth in SEQ ID NO:191.

SEQ ID NO: 191

MLIKMVKTKKQKRNNLLLGVVFFIGMAVMAYPLVSRLYYRVESNQQTA

DFDKEKATLDEADIDERMKLAQAFNDSLNNVVSGDPWSEEMKKKGRAE

YARMLEIHERMGHVEIPVIDVDLPVYAGTAEEVLQQGAGHLEGTSLPI

GGNSTHAVITAHTGLPTAKMFTDLTKLKVGDKFYVHNIKEVMAYQVDQ

VKVIEPTNFDDLLIVPGHDYVTLLTCTPYMINTHRLLVRGHRIPYVAE

VEEEFIAANKLSHLYRYLFYVAVGLIVILLWIIRRLRKKKKQPEKAL

KALKAARKEVKVEDGQQ

ORF7__19AH is a putative sortase. An example of an amino acid sequence of ORF7__19AH is set forth in SEQ ID NO:192.

SEQ ID NO: 192

MDNSRRSRKKGTKKKKHPLILLLIFLVGFAVAIYPLVSRYYYRIESNE

VIKEFDETVSQMDKAELEERWRLAQAFNATLKPSEILDPFTEQEKKKG

VSEYANMLKVHERIGYVEIPAIDQEIPMYVGTSEEILQKGAGLLEGAS

LPVGGENTHTVVTAHRGLPTAELFSQLDKMKKGDVFYLHVLDQVLAYQ

VDQILTVEPNDFEPVLIQHGEDYATLLTCTPYMTNSHRLLVRGKRIPY

TAPIAERNRAVRERGQFWLWLLLAALVMILVLSYGVYRHRRIVKGLEK

QLEEHHVKG

ORF8__19AH is a putative sortase. An example of an amino acid sequence of ORF8__19AH is set forth in SEQ ID NO:193.

SEQ ID NO: 193

MSKAKLQKLLGYLLMLVALVIPVYCFGQMVLQSLGQVKGHEIFSESVT

ADSYQEQLQRSLDYNQRLDSQNRIVDPFLAEGYEVNYQVSDDPDAVYG

YLSIPSLEIMEPVYLGADYHHLAMGLAHVDGTPLPVEGKGIRSVIAGH

PAEPSHVFFRHLDQLKVGDALYYDNGQEIVEYQMMDTEIILPSEWEKL

ESVSSKNIMTLITCDPIPTFNKRLLVNFERVAVYQKSDPQTAAVARVA

FTKEGQSVSRVATSQWLYRGLVVLAFMGILFVLWKLARLLRGK

As discussed above, a *S. pneumoniae* AI sequence is present in the 6B Finland 12 *S. pneumoniae* genome. Examples of *S. pneumoniae* AI sequences from 6B Finland 12 are set forth below.

ORF2__6BF is a transcriptional regulator. An example of an amino acid sequence of ORF2__6BF is set forth in SEQ ID NO:194.

SEQ ID NO: 194

MLNKYIEKRITDKITILNILLDIRSIELDELSTLTSLQSKSLLSILQE

LQETFEEELTFNLDTQQVQLIEHHSHQTNYYFHQLYNQSTILKILRFF

LLQGNQSENEFTQKEYISIATGYRVRQKCGLLLRSVGLDLVKNQVVGP

EYRIRFLIALLQFHFGIEIYDLNDGSMDWVTHMIVQSNSQLSHELLEI

TPDEYVHFSILVALTWKRREFPLEFPESKEFEKLKNLFMYPILMEHGQ

TYLEPHANMTFTQEELDYIFLVYCSANSSFSKDKWNQEKKTHTIQLIL

QHTRGKHLLSKFKNILGNDISNSLSFLTALTFLTRTFLFGLQNLVPYY

NYYEHYGIESDKPLYHISKAIVQEWMTEQKIEGVIDQHRLYLFSLYLT

ETIFSSLPAIPIFIILNNQADVNLIKSIILRNFTDKVASVTGYNILIS

-continued

PPPSEEHLTEPLIIITTKEYLPYVKKQYPKGKHHFLTIALDLHVSQQR

LIYQTIVDIRKEAFDKRVAMIAKKAHYLL

ORF3__6BF is a cell wall surface protein. An example of an amino acid sequence of ORF3__6BF is set forth in SEQ ID NO:195.

SEQ ID NO: 195
MKKVRKIFQKAVAGLCCISQLTAFSSIVALAETPETSPAIGKVVIKET

GEGGALLGDAVFELKNNTDGTTVSQRTEAQTGEAIFSNIKPGTYTLTE

AQPPVGYKPSTKQWTVEVEKNGRTTVQGEQVENREEALSDQYPQTGTY

PDVQTPYQIIKVDGSEKNGQHKALNPNPYERVIPEGTLSKRTYQVNNL

DDNQYGIELTVSGKTTVETKEASTPLDVVILLDNSNSMSNIRHNHAHR

AEKAGEATRALVDKITSNPDNRVALVTYGSTIFDGSEATVEKGVADAN

GKILNDSALWTFDRTTFTAKTYNYSFLNLTSDPTDIQTIKDRIPSDAE

ELNKDKLMYQFGATFTQKALMTADDILTKQARPNSKKVIFHITDGVPT

MSYPINFKYTGTTQSYRTQLNNFKAKTPNSSGILLEDFVTWSADGEHK

IVRGDGESYQMFTKKPVTDQYGVHQILSITSMEQRAKLVSAGYRFYGT

DLYLYWRDSILAYPFNSSTDWITNHGDPTTWYYNGNMAQDGYDVFTVG

VGVNGDPGTDEATATRFMQSISSSPDNYTNVADPSQILQELNRYFYTI

VNEKKSIENGTITDPMGELIDFQLGADGRFDPADYTLTANDGSSLVNN

VPTGGPQNDGGLLKNAKVFYDTTEKRIRVTGLYLGTGEKVTLTYNVRL

NDQFVSNKEYDTNGRTTLHPKEVEKNTVRDFPIPKIRDVRKYPEITTP

KEKKLGEIEFIKINKNDKKPLRDAVFSLQKQHPDYPDIYGAIDQNGTY

QNVRTGEDGKLTFKNLSDGKYRLFENSEPAGYKPVQNKPIVAFQIVNG

EVRDVTSIVPQDIPAGYEFTNDKHYITNEPIPPKREYPRTGGIGMLPE

YLIGCMMMGGVLLYTRKHP

ORF4__6BF is a cell wall surface protein. An example of an amino acid sequence of ORF4__6BF is set forth in SEQ ID NO:196.

SEQ ID NO: 196
MKSINKFLTMLAALLLTASSLFSAATVFAADNVSTAPDAVTKTLTIHK

LLLSEDDLKTWDTNGPKGYDGTQSSLKDLTGVVAEEIPNVYFELQKYN

LTDGKEKENLKDDSKWTTVHGGLTTKDGLKIETSTLKGVYRIREDRTK

TTYVGPNGQVLTGSKAVPALVTLPLVNNNGTVIDAHVFPKNSYNKPVV

DKRIADTLNYNDQNGLSIGTKIPYVVNTTIPSNATFATSFWSDEMTEG

LTYNEDVTITLNNVAMDQADYEVTKGNNGFNLKLTEAGLAKINGKDAD

QKIQITYSATLNSLAVADIPESNDITYHYGNHQDHGNTPKPTKPNNGQ

ITVTKTWDSQPAPEGVKATVQLVNAKTGEKVGAPVELSENNWTYTWSG

LDNSIEYKVEEEYNGYSAEYTVESKGKLGVKNWKDNNPAPINPEEPRV

KTYGKKFVKVDQKDTRLENAQFVVKKADSNKYIAFKSTAQQAADEKAA

ATAKQKLDAAVAAYTNAADKQAAQALVDQAQQEYNVAYKEAKFGYVEV

AGKDEAMVLTSNTDGQFQISGLAAGTYKLEEIKAPEGFAKIDDVEFVV

GAGSWNQGEFNYLKDVQKNDATKVVNKKITIPQTGGIGTIIEAVAGAA

IMGIAVYAYVKNNKDEDQLA

ORF5__6BF is a cell wall surface protein. An example of an amino acid sequence of ORF5__6BF is set forth in SEQ ID NO:197.

SEQ ID NO: 197
MTMQKMQKMISRIFFVMALCFSLVWGAHAVQAQEDHTLVLQLENYQEV

VSQLPSRDGHRLQVWKLDDSYSYDDRVQIVRDLHSWDENKLSSFKKTS

FEMTFLENQIEVSHIPNGLYYVRSIIQTDAVSYPAEFLFEMTDQTVEP

LVIVAKKTDTMTTKVKLIKVDQDHNRLEGVGFKLVSVARDGSEKEVPL

IGEYRYSSSGQVGRTLYTDKNGEIFVTNLPLGNYRFKEVEPLAGYAVT

TLDTDVQLVDHQLVTITVVNQKLPRGNVDFMKVDGRTNTSLQGAMFKV

MKEESGHYTPVLQNGKEVVVTSGKDGRFRVEGLEYGTYYLWELQAPTG

YVQLTSPVSFTIGKDTRKELVTVVKNNKRPRIDVPDTGEETLYILMLV

AILLFGSGYYLTKKPNN

ORF6__6BF is a putative sortase. An example of an amino acid sequence of ORF6__6BF is set forth in SEQ ID NO:198.

SEQ ID NO: 198
MLIKMVKTKKQKRNNLLLGVVFFIGMAVMAYPLVSRLYYRVESNQQIA

DFDKEKATLDEADIDERMKLAQAFNDSLNNVVSGDPWSEEMKKKGRAE

YARMLEIHERMGHVEIPVIDVDLPVYAGTAEEVLQQGAGHLEGTSLPT

GGNSTHAVITAHTGLPTAKMFTDLTKLKVGDKFYVHNIKEVMAYQVDQ

VKVIEPTNFDDLLIVPGHDYVTLLTCTPYMINTHRLLVRGHRIPYVAE

VEEEFIAANKLSHLYRYLFYVAVGLIVILLWIIRRLRKKKKQPEKALK

ALKAARKEVKVEDGQQ

ORF7__6BF is a putative sortase. An example of an amino acid sequence of ORF7__6BF is set forth in SEQ ID NO:199.

SEQ ID NO: 199
MDNSRRSRKKGTKKKKHPLILLLIFLVGFAVAIYPLVSRYYYRIESNE

VIKEFDETVSQMDKAELEERWRLAQAFNATLKPSEILDPFTEQEKKKG

VSEYANMLKVHERIGYVEIPAIDQEIPMYVGTSEEILQKGAGLLEGAS

LPVGGENTHTVVTAHRGLPTAELFSQLDKMKKGDVFYLHVLDQVLAYQ

VDQILTVEPNDFEPVLIQHGEDYATLLTCTPYMINSHRLLVRGKRIPY

TAPIAERNRAVRERGQFWLWLLLAALVMILVLSYGVYRHRRIVKGLEK

QLEEHHVKG

ORF8__6BF is a putative sortase. An example of an amino acid sequence of ORF8__6BF is set forth in SEQ ID NO:200.

SEQ ID NO: 200
MSKAKLQKLLGYLLMLVALVTPVYCFGQMVLQSLGQVKGHEIFSESVT

ADSYQEQLQRSLDYNQRLDSQNRIVDPFLAEGYEVNYQVSDDPDAVYG

YLSIPSLETMEPVYLGADYHHLAMGLAHVDGTPLPVEGKGIRSVIAGH

RAEPSHVFFRHLDQLKVGDALYYDNGQEIVEYQMMDTEIILPSEWEKL

ESVSSKNIMTLITCDPIPTFNKRLLVNFERVAVYQKSDPQTAAVARVA

PTKEGQSVSRVATSQWLYRGLWLAFLGILFVLWKLARLLRGK

As discussed above, a *S. pneumoniae* AI sequence is present in the 6B Spain 2 *S. pneumoniae* genome. Examples of *S. pneumoniae* AI sequences from 6B Spain 2 are set forth below.

ORF2__6BSP is a transcriptional regulator. An example of an amino acid sequence of ORF2__6BSP is set forth in SEQ ID NO:201.

SEQ ID NO: 201

```
MLNKYIEKRITDKITILNILLDIRSIELDELSTLTSLQSKSLLSTLQE
LQETFEEELTFNLDTQQVQLTEHHSHQTNYYFHQLYNQSTILKILRFF
LLQGNQSFNEFTQKEYISIATGYRVRQKCGLLLRSVGLDLVKNQVVGP
EYRIRFLIALLQFHFGIEIYDLNDGSMDWVTHMIVQSNSQLSHELLEI
TPDEYVHFSILVALTWKRREFPLEFPESKEFEKLKNLFMYPILMEHCQ
TYLEPHANMTFTQEELDYIFLVYCSANSSFSKDKWNQEKKTHTIQLIL
QHTRGKHLLSKFKNILGNDISNSLSPLTALTFLTRTFLFGLQNLVPYY
NYYEHYGIESDKPLYHISKAIVQEWMTEQKIEGVIDQHRLYLFSLYLT
ETIFSSLPAIPIFITLNNQADVNLTKSIILRNFTDKVASVTGYNILIS
PPPSEEHLTEPLIIITTKEYLPYVKKQYPKGKHHFLTIALDLHVSQQR
LIYQTIVDTRKEAFDKRVAMIAKKAHYLL
```

ORF3__6BSP is a cell wall surface protein. An example of an amino acid sequence of ORF3__6BSP is set forth in SEQ ID NO:202.

SEQ ID NO: 202

```
MKKVRKIFQKAVAGLCCISQLTAFSSIVALAETPETSPAIGKVVIKET
GEGGALLGDAVFELKNNTDGTTVSQRTEAQTGEAIFSNIKPGTYTLTE
AQPPVGYKPSTKQWTVEVEKNGRTTVQGEQVENREEALSDQYPQTGTY
PDVQTPYQIIKVDGSEKNGQHKALNPNPYERVIPEGTLSKRIYQVNNL
DDNQYGIELTVSGKTTVETKEASTPLDVVILLDNSNSMSNIRHNHAHR
AEKAGEATRALVDKITSNPDNRVALVTYGSTIFDGSEATVEKGVADAN
GKILNDSALWTFDRTTFTAKTYNYSFLNLTSDPTDIQTIKDRIPSDAE
ELNKDKLMYQFGATFTQKALMTAKKILTKQARPNSKKVIFHITDGVPT
MSYPINFKYTGTTQSYRTQLNNFKAKTPNSSGILLEDFVTWSADGEHK
IVRGDGESYQMFTKKPVTDQYGVHQILSITSMEQRAKLVSAGYRFYGT
DLYLYWRDSILAYPFNSSTDWITNHGDPTTWYYNGNMAQDGYDVFTVG
VGVNGDPGTDEATATRFMQSISSSPDNYTNVADPSQILQELNRYEYTI
VNEKKSIENGTITDPMGELIDFQLGADGRFDPADYTLTANDGSSLVNN
VPTGGPQNDGGLLKNAKVFYDTTEKRTRVTGLYLGTGEKVTLTYNVRL
NDQFVSNKFYDTNGRTTLHPKEVEKNTVRDFPIPKIRDVRKYPEITIP
KEKKLGEIEFIKINKNDKKPLRDAVFSLQKQHPDYPDIYGAIDQNGTY
QNVRTGEDGKLTFKNLSDGKYRLFENSEPAGYKPVQNKPIVAFQIVNG
EVRDVTSIVPQDIPAGYEFTNDKHYITNEPIPPKREYPRTGGIGMLPF
YLIGCMMMGGVLLYTRKHP
```

ORF4__6BSP is a cell wall surface protein. An example of an amino acid sequence of ORF4__6BSP is set forth in SEQ ID NO:203.

SEQ ID NO: 203

```
MSKINKFLTMLAALLLTASSLFSAATVFAADNVSTAPDAVTKTLTIHK
LLLSEDDLKTWDTNGPKGYDGTQSSLKDLTGVVAEEIPNVYFELQKYN
LTDGKEKENLKDDSKWTTVHGGLTTKDGLKIETSTLKGVYRTREDRTK
TTYVGPNGQVLTGSKAVPALVTLPLVNNNGTVTDAHVFPKNSYNKPVV
DKRIADTLNYNDQNGLSIGTKIPYVVNTTIPSNATFATSFWSDEMTEG
LTYNEDVTITLNNVAMDQADYEVTKGNNGFNLKLTEAGLAKINGKDAD
QKIQITYSATLNSLAVADIPESNDTTYHYGNHQDHGNTPKPTKPNNGQ
ITVTKTWDSQPAPEGVKATVQLVNAKTGEKVGAPVELSENNWTYTWSG
LDNSIEYKVEEEYNGYSAEYTVESKGKLGVKNWKDNNPAPINPEEPRV
KTYGKKFVKVDQKDTRLENAQFVVKKADSNKYIAFKSTAQQAADEKAA
ATAKQKLDAAVAAYTNAADKQAAQALVDQAQQEYNVAYKEAKPGYVEV
AGKDEAMVLTSNTDGQEQISGLAAGTYKLEEIKAPEGFAKIDDVEFVV
GAGSWNQGEFNYLKDVQKNDATKVVNKKITIPQTGGIGTIIFAVAGAA
IMGIAVYAYVKNNKDEDQLA
```

ORF5__6BSP is a cell wall surface protein. An example of an amino acid sequence of ORF5__6BSP is set forth in SEQ ID NO:204.

SEQ ID NO: 204

```
MTMQKMQKMISRIFFVMALCFSLVWGAHAVQAQEDHTLVLQLENYQEV
VSQLPSRDGHRLQVWKLDDSYSYDDRVQIVRDLHSWDENKLSSFKKTS
FEMTFLENQIEVSHIPNGLYYVRSIIQTDAVSYPAEFLFEMTDQTVEP
LVIVAKKTDTMTTKVKLIKVDQDHNRLEGVGFKLVSVARDGSEKEVPL
IGEYRYSSSGQVGRTLYTDKNGEIFVTNLPLGNYRFKEVEPLAGYAVT
TLDTDVQLVDHQLVTITVVNQKLPRGNVDFMKVDGRTNTSLQGAMFKV
MKEESGHYTPVLQNGKEVVVTSGKDGRFRVEGLEYGTYYLWELQAPTG
YVQLTSPVSFTIGKDTRKELVTVVKNNKRPRIDVPDTGEETLYILMLV
AILLFGSGYYLTKKPNN
```

ORF6__6BSP is a putative sortase. An example of an amino acid sequence of ORF6__6BSP is set forth in SEQ ID NO:205.

SEQ ID NO: 205

```
MLIKMVKTKKQKRNNLLLGVVFFIGMAVMAYPLVSRLYYRVESNQQIA
DFDKEKATLDEADIDERMKLAQAFNDSLNNVVSGDPWSEEMKKKGRAE
YARMLEIHERMGHVETPVIDVDLPVYAGTAEEVLQQGAGHLEGTSLPI
GGNSTHAVITAHTGLPTAKMFTDLTKLKVGDKFYVHNIKEVMAYQVDQ
VKVIEPTNFDDLLIVPGHDYVTLLTCTPYMINTHRLLVRGHRIPYVAE
VEEEFTAANKLSHLYRYLFYVAVGLIVILLWIIRRLRKKKKQPEKALK
ALKAARKEVKVEDGQQ
```

ORF7__6BSP is a putative sortase. An example of an amino acid sequence of ORF7__6BSP is set forth in SEQ ID NO:206.

SEQ ID NO: 206
MDNSRRSRKKGTKKKKHPLILLLIFLVGFAVAIYPLVSRYYYRIESNE
VIKEFDETVSQMDKAELEERWRLAQAFNATLKPSEILDPFTEQEKKKG
VSEYANMLKVHERIGYVEIPAIDQEIPMYVGTSEEILQKGAGLLEGAS
LPVGGENTHTVVTAHRGLPTAELFSQLDKMKKGDVFYLHVLDQVLAYQ
VDQILTVEPNDFEPVLIQHGEDYATLLTCTPYMINSHRLLVRGKRIPY
TAPIAERNRAVRERGQFWLKLLLAALVMILVLSYGVYRHRRIVKGLEK
QLEEHHVKG

ORF8__6BSP is a putative sortase. An example of an amino acid sequence of ORF8__6BSP is set forth in SEQ ID NO:207.

SEQ ID NO: 207
MSKAKLQKLLGYLLMLVALVIPVYCFGQMVLQSLGQVKGHEIFSESVT
ADSYQEQLQRSLDYNQRLDSQNRIVDPFLAEGYEVNYQVSDDPDAVYG
YLSIPSLETMEPVYLGADYHHLAMGLAHVDGTPLPVEGKGIRSVIAGH
RAEPSHVFFRHLDQLKVGDALYYDNGQEIVEYQMMDTEIILPSEWEKL
ESVSSKNIMTLITCDPTPTFNKRLLVNGERVAVYQKSDPQTAAVARVA
FTKEGQSVSRVATSQWLYRGLVVLAFLGILFVLWKLARLLRGK

As discussed above, a *S. pneumoniae* AI sequence is present in the 9V Spain 3 *S. pneumoniae* genome. Examples of *S. pneumoniae* AI sequences from 9V Spain 3 are set forth below.

ORF2__9VSP is a transcriptional regulator. An example of an amino acid sequence of ORF2__9VSP is set forth in SEQ ID NO:208.

SEQ ID NO: 208
MLNKYIEKRITDKITILNILLDIRSIELDELSTLTSLQSKSLLSILQE
LQETFEEELTFNLDTQQVQLIEHHSHQTNYYFHQLYNQSTILKILREE
LLQGNQSFNEFTQKEYISIATGYRVRQKCGLLLRSVGLDLVKNQVVGP
EYRIRFLIALLQFHFGIEIYDLNDGSMDWVTHMTVQSNSQLSHELLEI
TPDEYVHFSILVALTWKRREFPLEFPESKEFEKLKNLFMYPILMEHCQ
TYLEPHANMTFTQEELDYIFLVYCSANSSFSKDKWNQEKKTHTIQLIL
QHTRGKHLLSKFKNILGNDISNSLSFLTALTFLTRTFLFGLQNLVPYY
NYYEHYGIESDKPLYHISKAIVQEWMTEQKIEGVIDQHRLYLFSLYLT
ETIFSSLPAIPIFIILNNQADVNLIKSIILRNFTDKVASVTGYNILIL
SPPPSEEHLTEPLIITTKEYLPYVKKQYPKGKHHFLTTALDLHVSQQR
LIYQTIVDIRKEAFDKRVAMIAKKAHYLL

ORF3__9VSP is a cell wall surface protein. An example of an amino acid sequence of ORF3__9VSP is set forth in SEQ ID NO:209.

SEQ ID NO: 209
MKKVRKIFQKAVAGLCCISQLTAFSSIVALAETPETSPAIGKVVIKET
GEGGALLGDAVFELKNNTNGTTVSQRTEAQTGEAIFSNIKPGTYTLTE
AQPPVGYKPSTKQRTVEVEKNGRTTVQGEQVENREEALSDQYPQTGTY

-continued

PDVQTPYQIIKVDGSEKNGQHKALNPNPYERVIPEGTLSKRIYQVNNL
DDNQYGIELTVSGKTVYERKDKSVPLDVVILLDNSNSMSNIRNKNARR
AERAGEATRSLIDKITSDPENRVALVTYASTIFDGTEFTVEKGVADKN
GKRLNDSLFWNYDQTSFTTNTKDYSYLKLTNDKNDIVELKNKVPTEAE
DHDGNRLMYQFGATFTQKALMKADEILTQQARQNSQKVIFHITDGVPT
MSYPINFNHATFAPSYQNQLNAFFSKSPNKDGILLSDFITQATSGEHT
IVRGDGQSYQMFTDKTVYEKGAPAAFPVKPEKYSEMKAVGYAVIGDPI
NGGYIWLNWRESILAYPFNSNTAKITNHGDPTRWYYNGNIAPDGYDVF
TVGIGINGDPGTDEATATSFMQSISSKPENYTNVTDTTKILEQLNRYF
HTIVTEKKSIENGTITDPMGELIDLQLGTDGRFDPADYTLTANDGSRL
ENGQAVGGPQNDGGLLKNAKVFYDTTEKRIRVTGLYLGTGEKVTLTYN
VRLNDQFVSNKFYDTNGRTTLHPKEVEKNTVRDFPIPKIRDVRKYPAI
TIAKEKKLGEIEFIKINKNDKKPLRDAVFSLQKQHPDYPDIYGAIDQN
GTYQNVRTGEDGKLTFKNLSDGKYRLFENSEPAGYKPVQNKPIVAFQI
VNGEVRDVISTVPQDIPAGYEFTNDKHYITNEPIPPKREYPRTGGIGM
LLFYLIGCMMMGGVLLYTRKHP

ORF4__9VSP is a cell wall surface protein. An example of an amino acid sequence of ORF4__9VSP is set forth in SEQ ID NO:210.

SEQ ID NO: 210
MKSINKFLTMLAALLLTASSLFSAATVFAAGTTTTSVTVHKLLATDGD
MDKIANELETGNYAGNKVGVLPANAKEIAGVMFVWTNTNNEIIDENGQ
TLGVNIDPQTFKLSGAMPATAMKKLTEAEGAKFNTANLPAAKYKIYEI
HSLSTYVGEDGATLTGSKAVPIEIELPLNDVVDAHVYPKNTEAKPKID
KDFKGKANPDTPRVDKDTPVNHQVGDVVEYEIVTKIPALANYATANWS
DRMTEGLAFNKGTVKVTVDDVALEAGDYALTEVATGFDLKLTDAGLAK
VNDQNAEKTVKITYSATLNDKAIVEVPESNDVTFNYGNNPDHGNTPKP
NKPNENGDLTLTKTWVDATGAPIPAGAEATFDLVNAQTGDVVQTVTLT
TDKNTVTVNGLDKNTEYKFVERSIKGYSADYQEITTAGEIAVKNWKDE
NPKPLDPTEPKVVTYGKKFVKVNDKDNRLAGAEFVIANADNAGQYLAR
KADKVSQEEKQLVVTTKDALDRAVAAYNALTAQQQTQQEKEKVDKAQA
AYNAAVTAANNAFEWVADKDNENVVKLVSDAQGRFEITGLLAGTYYLE
ETKQPAGYALLTSRQKFEVTATSYSATGQGIEYTAGSGKDDATKVVNK
KITIPQTGGIGTIIFAVAGAVIMGIAVYAYVKNNKDEDQLA

ORF5__9VSP is a cell wall surface protein. An example of an amino acid sequence of ORF5__9VSP is set forth in SEQ ID NO:211.

SEQ ID NO: 211
MTMQKMQKMQKMQKMQKMQKMISRIFFVMALCFSLVWGAHAVQAQEDH
TLVLQLENYQEVVSQLPSRDGHRLQVWKLDDSYSYDNRVQTVRDLHSK
DENKLSSFKKTSFEMTFLENQIEVSHIPNGLYYVRSIIQTDAVSYPAE
FLFEMTDQTVEPLVIVAKKADTVTTKVKLIKVDQDHNRLEGVGFKLVS

-continued

VARDGSEKEVPLIGEYRYSSSGQVGRTLYTDKNGEIVVTNLPLGTYRF

KEVEPLAGYTVTTMDTDVQLVDHQLVTITVVNQKLPRGNVDFMKVDGR

TNTSLQGAMFKVMKEENGHYTPVLQNGKEVVVASGKDGRFRVEGLEYG

TYYLWELQAPTGYVQLTSPVSFTIGKDTRKELVTVVKNNKRPRIDVPD

TGEETLYILMLVAILLFGSGYYLTKKTNN

ORF6__9VSP is a putative sortase. An example of an amino acid sequence of ORF6__9VSP is set forth in SEQ ID NO:212.

SEQ ID NO: 212

MLIKMAKTKKQKRNNLLLGVVFFIGIAVMAYPLVSRLYYRVESNQQIA

DFDKEKATLDEADIDERMKLAQAFNDSLNNVVSGDPWSEEMKKKGRAE

YARMLEIHERMGHVEIPAIDVDLPVYAGTAEEVLQQGAGHLEGTSLPI

GGNSTHAVTTAHTGLPTAKMFTDLTKLKVGDKFYVHNIKEVMAYQVDQ

VKVIEPTNFDDLLIVPGHDYVTLLTCTPYMINTHRLLVRGHRIPYVAE

VEEEFIAANKLSHLYRYLFYVAVGLIVILLWIIRRLRKKKRQSERALK

ALKEATKEVKVEDE

ORF7__9VSP is a putative sortase. An example of an amino acid sequence of ORF7__9VSP is set forth in SEQ ID NO:213.

SEQ ID NO: 213

MSKSRYSRKKSVKKKKNPFILLLIFLVGLAVANYPLVSRYYYRIESNE

VIKEFDETVSQMDKAELEERWRLAQAFNATLKPSEILDPFTEQEKKKG

VSEYANMLKVHERTGYVEIPAIDQEIPMYVGTSEEILQKGAGLLEGAS

LPVGGENTHTVVTAHRGLPTAELFSQLDKMKKGDIEYLHVLDQVLAYQ

VDQIVTVEPNDFEPVLIQHGEDYATLLTCTPYMINSHRLLVRGKRIPY

TAPIAERNRAVRERGQFWLWLLLGAMAVILLLLYRVYRNRRIVKGLEK

QLEGRHVKD

ORF8__9VSP is a putative sortase. An example of an amino acid sequence of ORF8__9VSP is set forth in SEQ ID NO:214.

SEQ ID NO: 214

MSRTKLRALLGYLLMLVACLIPIYGFGQMVLQSLGQVKGHATFVKSMT

TEMYQEQQNHSLAYNQRLASQNRIVDPELAEGYEVNYQVSDDPDAVYG

YLSIPSLEIMEPVYLGADYHHLGMGLAHVDGTPLPLDGTGIRSVIAGH

PAEPSHVFTRHLDQLKVGDALYYDNGQEIVEYQMMDTEIILPSEWEKL

ESVSSKNIMTLITCDPIPTFNKRLLVNEERVAVYQKSDPQTAAVARVA

FTKEGQSVSRVATSQWLYRGLWLAFLGILFVLWKLARLLRGK

As discussed above, a *S. pneumoniae* AI sequence is present in the 14 CSR 10 *S. pneumoniae* genome. Examples of *S. pneumoniae* AI sequences from 14 CSR 10 are set forth below.

ORF2__14CSR is a transcriptional regulator. An example of an amino acid sequence of ORF2__14CSR is set forth in SEQ ID NO:215.

SEQ ID NO: 215

MLNKYIEKRITDKITILNILLDIRSIELDELSTLTSLQSKSLLSILQE

LQETFEEELTFNLDTQQVQLIEHHSHQTNYYFHQLYNQSTILKTLRFF

LLQGNQSFNEFTQKEYISIATGYRVRQKCGLLLRSVGLDLVKNQVVGP

EYRIRFLIALLQFHFGIEIYDLNDGSMDWVTHMIVQSNSQLSHELLEI

TPDEYVHFSILVALTWKRREFPLEFPESKEFEKLKNLFMYPILMEHCQ

TYLEPHANMTFTQEELDYIFLVYCSANSSFSKDKWNQEKKTHTTQLIL

QHTRGKHLLSKFKNILGNDISNSLSFLTALTFLTRTFLFGLQNLVPYY

NYYEHYGIESDKPLYHTSKATVQEWMTEQKIEGVTDQHRLYLFSLYLT

ETIFSSLPAIPIFIILNNQADVNLIKSIILRNFTDKVASVTGYNILIS

PPPSEEHLTEPLIIITTKEYLPYVKKQYPKGKHHFLTIALDLHVSQQR

LIYQTIVDIRKEAFDKRVAMIAKKAHYLL

ORF3__14CSR is a cell wall surface protein. An example of an amino acid sequence of ORF3__14CSR is set forth in SEQ ID NO:216.

SEQ ID NO: 216

MKKVRKIFQKAVAGLCCISQLTAFSSIVALAETPETSPAIGKVVIKET

GEGGALLGDAVFELKNNTDGTTVSQRTEAQTGEAIFSNIKPGTYTLTE

AQPPVGYKPSTKQWTVEVEKNGRTTVQGEQVENREEALSDQYPQTGTY

PDVQTPYQIIKVDGSEKNGQHKALNPNPYERVIPEGTLSKRIYQVNNL

DDNQYGIELTVSGKTTVETKEASTPLDVVTLLDNSNSMSNIRHNHAHR

AEKAGEATRALVDKITSNPDNRVALVTYGSTIFDGSEATVEKGVADAN

GKILNDSALWTFDRTTFTAKTYNYSFLNLTSDPTDIQTIKDRIPSDAE

ELNKDKLMYQFGATFTQKALMTADDILTKQARPNSKKVIFHITDGVPT

MSYPINFKYTGTTQSYRTQLNNFKAKTPNSSGILLEDFVTWSADGEHK

IVRGDGESYQMFTKKPVTDQYGVHQILSITSMEQRAKLVSAGYRFYGT

DLYLYWRDSILAYPFNSSTDWITNHGDPTTWYYNGNMAQDGYDVFTVG

VGVNGDPGTDEARARTFMQSISSSPDNYTNVADPSQILQELNRYFYTI

VNEKKSIENGTITDPMGELIDFQLGADGRFDPADYTLTANDGSSLVNN

VPTGGPQNDGGLLKNAKVFYDTTEKRIRVTGLYLGTGEKVTLTYNVRL

NDQFVSNKFYDTNGRTTLHPKEVEKNTVRDFPIPKIRDVRKYPEITIP

KEKKLGEIEFIKINKNDKKPLRDAVPSLQKQHPDYPDIYGAIDQNGTY

QNVRTGEDGKLTEKNLSDGKYRLFENSEPAGYKPVQNKPIVAFQIVNG

EVRDVTSIVPQDIPAGYEFTNDKHYITNEPTPPKREYPRTGGIGMLPF

YLTGCMMMGGVLLYTRKHP

ORF4__14CSR is a cell wall surface protein. An example of an amino acid sequence of ORF4__14CSR is set forth in SEQ ID NO:217.

SEQ ID NO: 217

MKSINKFLTMLAALLLTASSLFSAATVFAADNVSTAPDAVTKTLTIHK

LLLSEDDLKTWDTNGPKGYDGTQSSLKDLTGVVAEEIPNVYFELQKYN

LTDGKEKENLKDDSKWTTVHGGLTTKDGLKIETSTLKGVYRIREDRTK

-continued

TTYVGPNGQVLTGSKAVPALVTLPLVNNNGTVIDAHVFPKNSYNKPVV

DKRTADTLNYNDQNGLSIGTKIPYVVNTTIPSNATFATSFKSDEMTEG

LTYNEDVTITLNNVAMDQADYEVTKGNNGFNLKLTEAGLAKINGKDAD

QKIQITYSATLNSLAVADIPESNDITYHYGNHQDHGNTPKPTKPNNGQ

ITVTKTWDSQPAPEGVKATVQLVNAKTGEKVGAPVELSENNWTYTWSG

LDNSIEYKVEEEYNGYSAEYTVESKGKLGVKNWKDNNPAPINPEEPRV

KTYGKKFVKVDQKDTRLENAQFVVKKADSNKYIAFKSTAQQAADEKAA

ATAKQKLDAAVAAYTNAADKQAAQALVDQAQQEYNVAYKEAKFGYVEV

AGKDEAMVLTSNTDGQFQISGLAAGTYKLEEIKAPEGFAKIDDVEFVV

GAGSWNQGEFNYLKDVQKNDATKVVNKKITIPQTGGIGTIIFAVAGAA

IMGIAVYAYVKNNKDEDQLA

ORF5__14CSR is a cell wall surface protein. An example of an amino acid sequence of ORF5__14CSR is set forth in SEQ ID NO:218.

SEQ ID NO: 218

MTMQKMQKMISRIFFVMALCFSLVWGAHAVQAQEDHTLVLQLENYQEV

VSQLPSRDGHRLQVWKLDDSYSYDDRVQIVRDLHSWDENKLSSFKKTS

FEMTFLENQIEVSHIPNGLYYVRSIIQTDAVSYPAEFLFEMTDQTVEP

LVIVAKKTDTMTTKVKLIKVDQDHNRLEGVGFKLVSVARDGSEKEVPL

IGEYRYSSSGQVGRTLYTDKNGETFVTNLPLGNYRFKEVEPLAGYAVT

TLDTDVQLVDHQLVTITVVNQKLPRGNVDFMKVDGRTNTSLQGAMFKV

MKEESGHYTPVLQNGKEVVVTSGKDGRFRVEGLEYGTYYLWELQAPTG

YVQLTSPVSFTIGKDTRKELVTVVKNNKRPRIDVPDTGEETLYILMLV

AILLFGSGYYLTKKPNN

ORF6__14CSR is a putative sortase. An example of an amino acid sequence of ORF6__14CSR is set forth in SEQ ID NO:219.

SEQ ID NO: 219

MLIKMVKTKKQKRNNLLLGVVFFIGMAVMAYPLVSRLYYRVESNQQIA

DFDKEKATLDEADIDERMKLAQAFNDSLNNVVSGDPWSEEMKKKGRAE

YARMLEIHERMGHVEIPVIDVDLPVYAGTAEEVLQQGAGHLEGTSLPI

GGNSTHAVITAHTGLPTAKMFTDLTKLKVGDKFYVHNIKEVMAYQVDQ

VKVIEPTNFDDLLIVPGHDYVTLLTCTPYMINTHRLLVRGHRIPYVAE

VEEEFIAANKLSHLYRYLFYVAVGLIVILLWIIRRLRKKKKQPEKALK

ALKAARKEVKVEDGQQ

ORF7__14CSR is a putative sortase. An example of an amino acid sequence of ORF7__14CSR is set forth in SEQ ID NO:220.

SEQ ID NO: 220

MDNSRRSRKKGTKKKKHPLILLLIFLVGFAVAIYPLVSRYYYRIESNE

VIKEFDETVSQMDKAELEERWRLAQAFNATLKPSEILDPFTEQEKKKG

VSEYANMLKVHERIGYVEIPAIDQEIPMYVGTSEEILQKGAGLLEGAS

-continued

LPVGGENTHTVVTAHRGLPTAELFSQLDKMKKGDVFYLHVLDQVLAYQ

VDQILTVEPNDFEPVLIQHGEDYATLLTCTPYMINSHRLLVRGKRIPY

TAPIAERNRAVRERGQEWLWLLLAALVMILVLSYGVYRHRRIVKGLEK

QLEEHHVKG

ORF8__14CSR is a putative sortase. An example of an amino acid sequence of ORF8__14CSR is set forth in SEQ ID NO:221.

SEQ ID NO: 221

MSKAKLQKLLGYLLMLVALVIPVYCFGQMVLQSLGQVKGHEIFSESVT

ADSYQEQLQRSLDYNQRLDSQNRIVDPFLAEGYEVNYQVSDDPDAVYG

YLSIPSLEIMEPVYLGADYHHLAMGLAHVDGTPLPVEGKGIRSVIAGH

PAEPSHVFFRHLDQLKVGDALYYDNGQEIVEYQMMDTEIILPSEWEKL

ESVSSKNIMTLITCDPIPTPNKRLLVNFERVAVYQKSDPQTAAVARVA

FTKEGQSVSRVATSQWLYRGLWLAFLGTLFVLWKLARLLRGK

As discussed above, a *S. pneumoniae* AI sequence is present in the 19F Taiwan 14 *S. pneumoniae* genome. Examples of *S. pneumoniae* AI sequences from 19F Taiwan 14 are set forth below.

ORF2__19FTW is a transcriptional regulator. An example of an amino acid sequence of ORF2__19FTW is set forth in SEQ ID NO:222.

SEQ ID NO: 222

MLNKYIEKRITDKITILNILLDIRSTELDELSTLTSLQSKSLLSILQE

LQETFEEELTFNLDTQQVQLIEHHSHQTNYYFHQLYNQSTILKTLRFF

LLQGNQSENEFTQKEYISIATGYRVRQKCGLLLRSVGLDLVKNQVVGP

EYRIRFLTALLQFHFGTEIYDLNDGSMDWVTHMIVQSNSQLSHELLEI

TPDEYVHESTLVALTWKRREFPLEFPESKEFEKLKNLFMYPILMEHCQ

TYLEPHANMTFTQEELDYIFLVYCSANSSFSKDKWNQEKKTHTIQLIL

QHTRGKHLLSKFKNILGNDISNSLSFLTALTFLTRTFLFGLQNLVPYY

NYYEHYGIESDKPLYHISKAIVQEWMTEQKIEGVIDQHRLYLFSLYLT

ETIFSSLPAIPIFIILNNQADVNLIKSIILRNFTDKVASVTGYNILTS

PPPSEEHLTEPLIIITTKEYLPYVKKQYPKGKHHFLTIALDLHVSQQR

LIYQTIVDIRKEAFDKRVAMIAKKAHYLL

ORF3__19FTW is a cell wall surface protein. An example of an amino acid sequence of ORF3__19FTW is set forth in SEQ ID NO:223.

SEQ ID NO: 223

MKKVRKIFQKAVAGLCCISQLTAFSSIVALAETPETSPAIGKVVIKET

GEGGALLGDAVFELKNNTDGTTVSQRTEAQTGEAIESNIKPGTYTLTE

AQPPVGYKPSTKQWTVEVEKNGRTTVQGEQVENREEALSDQYPQTGTY

PDVQTPYQIIKVDGSEKNGQHKALNPNPYERVTPEGTLSKRIYQVNNL

DDNQYGIELTVSGKTVYERKDKSVPLDVVILLDNSNSMSNIRNKNARR

AERAGEATRSLIDKITSDPENRVALVTYASTIPDGTEFTVEKGVADKN

GKRLNDSLFWNYDQTSFTTNTKDYSYLKLTNDKNDIVELKNKVPTEAE

-continued

```
DHDGNRLMYQFGATFTQKALMKADEILTQQARQNSQKVIFHITDGVPT
MSYPINFNHATFAPSYQNQLNAFFSKSPNKDGILLSDFITQATSGEHT
IVRGDGQSYQMFTDKTVYEKGAPAAFPVKPEKYSEMKAVGYAVIGDPI
NGGYIWLNWRESILAYPFNSNTAKITNHGAPTRWYYNGNIAPDGYDVF
TVGIGINGDPGTDEATATSFMQSISSKPENYTNVTDTTKILEQLNRYF
HTIVTEKKSIENGTITDPMGELIDLQLGTDGRFDPADYTLTANDGSRL
ENGQAVGGPQNDGGLLKNAKVFYDTTEKRIRVTGLYLGTGEKVTLTYN
VRLNDQEVSNKFYDTNGRTTLHPKEVEKNTVRDFPIPKIRDVRKYPAI
TIAKEKKLGEIEFIKINKNDKKPLRDAVFSLQKQHPDYPDIYGAIDQN
GTYQNVRTGEDGKLTFKNLSDGKYRLFENSEPAGYKPVQNKPIVAFQI
VNGEVRDVTSIVPQDIPAGYEFTNDKHYITNEPIPPKREYPRTGGIGM
LPFYLIGCMMMGGVLLYTRKHP
```

ORF4__19FTW is a cell wall surface protein. An example of an amino acid sequence of ORF4__19FTW is set forth in SEQ ID NO:224.

```
                                                SEQ ID NO: 224
MKSINKFLTMLAALLLTASSLFSAATVFAAGTTTTSVTVHKLLATDGD
MDKIANELETGNYAGNKVGVLPANAKEIAGVMFVWTNTNNEIIDENGQ
TLGVNIDPQTFKLSGAMPATAMKKLTEAEGAKFNTANLPAAKYKIYEI
HSLSTYVGEDGATLTGSKAVPIEIELPLNDVVDAHVYPKNTEAKPKID
KDFKGKANPDTPRVDKDTPVNHQVGDVVEYEIVTKIPALANYATANWS
DRMTEGLAFNKGTVKVTVDDVALEAGDYALTEVATGFDLKLTDAGLAK
VNDQNAEKTVKITYSATLNDKAIVEVPESNDVTFNYGNNPDHGNTPKP
NKPNENGDLTLTKTWVDATGAPIPAGAEATFDLVNAQTGKVVQTVTLT
TDKNTVTVNGLDKNTEYKFVERSIKGYSADYQEITTAGEIAVKNWKDE
NPKPLDPTEPKVVTYGKKFVKVNDKDNRLAGAEFVTANADNAGQYLAR
KADKVSQEEKQLVVTTKDALDRAVAAYNALTAQQQTQQEKEKVDKAQA
AYNAAVIAANNAFEWVADKDNENVVKLVSDAQGRFEITGLLAGTYYLE
ETKQPAGYALLTSRQKFEVTATSYSATGQGIEYTAGSGKDDATKWNKK
ITIPQTGGIGTIIFAVAGAVIMGIAVYAYVKNNKDEDQLA
```

ORF5__19FTW is a cell wall surface protein. An example of an amino acid sequence of ORF5__19FTW is set forth in SEQ ID NO:225.

```
                                                SEQ ID NO: 225
MTMQKMQKMTSRIFFVIMALCFSLVWGAHAVQAQEDHTLVLQLENYQE
WSQLPSRDGHRLQVKKLDDSYSYDNRVQIVRDLHSWDENKLSSFKKTS
FEMTFLENQIEVSHIPNGLYYVRSIIQTDAVSYPAEFLFEMTDQTVEP
LVIVAKKADTVTTKVKLIKVDQDHNRLEGVGFKLVSVARDGSEKEVPL
IGEYRYSSSGQVGRTLYTDKNGEIVVTNLPLGTYRFKEVEPLAGYTVT
TMDTDVQLVDHQLVTITVVNQKLPRGNVDFMKVDGRTNTSLQGAMFKV
MKEENGHYTPVLQNGKEVVVASGKDGRFRVEGLEYGTYYLWELQAPTG
```

-continued

```
YVQLTSPVSFTIGKDTRKELVTVVKNNKRPRIDVPDTGEETLYILMLV
AILLFGSGYYLTKKTNN
```

ORF6__19FTW is a putative sortase. An example of an amino acid sequence of ORF6__19FTW is set forth in SEQ ID NO:226.

```
                                                SEQ ID NO: 226
MLIKMAKTKKQKRNNLLLGVVFFIGMAVMAYPLVSRLYYRVESNQQIA
DFDKEKATLDEADTDERMKLAQAFNDSLNNVVSGDPWSEEMKKKGRAE
YARMLEIHERMGHVEIPAIDVDLPVYAGTAEEVLQQGAGHLEGTSLPI
GGNSTHAVITAHTGLPTAKMFTDLTKLKVGDKFYVHNIKEVMAYQVDQ
VKVIEPTNFDDLLIVPGHDYVTLLTCTPYMINTHRLLVRGHRIPYVAE
VEEEFIAANKLSHLYRYLFYVAVGLIVILLWIIRRLRKKKRQSERALK
ALKEATKEVKVEDE
```

ORF7__19FTW is a putative sortase. An example of an amino acid sequence of ORF7__19FTW is set forth in SEQ ID NO:227.

```
                                                SEQ ID NO: 227
MSKSRYSRKKSVKKKKNPFILLLIFLVGLAVAMYPLVSRYYYRIESNE
VTKEFDETVSQMDKAELEERWRLAQAFNATLKPSEILDPFTDQEKKQG
VSEYANMLKVHERIGYVEIPAIEQEIPMYVGTSEDILQKGAGLLEGAS
LPVGGENTHTVITAHRGLPTAELFSQLDKMKKGDIFYLHVLDQVLAYQ
VDQIVTVEPNDFEPVLIQHGQDYATLLTCTPYMLNSHRLLVRGKRTPY
TAPIAERNRAVRERGQFWLWLLLGAMAVILLLLYRVYRNRRTVKGLEK
QLEGRHVKD
```

ORF8__19FTW is a putative sortase. An example of an amino acid sequence of ORF8__19FTW is set forth in SEQ ID NO:228.

```
                                                SEQ ID NO: 228
MSRTKLRALLGYLLMLVACLIPIYCFGQMVLQSLGQVKGHATFVKSMT
TEMYQEQQNHSLAYNQRLASQNRIVDPFLAEGYEVNYQVSDDPDAVYG
YLSIPSLEIMEPVYLGADYHHLGMGLAHVDGTPLPLDGTGIRSVIAGH
RAEPSHVFFRHLDQLKVGDALYYDNGQEIVEYQMMDTEIILPSEWEKL
ESVSSKNIMTLITCDPIPTFNKRLLVNFERVAVYQKSDPQTAAVARVA
FTKEGQSVSRVATSQWLYRGLWLAFLGILFVLWKLARLLRGK
```

As discussed above, a *S. pneumoniae* AI sequence is present in the 23F Taiwan 15 *S. pneumoniae* genome. Examples of *S. pneumoniae* AI sequences from 23F Taiwan 15 are set forth below.

ORF2__23FTW is a transcriptional regulator. An example of an amino acid sequence of ORF2__23FTW is set forth in SEQ ID NO:229.

```
                                                SEQ ID NO: 229
MLNKYIEKRITDKITILNILLDIRSIELDELSTLTSLQSKSLLSILQE
LQETFEEELTPNLDTQQVQLIEHHSHQTNYYFHQLYNQSTILKILRFF
```

```
LLQGNQSFNEFTQKEYISIATGYRVRQKCGLLLRSVGLDLVKNQVVGP
EYRIRFLIALLQFHFGIEIYDLNDGSMDWVTHMIVQSNSQLSHELLET
TPDEYVHFSILVALTWKRREFPLEFPESKEFEKLKNLFMYPILMEHCQ
TYLEPHANMTFTQEELDYIFLVYCSANSSFSKDKWNQEKKTHTIQLIL
QHTRGKHLLSKFKNILGNDISNSLSFLTALTFLTRTFLFGLQNLVPYY
NYYEHYGIESDKPLYHISKAIVQEKMTEQKIEGVIDQHRLYLFSLYLT
ETIFSSLPAIPIFIILNNQADVNLIKSIILRNFTDKVASVTGYNILIS
PPPSEEHLTEPLITITTKEYLPYVKKQYPKGKHHFLTIALDLHVSQQR
LIYQTIVDIRKEAFDKRVAMIAKKAHYLL
```

ORF3_23FTW is a cell wall surface protein. An example of an amino acid sequence of ORF3_23FTW is set forth in SEQ ID NO:230.

```
                                           SEQ ID NO: 230
MKKVRKIFQKAVAGLCCISQLTAFSSIVALAETPETSPAIGKVVIKET
GEGGALLGDAVFELKNNTDGTTVSQRTEAQTGEAIFSNIKPGTYTLTE
AQPPVGYKPSTKQWTVEVEKNGRTTVQGEQVENREEALSDQYPQTGTY
PDVQTPYQIIKVDGSEKNGQHKALNPNPYERVIPEGTLSKRIYQVNNL
DDNQYGIELTVSGKTVYEQKDKSVPLDVVILLDNSNSMSNIRNKNARR
AERAGEATRSLIDKITSDPENRVALVTYASTIFDGTEFTVEKGVADKN
GKRLNDSLFWNYDQTSFTTNTKDYSYLKLTNDKNDIVELKNKVPTFAE
DHDGNRLMYQFGATFTQKALMKADEILTQQARQNSQKVIFHITDGVPT
MSYPINFNHATFAPSYQNQLNAETSKSPNKDGILLSDFITQATSGEHT
IVRGDGQSYQMFTDKTVYEKGAPAAFPVKPEKYSEMKAAGYAVIGDPI
NGGYIWLNWRESILAYPFNSNTAKITNHGDPTRWYYNGNIAPDGYDVF
TVGIGINGDPGTDEATATSFMQSISSKPENYTNVTDTTKILEQLNRYF
HTIVTEKKSIENGTITDPMGELIDLWLGTDGRFDPADYTLTANDGSRL
ENGQAVGGPQNDGGLLKNAKVLYDTTEKRIRVTGLYLGTKEKVTLTYN
VRLNDEFVSNKFYDTNGRTTLHPKEVEQNTVRDFPIPKIRDVRKYPEI
TISKEKKLGDIEFIKVNKNDKKPLRDAVFSLQKQHPDYPDIYGAIDQN
GTYQNVRTGEDGKLTFKNLSDGKYRLFENSEPAGYKPVQNKPIVAFQI
VNGEVRDVTSIVPQDIPAGYEFTNDKHYITNEPIPPKREYPRTGGIGM
LPFYLIGCMMMGGVLLYTRKHP
```

ORF4_23FTW is a cell wall surface protein. An example of an amino acid sequence of ORF4_23FTW is set forth in SEQ ID NO:231.

```
                                           SEQ ID NO: 231
MKSINKFLTILAALLLTVSSLFSAATVFAAEQKTKTLTVHKLLMTDQE
LDAWNSDAITTAGYDGSQNFEQFKQLQGVPQGVTEISGVAFELQSYTG
PQGKEQENLTNDAVWTAVNKGVTTETGVKFDTEVLQGTYRLVEVRKES
TYVGPNGKVLTGMKAVPALITLPLVNQNGVVENAHVYPKNSEDKPTAT
KTFDTAAGFVDPGEKGLAIGTKVPYIVTTTIPKNSTLATAPWSDEMTE
GLDYNGDVVVNYNGQPLDNSHYTLEAGHNGFILKLNEKGLEAINGKDA
EATITLKYTATLNALAVADVPEANDVTFHYGNNPGHGNTPKPNKPKNG
ELTITKTWADAKDAPIAGVEVTFDLVNAQTGEVVKVPGHETGIVLNQT
NNWTFTATGLDNNTEYKFVERTIKGYSADYQTITETGKIAVKNWKDEN
PEPINPEEPRVKTYGKKFVKVDQKDERLKEAQFVVKNEQGKYLALKSA
AQQAVNEKAAAEAKQALDAAIAAYTNAADKNAAQAVVDAAQKTYNDNY
RAARFGYVEVERKEDALVLTSNTDGQFQISGLAAGSYTLEETKAPEGF
AKLGDVKFEVGAGSWNQGDFNYLKDVQKNDATKVVNKKITIPQTGGIG
TIIFAVAGAVIMGIAVYAYVKNNKDEDQLA
```

ORF5_23FTW is a cell wall surface protein. An example of an amino acid sequence of ORF5_23FTW is set forth in SEQ ID NO:232.

```
                                           SEQ ID NO: 232
MTMQKMQKMISRIFFVMALCFSLVWGAHAVQAQEDHTLVLQLENYQEV
VSQLPSRDGHRLQVWKLDDSYSYDNRVQIVRDLHSWDENKLSSFKKTS
EEMTFLENQIEVSHIPNGLYYVRSIIQTDAVSYPAEFLFEMTDQTVEP
LVIVAKKADTVTTKVKLIKVDQDHNRLEGVGFKLVSVARDGSEKEVPL
IGEYRYSSSGQVGRTLYTDKNGEIVVTNLPLGTYRFKEVEPLAGYTVT
TMDTDVQLVDHQLVTITVVNQKLPRGNVDFMKVDGRTNTSLQGAMFKV
MKEENGHYTPVLQNGKEVVVASGKDGRFRVEGLEYGTYYLWELQAPTG
YVQLTSPVSFTIGKDTRKELVTVVKNNKRPRIDVPDTGEETLYILMLV
AILLFGSGYYLTKKTNN
```

ORF6_23FTW is a putative sortase. An example of an amino acid sequence of ORF6_23FTW is set forth in SEQ ID NO:233.

```
                                           SEQ ID NO: 233
MLIKMVKTKKQKRNNLLLGVVFFIGMAVMAYPLVSRLYYRVESNQQIA
DFDKEKATLDEADIDERMKLAQAFNDSLNNVVSGDPWSEEMKKKGRAE
YARMLEIHERMGHVEIPVIDVDLPVYAGTAEEVLOOGAGOLEGTSLPI
GGNSTHAVITAHTGLPTAKMFTDLTKLKVGDKFYVHNIKEVMAYQVDQ
VKVIEPTNFDDLLIVPGHDYVTLLTCTPYMINTHRLLVRGHRIPYVAE
VEEEFIAANKLSHLYRYLFYVAVGLIVILLWIIRRLRKKKKQPEKALK
ALKAARKEVKVEDGQQ
```

ORF7_23FTW is a putative sortase. An example of an amino acid sequence of ORF7_23FTW is set forth in SEQ ID NO:234.

```
                                           SEQ ID NO: 234
MDNSRRSRKKGTKKKKHPLILLLIFLVGFAVAIYPLVSRYYYRIESNE
VIKEFDETVSQMDKAELEERWRLAQAFNATLKPSEILDPFThQEKKKG
VSEYANMLKVHERIGYVEIPAIDQEIPMYVGTSEEILQKGAGLLEGAS
LPVGGENTHTVVTAHRGLPTAELFSQLDKMKKGDVFYLHVLDQVLAYQ
VDQILTVEPNDFEPVLIQHGKDYATLLTCTPYMINSHRLLVRGKRIPY
TAPIAERNRAVRERGQFWLWLLLAALVMILVLSYGVYRHRRIVKGLEK
QLEEHHVKG
```

ORF8_23FTW is a putative sortase. An example of an amino acid sequence of ORF8_23FTW is set forth in SEQ ID NO:235.

SEQ ID NO: 235
MSKAKLQKLLGYLLMLVALVIPVYCFGQMVLQSLGQVKGHETFSESVT
ADSYQEQLQRSLDYNQRLDSQNRIVDPFLAEGYEVNYQVSDDPDAVTG
YLSIPSLEIMEPVYLGADYHHLAMGLAHVDGTPLPVEGKGTRSVIAGH
PAEPSHVFFRHLDQLKVCDALYYDNGOEIVEYQMMDTEIILPSEWEKL
ESVSSKNIMTLITCDPIPTFNKRLLVNFERVAVYQKSDPQTAAVARVA
FTKEGQSVSRVATSQWLYRGLWLAFLGILFVLWKLARLLRGK

As discussed above, a *S. pneumoniae* AI sequence is present in the 23F Poland 16 *S. pneumoniae* genome. Examples of *S. pneumoniae* AI sequences from 23F Poland 16 are set forth below.

ORF2_23FP is a transcriptional regulator. An example of an amino acid sequence of ORF2_23FP is set forth in SEQ ID NO:236.

84 + TR,
SEQ ID NO: 236
MLNKYIEKRITDKITILNILLDIRSIELDELSTLTSLQSKSLLSILQE
LQETFEEELTFNLDTQQVQLIEHHSHQTNYYFHQLYNQSTILKILRFF
LLQGNQSFNEFTQKEYISIATGYRVRQKCGLLLRSVGLDLVKNQVVGP
EYRIRFLIALLQFHFGIEIYDLNDGSMDWVTHMIVQSNSQLSHELLEI
TPDEYVHFSILVALTWKRREFPLEFPESKEFEKLKNLFMYPILMEHCQ
TYLEPHANMTFTQEELDYIFLVYCSANSSFSKDKWNQEKKTHTIQLIL
QHTRGKHLLSKFKNILGNDISNSLSFLTALTFLTRTFLFGLQNLVPYY
NYYEHYGIESDKPLYHISKATVQEWMTEQKIEGVIDQHRLYLFSLYLT
ETIFSSLPAIPIFIILNNQADVNLIKSIILRNFTDKVASVTGYNILIS
PPPSEEHLTEPLIIIITTKEYLPYVKKQYPKGKHHELTIALDLHVSQQR
LIYQTIVDIRKEAFDKRVANIAKKAHYLL

ORF3_23FP is a cell wall surface protein. An example of an amino acid sequence of ORF3_23FP is set forth in SEQ ID NO:237.

SEQ ID NO: 237
MKKVRKIFQKAVAGLCCISQLTAFSSIVALAETPETSPAIGKVVIKET
GEGGALLGDAVFELKNNTDGTTVSQRTEAQTGEAIFSNIKPGTYTLTE
AQPPVGYKPSTKQWTVEVEKNGRTTVQGEQVENREEALSDQYPQTGTY
PDVQTPYQIIKVDGSEKNGQHKALNPNPYERVIPEGTLSKRIYQVNNL
DDNQYGIELTVSGKTTVETKEASTPLDVVTLLDNSNSMSNIRHNHAHR
AEKAGEATRALVDKITSNPDNRVALVTYGSTIFDGSEATVEKGVADAN
GKTLNDSALWTEDRTTFTAKTYNYSFLNLTSDPTDIQTIKDRIPSDAE
ELNKDKLMYQFGATFTQKALMTADDILTKQARPNSKKVIFHITDGVPT
MSYPINFKYTGTTQSYRTQLNNFKAKTPNSSGILLEDFVTWSADGEHK
IVRGDGESYQMFTKKPVTDQYGVHQILSITSMEQRAKLVSAGYRFYGT
DLYLYWRDSILAYPFNSSTDWITNHGDPTTWYYNGNMAQDGYDVFTVG

-continued

VGVNGDPGTDEATATRFMQSISSSPDNYTNVADPSQILQELNRYFYTI
VNEKKSIENGTITDPMGELIDFQLGADGRFDPADYTLTANDGSSLVNN
VPTGGPQNDGGLLKNAKVFYDTTEKRIRVTGLYLGTGEKVTLTYNVRL
NDQFVSNKFYDTNGRTTLHPKEVEKNTVRDFPIPKIRDVRKYPEITIP
KEKKLGEIEFIKINKNDKKPLRDAVFSLQKQHPDYPDIYGAIDQNGTY
QNVRTGEDGKLTFKNLSDGKYRLFENSEPAGYKPVQNKPIVAFQIVNG
EVRDVTSIVPQDIPAGYEETNDKHYITNEPIPPKREYPRTGGIGMLPF
YLIGCMMMGGVLLYTRKNP

ORF4_23FP is a cell wall surface protein. An example of an amino acid sequence of ORF4_23FP is set forth in SEQ ID NO:238.

SEQ ID NO: 238
MKSINKFLTMLAALLLTASSLFSAATVFAADNVSTAPDAVTKTLTIHK
LLLSEDDLKTWDTNGPKGYDGTQSSLKDLTGVVAEEIPNVYFELQKYN
LTDGKEKENLKDDSKWTTVHGGLTTKDGLKIETSTLKGVYRIREDRTK
TTYVGPNGQVLTGSKAVPALVTLPLVNNNGTVIDAHVEPKNSYNKPVV
DKRIADTLNYNDQNGLSIGTKIPYVVNTTIPSNATFATSFWSDEMTEG
LTYNEDVTITLNNVAMDQADYEVTKGINGFNLKLTEAGLAKINGKDAD
QKIQITYSATLNSLAVADIPESNDITYHYGNHQDHGNTPKPTKPNNGQ
ITVTKTWDSQPAPEGVKATVQLVNAKTGEKVGAPVELSENNWTYTWSG
LDNSIEYKVEEEYNGYSAEYTVESKGKLGVKNWKDNNPAPINLEEPRV
KTYGKKFVKVDQKDTRLENAQFVVKKADSNKYIAFKSTAQQAADEKAA
ATAKQKLDAAVAAYTNAADKQAAQALVDQAQQEYNVAYKEAKFGYVEV
AGKDEAMVLTSNTDGQFQISGLAAGTYKLEEIKAPEGFAKIDDVEFVV
GAGSWNQGEFNYLKDVQKNDATKVVNKKITIPQTGGIGTIIFAVAGAV
IMGIAVYAYVKNNKDEDQLA

ORF5_23FP is a cell wall surface protein. An example of an amino acid sequence of ORF5_23FP is set forth in SEQ ID NO:239.

SEQ ID NO: 239
MTMQKMQKMISRIFFVMALCFSLVWGAHAVQAQEDHTLVLQLENYQEV
VSQLPSRDGHRLQVWKLDDSYSYDNRVQIVRDLHSWDENKLSSFKKTS
FEMTFLSNQIEVSHIPNGLYYVRSIIQTDAVSYPAEFLFEMTDQTVEP
LVIVAKKADTVTTKVKLIKVDQDHNRLEGVGFKLVSVARDGSEKEVPL
IGEYRYSSSGQVGRTLYTDKNGEIVVTNLPLGTYRFKEVEPLAGYAVT
TMDTDVQLVDHQLVTITVVNQKLPRGNVDFMKVDGRTNTSLQGAMFKV
MKEENGHYTPVLQNGKEVVVASGKDGRFRVEGLEYGTYYLWELQAPTG
YVQLTSPVSFTIGKDTRKELVTVVKNNKRPRTDVPDTGEETLYILMLV
AILLFGSGYYLTKKTNN

ORF6_23FP is a putative sortase. An example of an amino acid sequence of ORF6_23FP is set forth in SEQ ID NO:240.

SEQ ID NO: 240

```
MLIKMAKTKKQKRNNLLLGVVFFIGIAVMAYPLVSRLYYRVESNQQIA
DFDKEKATLDEADIDERMKLAQAFNDSLNNVVSGDPWSEEMKKKGRAE
YARMLEIHERMGHVETPAIDVDLPVYAGTAEEVLQQGAGHLEGTSLPI
GGNSTHAVITAHTGLPTAKMFTDLTKLKVGDKFYVHNIKEVMAYQVDQ
VKVIEPTNFDDLLIVPGHDYVTLLTCTPYMINTHRLLVRGHRIPYVAE
VEEEFIAANKLSHLYRYLFYVAVGLIVILLWIIRRLRKKKRQSERALK
ALKEATKEVKVEDE
```

ORF7_23FP is a putative sortase. An example of an amino acid sequence of ORF7_23FP is set forth in SEQ ID NO:241.

SEQ ID NO: 241

```
MSKSRYSRKKSVKKKKNPFILLLIFLVGLAVAMYPLVSRYYYRIESNE
VIKEFDETVSQMDKAELEERWRLAQAFNATLKPSEILDPFTEQEKKKG
VSEYANMLKVHERIGYVEIPAIDQEIPMYVGTSEETLQKGAGLLEGAS
LPVGGENTHTVVTAHRGLPTAELFSQLDKMKKGDIFYLHVLDQVLAYQ
VDQIVTVEPNDFEPVLIQHGEDYATLLTCTPYMINSHRLLVRGKRIPY
TAPIAERNRAVRERGQFWLWLLLGAMAVILLLLYRVYRNRRIVKGLEK
QLEGRHVKD
```

ORF8_23FP is a putative sortase. An example of an amino acid sequence of ORF8_23FP is set forth in SEQ ID NO:242.

SEQ ID NO: 242

```
MSKSRYSRKKSVKKKKNPFILLLIFLVGLAVAMYPLVSRYYYRIESNE
VIKEFDETVSQMDKAELEERWRLAQAFFLAEGYEVNYQVSDDPDAVYG
YLSIPSLEIMEPVYLGADYHHLGMGLAHVDGTPLPLDGTGIRSVIAGH
PAEPSHVEFRHLDQLKVGDALYYDNGQEIVEYQMMDTEIILPSEWEKL
ESVSSKNIMTLITCDPIPTFNKRLLVNFERVAVYQKSDPQTAAVARVA
FTKEGQSVSRVATSQWLYRGLWLAFLGILFVLWKLARLLRGK
```

Immunogenic compositions of the invention comprising AI antigens may further comprise one or more antigenic agents. Preferred antigens include those listed below. Additionally, the compositions of the present invention may be used to treat or prevent infections caused by any of the below-listed microbes. Antigens for use in the immunogenic compositions include, but are not limited to, one or more of the following set forth below, or antigens derived from one or more of the following set forth below:

Bacterial Antigens

*N. meningitides*: a protein antigen from *N. meningitides* serogroup A, C, W135, Y, and/or B (1-7); an outer-membrane vesicle (OMV) preparation from *N. meningitides* serogroup B. (8, 9, 10, 11); a saccharide antigen, including LPS, from *N. meningitides* serogroup A, B, C W135 and/or Y, such as the oligosaccharide from serogroup C (see PCT/US99/09346; PCT IB98/01665; and PCT IB99/00103);

*Streptococcus pneumoniae*: a saccharide or protein antigen, particularly a saccharide from *Streptococcus pneumoniae;*

*Streptococcus agalactiae*: particularly, Group B *Streptococcus* antigens;

*Streptococcus pyogenes*: particularly, Group A *Streptococcus* antigens;

*Enterococcus faecalis* or *Enterococcus faecium*: Particularly a trisaccharide repeat or other *Enterococcus* derived antigens provided in U.S. Pat. No. 6,756,361;

*Helicobacter pylori*, including: Cag, Vac, Nap, HopX, HopY and/or urease antigen;

*Bordetella pertussis*: such as petussis holotoxin (PT) and filamentous haemagglutinin (FHA) from *B. pertussis*, optionally also combination with pertactin and/or agglutinogens 2 and 3 antigen;

*Staphylococcus aureus*: including *S. aureus* type 5 and 8 capsular polysaccharides optionally conjugated to nontoxic recombinant *Pseudomonas aeruginosa* exotoxin A, such as StaphVAX™, or antigens derived from surface proteins, invasins (leukocidin, kinases, hyaluronidase), surface factors that inhibit phagocytic engulfment (capsule, Protein A), carotenoids, catalase production, Protein A, coagulase, clotting factor, and/or membrane-damaging toxins (optionally detoxified) that lyse eukaryotic cell membranes (hemolysins, leukotoxin, leukocidin);

*Staphylococcus epidermis*: particularly, *S. epidermidis* slime-associated antigen (SAA);

*Staphylococcus saprophyticus*: (causing urinary tract infections) particularly the 160 kDa hemagglutinin of *S. saprophyticus* antigen;

*Pseudomonas aeruginosa*, particularly, endotoxin A, Wzz protein, *P. aeruginosa* LPS, more particularly LPS isolated from PAO1 (O5 serotype), and/or Outer Membrane Proteins, including Outer Membrane Proteins F (OprF) (Infect Immun. 2001 May; 69 (5): 3510-3515);

*Bacillus anthracis* (anthrax): such as *B. anthracis* antigens (optionally detoxified) from A-components (lethal factor (LF) and edema factor (EF)), both of which can share a common B-component known as protective antigen (PA);

*Moraxella catarrhalis*. (respiratory) including outer membrane protein antigens (HMW-OMP), C-antigen, and/or LPS;

*Yersinia pestis* (plague): such as F1 capsular antigen (Infect Immun 2003 January; 71 (1)): 374-383, LPS (Infect Immun. 1999 October; 67 (10): 5395), *Yersinia pestis* V antigen (Infect Immun 1997 November; 65 (11): 4476-4482);

*Yersinia enterocolitica* (gastrointestinal pathogen): particularly LPS (Infect Immun. 2002 August; 70 (8): 4414);

*Yersinia pseudotuberculosis*: gastrointestinal pathogen antigens;

*Mycobacterium tuberculosis*: such as lipoproteins, LPS, BCG antigens, a fusion protein of antigen 85B (Ag85B) and/or ESAT-6 optionally formulated in cationic lipid vesicles (Infect Immun. 2004 October; 72(10): 6148), *Mycobacterium tuberculosis* (Mtb) isocitrate dehydrogenase associated antigens (Proc Natl Acad Sci USA. 2004 Aug. 24; 101 (34): 12652), and/or MPT51 antigens (Infect Immun 2004 July; 72(7): 3829);

*Legionella pneumophila* (Legionnairs' Disease): *L. pneumophila* antigens—optionally derived from cell lines with disrupted asd genes (Infect Immun 1998 May; 66 (5): 1898);

*Rickettsia*: including outer membrane proteins, including the outer membrane protein A and/or B (OmpB) (Biochim Biophys Acta. 2004 Nov. 1; 1702 (2): 145), LPS, and surface protein antigen (SPA) (J. Autoimmun. 1989 June; 2 Suppl: 81);

*E. coli*: including antigens from enterotoxigenic *E. coli* (ETEC), enteroaggregative *E. coli* (EAggEC), diffusely adhering *E. coli* (DAEC), enteropathogenic *E. coli* (EPEC), and/or enterohemorrhagic *E. coli* (EHEC);

*Vibrio cholerae*: including proteinase antigens, LPS, particularly lipopolysaccharides of *Vibrio cholerae* II, O1 Inaba O-specific polysaccharides, *V. cholera O*139, antigens of IEM108 vaccine (Infect Immun. 2003 October; 71 (10):5498-504), and/or Zonula occludens toxin (Zot);

*Salmonella typhi* (typhoid fever): including capsular polysaccharides preferably conjugates (Vi, i.e. vax-TyVi);

*Salmonella typhimurium* (gastroenteritis): antigens derived therefrom are contemplated for microbial and cancer therapies, including angiogenesis inhibition and modulation of flk;

*Listeria monocytogenes* (sytemic infections in immuno-compromised or elderly people, infections of fetus): antigens derived from *L. monocytogenes* are preferably used as carriers/vectors for intracytoplasmic delivery of conjugates/associated compositions of the present invention;

*Porphyromonas gingivalis*: particularly, *P. gingivalis* outer membrane protein (OMP);

*Tetanus*: such as tetanus toxoid (TT) antigens, preferably used as a carrier protein in conjunction/conjugated with the compositions of the present invention;

*Diphtheria*: such as a diphtheria toxoid, preferably $CRM_{197}$, additionally antigens capable of modulating, inhibiting or associated with ADP ribosylation are contemplated for combination/co-administration/conjugation with the compositions of the present invention, the diphtheria toxoids are preferably used as carrier proteins;

*Borrelia burgdorferi* (Lyme disease): such as antigens associated with P39 and P13 (an integral membrane protein, Infect Immun. 2001 May; 69 (5): 3323-3334), VlsE Antigenic Variation Protein (J Clin Microbiol. 1999 December; 37 (12): 3997);

*Haemophilis influenzae* B: such as a saccharide antigen therefrom;

*Klebsiella*: such as an OMP, including OMP A, or a polysaccharide optionally conjugated to tetanus toxoid;

*Neiserria gonorrhoeae*: including, a Por (or porin) protein, such as PorB (see Zhu et al., Vaccine (2004) 22:660-669), a transferring binding protein, such as ThpA and TbpB (See Price et al., Infection and Immunity (2004) 71 (1):277-283), a opacity protein (such as Opa), a reduction-modifiable protein (Rmp), and outer membrane vesicle (OMV) preparations (see Plante et al., J Infectious Disease (2000) 182:848-855), also see e.g. WO99/24578, WO99/36544, WO99/57280, WO02/079243);

*Chlamydia pneumoniae*, particularly *C. pneumoniae* protein antigens;

*Chlamydia trachomatis*: including antigens derived from serotypes A, B, Ba and C are (agents of trachoma, a cause of blindness), serotypes $L_1$, $L_2$ & $L_3$ (associated with *Lymphogranuloma venereum*), and serotypes, D-K;

*Treponema pallidum* (Syphilis): particularly a TmpA antigen; and

*Haemophilus ducreyi* (causing chancroid): including outer membrane protein (DsrA).

Where not specifically referenced, further bacterial antigens of the invention may be capsular antigens, polysaccharide antigens or protein antigens of any of the above. Further bacterial antigens may also include an outer membrane vesicle (OMV) preparation. Additionally, antigens include live, attenuated, split, and/or purified versions of any of the aforementioned bacteria. The bacterial or microbial derived antigens of the present invention may be gram-negative or gram-positive and aerobic or anaerobic.

Additionally, any of the above bacterial-derived saccharides (polysaccharides, LPS, LOS or oligosaccharides) can be conjugated to another agent or antigen, such as a carrier protein (for example $CRM_1 97$). Such conjugation may be direct conjugation effected by reductive amination of carbonyl moieties on the saccharide to amino groups on the protein, as provided in U.S. Pat. No. 5,360,897 and Can J Biochem Cell Biol. 1984 May; 62 (5):270-5. Alternatively, the saccharides can be conjugated through a linker, such as, with succinamide or other linkages provided in Bioconjugate Techniques, 1996 and CRC, Chemistry of Protein Conjugation and Cross-Linking, 1993.

Viral Antigens

Influenza: including whole viral particles (attenuated), split, or subunit comprising hemagglutinin (HA) and/or neuraminidase (NA) surface proteins, the influenza antigens may be derived from chicken embryos or propogated on cell culture, and/or the influenza antigens are derived from influenza type A, B, and/or C, among others;

Respiratory syncytial virus (RSV): including the F protein of the A2 strain of RSV (J Gen Virol. 2004 November; 85 (Pt 11):3229) and/or G glycoprotein;

Parainfluenza virus (PIV): including PIV type 1, 2, and 3, preferably containing hemagglutinin, neuraminidase and/or fusion glycoproteins;

Poliovirus: including antigens from a family of picornaviridae, preferably poliovirus antigens such as OPV or, preferably IPV;

Measles: including split measles virus (MV) antigen optionally combined with the Protollin and or antigens present in MMR vaccine;

Mumps: including antigens present in MMR vaccine;

Rubella: including antigens present in MMR vaccine as well as other antigens from Togaviridae, including dengue virus;

Rabies: such as lyophilized inactivated virus (RabAvert™);

Flaviviridae viruses: such as (and antigens derived therefrom) yellow fever virus, Japanese encephalitis virus, dengue virus (types 1, 2, 3, or 4), tick borne encephalitis virus, and West Nile virus;

Caliciviridae; antigens therefrom;

HIV: including HIV-1 or HIV-2 strain antigens, such as gag (p24gag and p55gag), env (gp160 and gp41), pol, tat, nef, rev vpu, miniproteins, (preferably p55 gag and gp140v delete) and antigens from the isolates $HIV_{IIb}$, $HIV_{SF2}$, $HIV_{LAV}$, $HIV_{LA1}$, $HUV_{MN}$, HIV-$1_{CM235}$, HIV-$1_{US4}$, HIV-2; simian immunodeficiency virus (SIV) among others;

Rotavirus: including VP4, VP5, VP6, VP7, VP8 proteins (Protein Expr Purif. 2004 December; 38 (2):205) and/or NSP4;

Pestivirus: such as antigens from classical porcine fever virus, bovine viral diarrhea virus, and/or border disease virus;

Parvovirus: such as parvovirus B19;

Coronavirus: including SARS virus antigens, particularly spike protein or proteases therefrom, as well as antigens included in WO 04/92360;

Hepatitis A virus: such as inactivated virus;

Hepatitis B virus: such as the surface and/or core antigens (sAg), as well as the presurface sequences, pre-S1 and pre-S2 (formerly called pre-S), as well as combinations of the above, such as sAg/pre-S1, sAg/pre-S2, sAg/pre-S1/pre-S2, and pre-S1/pre-S2, (see, e.g., AHBV Vaccines—Human Vaccines and Vaccination, pp. 159-176; and U.S. Pat. Nos. 4,722,840, 5,098,704, 5,324,513; Beames et al., J. Virol. (1995) 69:6833-6838, Birnbaum et al., J. Virol. (1990) 64:3319-3330; and Zhou et al., J. Virol. (1991) 65:5457-5464);

Hepatitis C virus: such as E1, E2, E1/E2 (see, Houghton et al., Hepatology (1991) 14:381), NS345 polyprotein, NS 345-core polyprotein, core, and/or peptides from the nonstructural regions (International Publication Nos. WO 89/04669; WO 90/11089; and WO 90/14436);

Delta hepatitis virus (HDV): antigens derived therefrom, particularly A-antigen from HDV (see, e.g., U.S. Pat. No. 5,378,814);

Hepatitis E virus (HEV); antigens derived therefrom;

Hepatitis G virus (HGV), antigens derived therefrom;

Varcicella zoster virus: antigens derived from varicella zoster virus (VZV) (J. Gen. Virol. (1986) 67:1759);

Epstein-Barr virus: antigens derived from EBV (Baer et al., Nature (1984) 310:207);

Cytomegalovirus: CMV antigens, including gB and gH (Cytomegaloviruses (J. K. McDougall, ed., Springer-Verlag 1990) pp. 125-169);

Herpes simplex virus: including antigens from HSV-1 or HSV-2 strains and glycoproteins gB, gD and gH (McGeoch et al., J. Gen. Virol. (1988) 69:1531 and U.S. Pat. No. 5,171, 568);

Human Herpes Virus: antigens derived from other human herpes viruses such as HHV6 and HHV7; and HPV: including antigens associated with or derived from human papillomavirus (HPV), for example, one or more of E1-E7, L1, L2, and fusions thereof, particularly the compositions of the invention may include a virus-like particle (VLP) comprising the L1 major capsid protein, more particular still, the HPV antigens are protective against one or more of HPV serotypes 6, 11, 16 and/or 18.

Further provided are antigens, compostions, methods, and microbes included in Vaccines, 4th Edition (Plotkin and Orenstein ed. 2004); Medical Microbiology 4th Edition (Murray et al. ed. 2002); Virology, 3rd Edition (W. K. Joklik ed. 1988); Fundamental Virology, 2nd Edition (B. N. Fields and D. M. Knipe, eds. 1991), which are contemplated in conjunction with the compositions of the present invention.

Additionally, antigens include live, attenuated, split, and/or purified versions of any of the aforementioned viruses.

Fungal Antigens

Fungal antigens for use herein, associated with vaccines include those described in: U.S. Pat. Nos. 4,229,434 and 4,368,191 for prophylaxis and treatment of trichopytosis caused by *Trichophyton mentagrophytes*; U.S. Pat. Nos. 5,277,904 and 5,284,652 for a broad spectrum dermatophyte vaccine for the prophylaxis of dermatophyte infection in animals, such as guinea pigs, cats, rabbits, horses and lambs, these antigens comprises a suspension of killed *T. equinum, T mentagrophytes* (var. *granulare*), *M. canis* and/or *M. gypseum* in an effective amount optionally combined with an adjuvant; U.S. Pat. Nos. 5,453,273 and 6,132,733 for a ringworm vaccine comprising an effective amount of a homogenized, formaldehyde-killed fungi, i.e., *Microsporum canis* culture in a carrier; U.S. Pat. No. 5,948,413 involving extracellular and intracellular proteins for pythiosis. Additional antigens identified within antifungal vaccines include Ringvac bovis LTF-130 and Bioveta.

Further, fungal antigens for use herein may be derived from *Dermatophytres*, including: *Epidermophyton floccusum, Microsporum audouini, Microsporum canis, Microsporum distortum, Microsporum equinum, Microsporum gypsum, Microsporum nanum, Trichophyton concentricum, Trichophyton equinum, Trichophyton gallinae, Trichophyton gypseum, Trichophyton megnini, Trichophyton mentagrophytes, Trichophyton quinckeanum, Trichophyton rubrum, Trichophyton schoenleini, Trichophyton tonsurans, Trichophyton verrucosum, T. verrucosum* var. *album*, var. *discoides*, var. *ochraceum, Trichophyton violaceum*, and/or *Trichophyton faviforme.*

Fungal pathogens for use as antigens or in derivation of antigens in conjunction with the compositions of the present invention comprise *Aspergillus fumigatus, Aspergillus flavus, Aspergillus niger, Aspergillus nidulans, Aspergillus terreus, Aspergillus sydowi, Aspergillus flavatus, Aspergillus glaucus, Blastoschizomyces capitatus, Candida albicans, Candida enolase, Candida tropicalis, Candida glabrata, Candida krusei, Candida parapsilosis, Candida stellatoidea, Candida kusei, Candida parakwsei, Candida lusitaniae, Candida pseudotropicalis, Candida guilliermondi, Cladosporium carrionii, Coccidioides immitis, Blastomyces dermatidis, Cryptococcus neoformans, Geotrichum clavatum, Histoplasma capsulatum, Klebsiella pneumoniae, Paracoccidioides brasiliensis, Pneumocystis carinii, Pythiumn insidiosum, Pityrosporum ovale, Sacharomyces cerevisae, Saccharomyces boulardii, Saccharomyces pombe, Scedosporium apiosperum, Sporothrix schenckii, Trichosporon beigelii, Toxoplasma gondii, Penicillium marneffei, Malassezia* spp., *Fonsecaea* spp., *Wangiella* spp., *Sporothrix* spp., *Basidiobolus* spp., *Conidiobolus* spp., *Rhizopus* spp, *Mucor* spp, *Absidia* spp, *Mortierella* spp, *Cunninghamella* spp, and *Saksenaea* spp.

Other fungi from which antigens are derived include *Alternaria* spp, *Curvularia* spp, *Helminthosporium* spp, *Fusarium* spp, *Aspergillus* spp, *Penicillium* spp, *Monolinia* spp, *Rhizoctonia* spp, *Paecilomyces* spp, *Pithomyces* spp, and *Cladosporium* spp.

Processes for producing a fungal antigens are well known in the art (see U.S. Pat. No. 6,333,164). In a preferred method a solubilized fraction extracted and separated from an insoluble fraction obtainable from fungal cells of which cell wall has been substantially removed or at least partially removed, characterized in that the process comprises the steps of: obtaining living fungal cells; obtaining fungal cells of which cell wall has been substantially removed or at least partially removed; bursting the fungal cells of which cell wall has been substantially removed or at least partially removed; obtaining an insoluble fraction; and extracting and separating a solubilized fraction from the insoluble fraction.

STD Antigens

In particular embodiments, microbes (bacteria, viruses and/or fungi) against which the present compositions and methods can be implement include those that cause sexually transmitted diseases (STDs) and/or those that display on their surface an antigen that can be the target or antigen composition of the invention. In a preferred embodiment of the invention, compositions are combined with antigens derived from a viral or bacterial STD. Antigens derived from bacteria or viruses can be administered in conjunction with the compositions of the present invention to provide protection against at least one of the following STDs, among others: chlamydia, genital herpes, hepatitis (particularly HCV), genital warts, gonorrhoea, syphilis and/or chancroid (See, WO00/15255).

In another embodiment the compositions of the present invention are co-administered with an antigen for the prevention or treatment of an STD.

Antigens derived from the following viruses associated with STDs, which are described in greater detail above, are preferred for co-administration with the compositions of the present invention: hepatitis (particularly HCV), HPV, HIV, or HSV.

Additionally, antigens derived from the following bacteria associated with STDs, which are described in greater detail above, are preferred for co-administration with the compositions of the present invention: *Neiserria gonorrhoeae, Chlamydia pneumoniae, Chlamydia trachomatis, Treponema pallidum*, or *Haemophilus ducreyi.*

Respiratory Antigens

The antigen may be a respiratory antigen and could further be used in an immunogenic composition for methods of preventing and/or treating infection by a respiratory pathogen, including a virus, bacteria, or fungi such as respiratory syncytial virus (RSV), PIV, SARS virus, influenza, *Bacillus anthracis*, particularly by reducing or preventing infection and/or one or more symptoms of respiratory virus infection. A composition comprising an antigen described herein, such as one derived from a respiratory virus, bacteria or fungus is administered in conjunction with the compositions of the present invention to an individual which is at risk of being exposed to that particular respiratory microbe, has been exposed to a respiratory microbe or is infected with a respiratory virus, bacteria or fungus. The composition(s) of the present invention is/are preferably co-administered at the same time or in the same formulation with an antigen of the respiratory pathogen. Administration of the composition results in reduced incidence and/or severity of one or more symptoms of respiratory infection.

Pediatric/Geriatric Antigens

In one embodiment the compositions of the present invention are used in conjunction with an antigen for treatment of a pediatric population, as in a pediatric antigen. In a more particular embodiment the pediatric population is less than about 3 years old, or less than about 2 years, or less than about 1 years old. In another embodiment the pediatric antigen (in conjunction with the composition of the present invention) is administered multiple times over at least 1, 2, or 3 years.

In another embodiment the compositions of the present invention are used in conjunction with an antigen for treatment of a geriatric population, as in a geriatric antigen.

Other Antigens

Other antigens for use in conjunction with the compositions of the present include hospital acquired (nosocomial) associated antigens.

In another embodiment, parasitic antigens are contemplated in conjunction with the compositions of the present invention. Examples of parasitic antigens include those derived from organisms causing malaria and/or Lyme disease.

In another embodiment, the antigens in conjunction with the compositions of the present invention are associated with or effective against a mosquito bom illness. In another embodiment, the antigens in conjunction with the compositions of the present invention are associated with or effective against encephalitis. In another embodiment the antigens in conjunction with the compositions of the present invention are associated with or effective against an infection of the nervous system.

In another embodiment, the antigens in conjunction with the compositions of the present invention are antigens transmissible through blood or body fluids.

Antigen Formulations

In other aspects of the invention, methods of producing microparticles having adsorbed antigens are provided. The methods comprise: (a) providing an emulsion by dispersing a mixture comprising (i) water, (ii) a detergent, (iii) an organic solvent, and (iv) a biodegradable polymer selected from the group consisting of a poly(α-hydroxy acid), a polyhydroxy butyric acid, a polycaprolactone, a polyorthoester, a polyanhydride, and a polycyanoacrylate. The polymer is typically present in the mixture at a concentration of about 1% to about 30% relative to the organic solvent, while the detergent is typically present in the mixture at a weight-to-weight detergent-to-polymer ratio of from about 0.00001:1 to about 0.1:1 (more typically about 0.0001:1 to about 0.1:1, about 0.001:1 to about 0.1:1, or about 0.005:1 to about 0.1:1); (b) removing the organic solvent from the emulsion; and (c) adsorbing an antigen on the surface of the microparticles. In certain embodiments, the biodegradable polymer is present at a concentration of about 3% to about 10% relative to the organic solvent.

Microparticles for use herein will be formed from materials that are sterilizable, non-toxic and biodegradable. Such materials include, without limitation, poly(α-hydroxy acid), polyhydroxybutyric acid, polycaprolactone, polyorthoester, polyanhydride, PACA, and polycyanoacrylate. Preferably, microparticles for use with the present invention are derived from a poly(α-hydroxy acid), in particular, from a poly(lactide) ("PLA") or a copolymer of D,L-lactide and glycolide or glycolic acid, such as a poly(D,L-lactide-co-glycolide) ("PLG" or "PLGA"), or a copolymer of D,L-lactide and caprolactone. The microparticles may be derived from any of various polymeric starting materials which have a variety of molecular weights and, in the case of the copolymers such as PLG, a variety of lactide:glycolide ratios, the selection of which will be largely a matter of choice, depending in part on the coadministered macromolecule. These parameters are discussed more fully below.

Further antigens may also include an outer membrane vesicle (OMV) preparation.

Additional formulation methods and antigens (especially tumor antigens) are provided in U.S. patent Ser. No. 09/581,772.

ANTIGEN REFERENCES

The following references include antigens useful in conjunction with the compositions of the present invention:

1 International patent application WO99/24578
2 International patent application WO99/36544.
3 International patent application WO99/57280.
4 International patent application WO00/22430.
5 Tettelin et al. (2000) Science 287:1809-1815.
6 International patent application WO96/29412.
7 Pizza et al. (2000) Science 287:1816-1820.
8 PCT WO 01/52885.
9 Bjune et al. (1991) Lancet 338 (8775).
10 Fuskasawa et al. (1999) Vaccine 17:2951-2958.
11 Rosenqist et al. (1998) Dev. Biol. Strand 92:323-333.
12 Constantino et al. (1992) Vaccine 10:691-698.
13 Constantino et al. (1999) Vaccine 17:1251-1263.
14 Watson (2000) Pediatr Infect Dis J 19:331-332.
15 Rubin (20000) Pediatr Clin North Am 47:269-285,v.
16 Jedrzejas (2001) Microbiol Mol Biol Rev 65:187-207.
17 International patent application filed on 3 Jul. 2001 claiming priority from GB-0016363.4; WO 02/02606; PCT IB/01/00166.
18 Kalman et al. (1999) Nature Genetics 21:385-389.
19 Read et al. (2000) Nucleic Acids Res 28:1397-406.
20 Shirai et al. (2000) J. Infect. Dis 181 (Suppl 3):S524-S527.
21 International patent application WO99/27105.
22 International patent application WO00/27994.
23 International patent application WO00/37494.
24 International patent application WO99/28475.
25 Bell (2000) Pediatr Infect Dis J 19:1187-1188.
26 Iwarson (1995) APMIS 103:321-326.
27 Gerlich et al. (1990) Vaccine 8 Suppl:S63-68 & 79-80.
28 Hsu et al. (1999) Clin Liver Dis 3:901-915.
29 Gastofsson et al. (1996) N. Engl. J. Med. 334-:349-355.
30 Rappuoli et al. (1991) TIBTECH 9:232-238.
31 Vaccines (1988) eds. Plotkin & Mortimer. ISBN 0-7216-1946-0.
32 Del Guidice et al. (1998) Molecular Aspects of Medicine 19:1-70.
33 International patent application WO93/018150.

34 International patent application WO99/53310.
35 International patent application WO98/04702.
36 Ross et al. (2001) Vaccine 19:135-142.
37 Sutter et al. (2000) Pediatr Clin North Am 47:287-308.
38 Zimmerman & Spann (1999) Am Fan Physician 59:113-118, 125-126.
39 Dreensen (1997) Vaccine 15 Suppl"S2-6.
40 MMWR Morb Mortal Wkly rep 1998 Jan. 16:47 (1):12, 9.
41 McMichael (2000) Vaccine 19 Suppl 1:S101-107.
42 Schuchat (1999) Lancer 353 (9146):51-6.
43 GB patent applications 0026333.5, 0028727.6 & 0105640.7.
44 Dale (1999) Infect Disclin North Am 13:227-43, viii.
45 Ferretti et al. (2001) PNAS USA 98: 4658-4663.
46 Kuroda et al. (2001) Lancet 357 (9264):1225-1240; see also pages 1218-1219.
47 Ramsay et al. (2001) Lancet 357 (9251):195-196.
48 Lindberg (1999) Vaccine 17 Suppl 2:S28-36.
49 Buttery & Moxon (2000) J R Coil Physicians Long 34:163-168.
50 Ahmad & Chapnick (1999) Infect Dis Clin North Am 13:113-133, vii.
51 Goldblatt (1998) J. Med. Microbiol. 47:663-567.
52 European patent 0 477 508.
53 U.S. Pat. No. 5,306,492.
54 International patent application WO98/42721.
55 Conjugate Vaccines (eds. Cruse et al.) ISBN 3805549326, particularly vol. 10:48-114.
56 Hermanson (1996) Bioconjugate Techniques ISBN: 012323368 & 012342335X.
57 European patent application 0372501.
58 European patent application 0378881.
59 European patent application 0427347.
60 International patent application WO93/17712.
61 International patent application WO98/58668.
62 European patent application 0471177.
63 International patent application WO00/56360.
64 International patent application WO00/67161.

The contents of all of the above cited patents, patent applications and journal articles are incorporated by reference as if set forth fully herein.

There may be an upper limit to the number of Gram positive bacterial proteins which will be in the compositions of the invention. Preferably, the number of Gram positive bacterial proteins in a composition of the invention is less than 20, less than 19, less than 18, less than 17, less than 16, less than 15, less than 14, less than 13, less than 12, less than 11, less than 10, less than 9, less than 8, less than 7, less than 6, less than 5, less than 4, or less than 3. Still more preferably, the number of Gram positive bacterial proteins in a composition of the invention is less than 6, less than 5, or less than 4. Still more preferably, the number of Gram positive bacterial proteins in a composition of the invention is 3.

The Gram positive bacterial proteins and polynucleotides used in the invention are preferably isolated, i.e., separate and discrete, from the whole organism with which the molecule is found in nature or, when the polynucleotide or polypeptide is not found in nature, is sufficiently free of other biological macromolecules so that the polynucleotide or polypeptide can be used for its intended purpose.

Fusion Proteins: GBS AI Sequences

The GBS AI proteins used in the invention may be present in the composition as individual separate polypeptides, but it is preferred that at least two (i.e. 2, 3, 4, 5, 6, 7, 8, 9, 10, 11, 12, 13, 14, 15, 16, 17, or 18) of the antigens are expressed as a single polypeptide chain (a "hybrid" or "fusion" polypeptide). Such fusion polypeptides offer two principal advantages: first, a polypeptide that may be unstable or poorly expressed on its own can be assisted by adding a suitable fusion partner that overcomes the problem; second, commercial manufacture is simplified as only one expression and purification need be employed in order to produce two polypeptides which are both antigenically useful.

The fusion polypeptide may comprise one or more AI polypeptide sequences. Preferably, the fusion comprises an AI surface protein sequence. Preferably, the fusion polypeptide includes one or more of GBS 80, GBS 104, and GBS 67. Most preferably, the fusion peptide includes a polypeptide sequence from GBS 80. Accordingly, the invention includes a fusion peptide comprising a first amino acid sequence and a second amino acid sequence, wherein said first and second amino acid sequences are selected from a GBS AI surface protein or a fragment thereof. Preferably, the first and second amino acid sequences in the fusion polypeptide comprise different epitopes.

Hybrids (or fusions) consisting of amino acid sequences from two, three, four, five, six, seven, eight, nine, or ten GBS antigens are preferred. In particular, hybrids consisting of amino acid sequences from two, three, four, or five GBS antigens are preferred.

Different hybrid polypeptides may be mixed together in a single formulation. Within such combinations, a GBS antigen may be present in more than one hybrid polypeptide and/or as a non-hybrid polypeptide. It is preferred, however, that an antigen is present either as a hybrid or as a non-hybrid, but not as both.

Hybrid polypeptides can be represented by the formula $NH_2$-A-{-X-L-}$_n$-B—COOH, wherein: X is an amino acid sequence of a GBS AI protein or a fragment thereof; L is an optional linker amino acid sequence; A is an optional N-terminal amino acid sequence; B is an optional C-terminal amino acid sequence; and n is 2, 3, 4, 5, 6, 7, 8, 9, 10, 11, 12, 13, 14 or 15.

If a -X- moiety has a leader peptide sequence in its wild-type form, this may be included or omitted in the hybrid protein. In some embodiments, the leader peptides will be deleted except for that of the -X- moiety located at the N-terminus of the hybrid protein i.e. the leader peptide of $X_1$ will be retained, but the leader peptides of $X_2 \ldots X_n$ will be omitted. This is equivalent to deleting all leader peptides and using the leader peptide of $X_1$ as moiety -A-.

For each n instances of {-X-L-}, linker amino acid sequence -L- may be present or absent. For instance, when n=2 the hybrid may be $NH_2$—$X_1$-$L_1$-$X_2$-$L_2$-COOH, $NH_2$—$X_1$—$X_2$—COOH, $NH_2$—$X_1$-$L_1$-$X_2$—COOH, $NH_2$—$X_1$—$X_2$-$L_2$-COOH, etc. Linker amino acid sequence(s) -L- will typically be short (e.g. 20 or fewer amino acids i.e. 19, 18, 17, 16, 15, 14, 13, 12, 11, 10, 9, 8, 7, 6, 5, 4, 3, 2, 1). Examples comprise short peptide sequences which facilitate cloning, poly-glycine linkers (i.e. comprising $Gly_n$ where n=2, 3, 4, 5, 6, 7, 8, 9, 10 or more), and histidine tags (i.e. $His_n$ where n=3, 4, 5, 6, 7, 8, 9, 10 or more). Other suitable linker amino acid sequences will be apparent to those skilled in the art. A useful linker is GSGGGG, with the Gly-Ser dipeptide being formed from a BamHI restriction site, thus aiding cloning and manipulation, and the $(Gly)_4$ tetrapeptide being a typical poly-glycine linker.

-A- is an optional N-terminal amino acid sequence. This will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct protein trafficking, or short peptide sequences which facilitate cloning or purification (e.g. histidine tags i.e. $His_n$ where n=3, 4, 5, 6, 7, 8, 9, 10 or more). Other suitable N-terminal amino acid sequences will be apparent to those skilled in the art. If $X_1$ lacks its own N-terminus methionine, -A- is preferably an oligopeptide (e.g. with 1, 2, 3, 4, 5, 6, 7 or 8 amino acids) which provides a N-terminus methionine.

—B— is an optional C-terminal amino acid sequence. This will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include sequences to direct protein trafficking, short peptide sequences which facilitate cloning or purification (e.g. comprising histidine tags i.e. $His_n$, where n=3, 4, 5, 6, 7, 8, 9, 10 or more), or sequences which enhance protein stability. Other suitable C-terminal amino acid sequences will be apparent to those skilled in the art.

Most preferably, n is 2 or 3.

Fusion Proteins: Gram Positive Bacteria AI Sequences

The Gram positive bacteria AI proteins used in the invention may be present in the composition as individual separate polypeptides, but it is preferred that at least two (i.e. 2, 3, 4, 5, 6, 7, 8, 9, 10, 11, 12, 13, 14, 15, 16, 17, or 18) of the antigens are expressed as a single polypeptide chain (a "hybrid" or "fusion" polypeptide). Such fusion polypeptides offer two principal advantages: first, a polypeptide that may be unstable or poorly expressed on its own can be assisted by adding a suitable fusion partner that overcomes the problem; second, commercial manufacture is simplified as only one expression and purification need be employed in order to produce two polypeptides which are both antigenically useful.

The fusion polypeptide may comprise one or more AI polypeptide sequences. Preferably, the fusion comprises an AI surface protein sequence. Accordingly, the invention includes a fusion peptide comprising a first amino acid sequence and a second amino acid sequence, wherein said first and second amino acid sequences are selected from a Gram positive bacteria AI protein or a fragment thereof. Preferably, the first and second amino acid sequences in the fusion polypeptide comprise different epitopes.

Hybrids (or fusions) consisting of amino acid sequences from two, three, four, five, six, seven, eight, nine, or ten Gram positive bacteria antigens are preferred. In particular, hybrids consisting of amino acid sequences from two, three, four, or five Gram positive bacteria antigens are preferred.

Different hybrid polypeptides may be mixed together in a single formulation. Within such combinations, a Gram positive bacteria AI sequence may be present in more than one hybrid polypeptide and/or as a non-hybrid polypeptide. It is preferred, however, that an antigen is present either as a hybrid or as a non-hybrid, but not as both.

Hybrid polypeptides can be represented by the formula $NH_2$-A-{-X-L-}$_n$-B—COOH, wherein: X is an amino acid sequence of a Gram positive bacteria AI sequence or a fragment thereof; L is an optional linker amino acid sequence; A is an optional N-terminal amino acid sequence; B is an optional C-terminal amino acid sequence; and n is 2, 3, 4, 5, 6, 7, 8, 9, 10, 11, 12, 13, 14 or 15.

If a -X- moiety has a leader peptide sequence in its wild-type form, this may be included or omitted in the hybrid protein. In some embodiments, the leader peptides will be deleted except for that of the -X- moiety located at the N-terminus of the hybrid protein i.e. the leader peptide of $X_1$ will be retained, but the leader peptides of $X_2 \ldots X_n$ will be omitted. This is equivalent to deleting all leader peptides and using the leader peptide of $X_1$ as moiety -A-.

For each n instances of {-X-L-}, linker amino acid sequence -L- may be present or absent. For instance, when n=2 the hybrid may be $NH_2$—$X_1$-$L_1$-$X_2$-$L_2$-COOH, $NH_2$—$X_1$—$X_2$—COOH, $NH_2$—$X_1$-$L_1$-$X_2$—COOH, $NH_2$—$X_1$—$X_2$-$L_2$-COOH, etc. Linker amino acid sequence(s) -L- will typically be short (e.g. 20 or fewer amino acids i.e. 19, 18, 17, 16, 15, 14, 13, 12, 11, 10, 9, 8, 7, 6, 5, 4, 3, 2, 1). Examples comprise short peptide sequences which facilitate cloning, poly-glycine linkers (i.e. comprising Gly, where n=2, 3, 4, 5, 6, 7, 8, 9, 10 or more), and histidine tags (i.e. $His_n$ where n=3, 4, 5, 6, 7, 8, 9, 10 or more). Other suitable linker amino acid sequences will be apparent to those skilled in the art. A useful linker is GSGGGG, with the Gly-Ser dipeptide being formed from a BamHI restriction site, thus aiding cloning and manipulation, and the $(Gly)_4$ tetrapeptide being a typical poly-glycine linker.

-A- is an optional N-terminal amino acid sequence. This will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct protein trafficking, or short peptide sequences which facilitate cloning or purification (e.g. histidine tags i.e. His, where n=3, 4, 5, 6, 7, 8, 9, 10 or more). Other suitable N-terminal amino acid sequences will be apparent to those skilled in the art. If $X_1$ lacks its own N-terminus methionine, -A- is preferably an oligopeptide (e.g. with 1, 2, 3, 4, 5, 6, 7 or 8 amino acids) which provides a N-terminus methionine.

—B— is an optional C-terminal amino acid sequence. This will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include sequences to direct protein trafficking, short peptide sequences which facilitate cloning or purification (e.g. comprising histidine tags i.e. $His_n$, where n=3, 4, 5, 6, 7, 8, 9, 10 or more), or sequences which enhance protein stability. Other suitable C-terminal amino acid sequences will be apparent to those skilled in the art.

Most preferably, n is 2 or 3.

Antibodies: GBS AI Sequences

The GBS AI proteins of the invention may also be used to prepare antibodies specific to the GBS AI proteins. The antibodies are preferably specific to the an oligomeric or hyper-oligomeric form of an AI protein. The invention also includes combinations of antibodies specific to GBS AI proteins selected to provide protection against an increased range of GBS serotypes and strain isolates. For example, a combination may comprise a first and second antibody, wherein said first antibody is specific to a first GBS AI protein and said second antibody is specific to a second GBS AI protein. Preferably, the nucleic acid sequence encoding said first GBS AI protein is not present in a GBS genome comprising a polynucleotide sequence encoding for said second GBS AI protein. Preferably, the nucleic acid sequence encoding said first and second GBS AI proteins are present in the genomes of multiple GBS serotypes and strain isolates.

The GBS specific antibodies of the invention include one or more biological moieties that, through chemical or physical means, can bind to or associate with an epitope of a GBS polypeptide. The antibodies of the invention include antibodies which specifically bind to a GBS AI protein. The invention includes antibodies obtained from both polyclonal and monoclonal preparations, as well as the following: hybrid (chimeric) antibody molecules (see, for example, Winter et al. (1991) Nature 349: 293-299; and U.S. Pat. No. 4,816,567; $F(ab')_2$ and F(ab) fragments; $F_v$ molecules (non-covalent heterodimers, see, for example, Inbar et al. (1972) Proc Natl Acad Sci USA 69:2659-2662; and Ehrlich et al. (1980) Biochem 19:4091-4096); single-chain $F_v$ molecules (sFv) (see, for example, Huston et al. (1988) Proc Natl Acad Sci USA 85:5897-5883); dimeric and trimeric antibody fragment constructs; minibodies (see, e.g., Pack et al. (1992) Biochem 31:1579-1584; Cumber et al. (1992) J Immunology 149B: 120-126); humanized antibody molecules (see, for example, Riechmann et al. (1988) Nature 332:323-327; Verhoeyan et al. (1988) Science 239:1534-1536; and U.K. Patent Publication No. GB 2,276,169, published 21 Sep. 1994); and, any functional fragments obtained from such molecules, wherein such fragments retain immunological binding properties of the parent antibody molecule. The invention further includes antibodies obtained through non-conventional processes, such as phage display.

Preferably, the GBS specific antibodies of the invention are monoclonal antibodies. Monoclonal antibodies of the invention include an antibody composition having a homogeneous antibody population. Monoclonal antibodies of the invention may be obtained from murine hybridomas, as well as human monoclonal antibodies obtained using human rather than murine hybridomas. See, e.g., Cote, et al. Monoclonal Antibodies and Cancer Therapy, Alan R. Liss, 1985, p 77.

The antibodies of the invention may be used in diagnostic applications, for example, to detect the presence or absence of GBS in a biological sample. The antibodies of the invention may also be used in the prophylactic or therapeutic treatment of GBS infection.

Antibodies: Gram Positive Bacteria AI Sequences

The Gram positive bacteria AI proteins of the invention may also be used to prepare antibodies specific to the Gram positive bacteria AI proteins. The antibodies are preferably specific to the an oligomeric or hyper-oligomeric form of an AI protein. The invention also includes combinations of antibodies specific to Gram positive bacteria AI proteins selected to provide protection against an increased range of Gram positive bacteria genus, species, serotypes and strain isolates.

For example, a combination may comprise a first and second antibody, wherein said first antibody is specific to a first Gram positive bacteria AI protein and said second antibody is specific to a second Gram positive bacteria AI protein. Preferably, the nucleic acid sequence encoding said first Gram positive bacteria AI protein is not present in a Gram positive bacterial genome comprising a polynucleotide sequence encoding for said second Gram positive bacteria AI protein. Preferably, the nucleic acid sequence encoding said first and second Gram positive bacteria AI proteins are present in the genomes of multiple Gram positive bacteria genus, species, serotypes or strain isolates.

As an example of an instance where the combination of antibodies provides protection against an increased range of bacteria serotypes, the first antibody may be specific to a first GAS AI protein and the second antibody may be specific to a second GAS AI protein. The first GAS AI protein may comprise a GAS AI-1 surface protein, while the second GAS AI protein may comprise a GAS AI-2 or AI-3 surface protein.

As an example of an instance where the combination of antibodies provides protection against an increased range of bacterial species, the first antibody may be specific to a GBS AI protein and the second antibody may be specific to a GAS AI protein. Alternatively, the first antibody may be specific to a GAS AI protein and the second antibody may be specific to a *S. pneumoniae* AI protein.

The Gram positive specific antibodies of the invention include one or more biological moieties that, through chemical or physical means, can bind to or associate with an epitope of a Gram positive bacteria AI polypeptide. The antibodies of the invention include antibodies which specifically bind to a Gram positive bacteria AI protein. The invention includes antibodies obtained from both polyclonal and monoclonal preparations, as well as the following: hybrid (chimeric) antibody molecules (see, for example, Winter et al. (1991) Nature 349: 293-299; and U.S. Pat. No. 4,816,567; $F(ab')_2$ and F(ab) fragments; $F_v$ molecules (non-covalent heterodimers, see, for example, Inbar et al. (1972) Proc Natl Acad Sci USA 69:2659-2662; and Ehrlich et al. (1980) Biochem 19:4091_4096); single-chain Fv molecules (sFv) (see, for example, Huston et al. (1988) Proc Natl Acad Sci USA 85:5897-5883); dimeric and trimeric antibody fragment constructs; minibodies (see, e.g., Pack et al. (1992) Biochem 31:1579-1584; Cumber et al. (1992) J Immunology 149B: 120-126); humanized antibody molecules (see, for example, Riechmann et al. (1988) Nature 332:323-327; Verhoeyan et al. (1988) Science 239:1534-1536; and U.K. Patent Publication No. GB 2,276,169, published 21 Sep. 1994); and, any functional fragments obtained from such molecules, wherein such fragments retain immunological binding properties of the parent antibody molecule. The invention further includes antibodies obtained through non-conventional processes, such as phage display.

Preferably, the Gram positive specific antibodies of the invention are monoclonal antibodies. Monoclonal antibodies of the invention include an antibody composition having a homogeneous antibody population. Monoclonal antibodies of the invention may be obtained from murine hybridomas, as well as human monoclonal antibodies obtained using human rather than murine hybridomas. See, e.g., Cote, et al. Monoclonal Antibodies and Cancer Therapy, Alan R. Liss, 1985, p 77.

The antibodies of the invention may be used in diagnostic applications, for example, to detect the presence or absence of Gram positive bacteria in a biological sample. The antibodies of the invention may also be used in the prophylactic or therapeutic treatment of Gram positive bacteria infection.

Nucleic Acids

The invention provides nucleic acids encoding the Gram positive bacteria sequences and/or the hybrid fusion polypeptides of the invention. The invention also provides nucleic acid encoding the GBS antigens and/or the hybrid fusion polypeptides of the invention. Furthermore, the invention provides nucleic acid which can hybridise to these nucleic acids, preferably under "high stringency" conditions (e.g. 65° C. in a 0.1.times.SSC, 0.5% SDS solution).

Polypeptides of the invention can be prepared by various means (e.g. recombinant expression, purification from cell culture, chemical synthesis, etc.) and in various forms (e.g. native, fusions, non-glycosylated, lipidated, etc.). They are preferably prepared in substantially pure form (i.e. substantially free from other GAS or host cell proteins).

Nucleic acid according to the invention can be prepared in many ways (e.g. by chemical synthesis, from genomic or cDNA libraries, from the organism itself, etc.) and can take various forms (e.g. single stranded, double stranded, vectors, probes, etc.). They are preferably prepared in substantially pure form (i.e. substantially free from other GBS or host cell nucleic acids).

The term "nucleic acid" includes DNA and RNA, and also their analogues, such as those containing modified backbones (e.g. phosphorothioates, etc.), and also peptide nucleic acids (PNA), etc. The invention includes nucleic acid comprising sequences complementary to those described above (e.g. for antisense or probing purposes).

The invention also provides a process for producing a polypeptide of the invention, comprising the step of culturing a host cell transformed with nucleic acid of the invention under conditions which induce polypeptide expression.

The invention provides a process for producing a polypeptide of the invention, comprising the step of synthesising at least part of the polypeptide by chemical means.

The invention provides a process for producing nucleic acid of the invention, comprising the step of amplifying nucleic acid using a primer-based amplification method (e.g. PCR).

The invention provides a process for producing nucleic acid of the invention, comprising the step of synthesising at least part of the nucleic acid by chemical means.

Purification and Recombinant Expression

The Gram positive bacteria AI proteins of the invention may be isolated from the native Gram positive bacteria, or they may be recombinantly produced, for instance in a heterologous host. For example, the GAS, GBS, and *S. pneumoniae* antigens of the invention may be isolated from *Streptococcus agalactiae, S. pyogenes, S. pneumoniae*, or they may be recombinantly produced, for instance, in a heterologous host. Preferably, the GBS antigens are prepared using a heterologous host.

The heterologous host may be prokaryotic (e.g. a bacterium) or eukaryotic. It is preferably *E. coli*, but other suitable hosts include *Bacillus subtilis, Vibrio cholerae, Salmonella typhi, Salmonella typhimurium, Neisseria lactamica, Neisseria cinerea, Mycobacteria* (e.g. *M. tuberculosis*), *S. gordonii, L. lactis*, yeasts, etc.

Recombinant production of polypeptides is facilitated by adding a tag protein to the Gram positive bacteria AI sequence to be expressed as a fusion protein comprising the tag protein and the Gram positive bacteria antigen. For example, recombinant production of polypeptides is facilitated by adding a tag protein to the GBS antigen to be expressed as a fusion protein comprising the tag protein and the GBS antigen. Such tag proteins can facilitate purification, detection and stability of the expressed protein. Tag proteins suitable for use in the invention include a polyarginine tag (Arg-tag), polyhistidine tag (His-tag), FLAG-tag, Strep-tag, c-myc-tag, S-tag, calmodulin-binding peptide, cellulose-binding domain, SBP-tag, chitin-binding domain, glutathione S-transferase-tag (GST), maltose-binding protein, transcription termination anti-termination factor (NusA), *E. coli* thioredoxin (TrxA) and protein disulfide isomerase I (DsbA). Preferred tag proteins include His-tag and GST. A full discussion on the use of tag proteins can be found at Terpe et al., "Overview of tag protein fusions: from molecular and biochemical fundamentals to commercial systems", Appl Microbiol Biotechnol (2003) 60:523-533.

After purification, the tag proteins may optionally be removed from the expressed fusion protein, i.e., by specifically tailored enzymatic treatments known in the art. Commonly used proteases include enterokinase, tobacco etch virus (TEV), thrombin, and factor $X_a$.

GBS Polysaccharides

The compositions of the invention may be further improved by including GBS polysaccharides. Preferably, the GBS antigen and the saccharide each contribute to the immunological response in a recipient. The combination is particularly advantageous where the saccharide and polypeptide provide protection from different GBS serotypes.

The combined antigens may be present as a simple combination where separate saccharide and polypeptide antigens are administered together, or they may be present as a conjugated combination, where the saccharide and polypeptide antigens are covalently linked to each other.

Thus the invention provides an immunogenic composition comprising (i) one or more GBS AI proteins and (ii) one or more GBS saccharide antigens. The polypeptide and the polysaccharide may advantageously be covalently linked to each other to form a conjugate.

Between them, the combined polypeptide and saccharide antigens preferably cover (or provide protection from) two or more GBS serotypes (e.g. 2, 3, 4, 5, 6, 7, 8 or more serotypes). The serotypes of the polypeptide and saccharide antigens may or may not overlap. For example, the polypeptide might protect against serogroup II or V, while the saccharide protects against either serogroups Ia, Ib, or III. Preferred combinations protect against the following groups of serotypes: (1) serotypes Ia and Ib, (2) serotypes Ia and H, (3) serotypes Ia and III, (4) serotypes Ia and IV, (5) serotypes Ia and V, (6) serotypes Ia and VI, (7) serotypes Ia and VII, (8) serotypes Ia and VIII, (9) serotypes Ib and II, (10) serotypes Ib and III, (11) serotypes Ib and IV, (12) serotypes Ib and V, (13) serotypes Ib and VI, (14) serotypes Ib and VII, (15) serotypes Ib and VIII, 16) serotypes II and III, (17) serotypes II and IV, (18) serotypes II and V, (19) serotypes II and VI, (20) serotypes H and VII, (21) serotypes II and VII, (22) serotypes III and IV, (23) serotypes III and V, (24) serotypes III and VI, (25) serotypes III and VII, (26) serotypes III and VIII, (27) serotypes IV and V, (28) serotypes IV and VI, (29) serotypes IV and VII, (30) serotypes IV and VIII, (31) serotypes V and VI, (32) serotypes V and VII, (33) serotypes V and VIII, (34) serotypes VI and VII, (35) serotypes VI and VIII, and (36) serotypes VII and VIII.

Still more preferably, the combinations protect against the following groups of serotypes: (1) serotypes Ia and II, (2) serotypes Ia and V; (3) serotypes Ib and II, (4) serotypes Ib and V, (5) serotypes III and II, and (6) serotypes III and V. Most preferably, the combinations protect against serotypes III and V.

Protection against serotypes II and V is preferably provided by polypeptide antigens. Protection against serotypes Ia, Ib and/or III may be polypeptide or saccharide antigens.

Immunogenic Compositions and Medicaments

Compositions of the invention are preferably immunogenic compositions, and are more preferably vaccine compositions. The pH of the composition is preferably between 6 and 8, preferably about 7. The pH may be maintained by the use of a buffer. The composition may be sterile and/or pyrogen-free. The composition may be isotonic with respect to humans.

Vaccines according to the invention may either be prophylactic (i.e. to prevent infection) or therapeutic (i.e. to treat infection), but will typically be prophylactic. Accordingly, the invention includes a method for the therapeutic or prophylactic treatment of a Gram positive bacteria infection in an animal susceptible to such gram positive bacterial infection comprising administering to said animal a therapeutic or prophylactic amount of the immunogenic composition of the invention. For example, the invention includes a method for the therapeutic or prophylactic treatment of a *Streptococcus agalactiae, S. pyogenes*, or *S. pneumoniae* infection in an animal susceptible to streptococcal infection comprising administering to said animal a therapeutic or prophylactic amount of the immunogenic compositions of the invention.

The invention also provides a composition of the invention for use of the compositions described herein as a medicament. The medicament is preferably able to raise an immune response in a mammal (i.e. it is an immunogenic composition) and is more preferably a vaccine.

The invention also provides the use of the compositions of the invention in the manufacture of a medicament for raising an immune response in a mammal. The medicament is preferably a vaccine.

The invention also provides kits comprising one or more containers of compositions of the invention. Compositions can be in liquid form or can be lyophilized, as can individual antigens. Suitable containers for the compositions include, for example, bottles, vials, syringes, and test tubes. Containers can be formed from a variety of materials, including glass or plastic. A container may have a sterile access port (for example, the container may be an intravenous solution bag or a vial having a stopper pierceable by a hypodermic injection needle). The composition may comprise a first component comprising one or more Gram positive bacteria AI proteins. Preferably, the AI proteins are surface AI proteins. Preferably, the AI surface proteins are in an oligomeric or hyperoligomeric form. For example, the first component comprises a combination of GBS antigens or GAS antigens, or *S. pneumoniae* antigens. Preferably said combination includes GBS 80. Preferably GBS 80 is present in an oligomeric or hyperoligomeric form.

The kit can further comprise a second container comprising a pharmaceutically-acceptable buffer, such as phosphate-buffered saline, Ringer's solution, or dextrose solution. It can also contain other materials useful to the end-user, including other buffers, diluents, filters, needles, and syringes. The kit can also comprise a second or third container with another active agent, for example an antibiotic.

The kit can also comprise a package insert containing written instructions for methods of inducing immunity against *S. agalactiae* and/or *S. pyogenes* and/or *S. pneumoniae* or for treating *S. agalactiae* and/or *S. pyogenes* and/or *S. pneumoniae* infections. The package insert can be an unapproved draft package insert or can be a package insert approved by the Food and Drug Administration (FDA) or other regulatory body.

The invention also provides a delivery device pre-filled with the immunogenic compositions of the invention.

The invention also provides a method for raising an immune response in a mammal comprising the step of administering an effective amount of a composition of the invention. The immune response is preferably protective and preferably involves antibodies and/or cell-mediated immunity. This immune response will preferably induce long lasting (e.g., neutralising) antibodies and a cell mediated immunity that can quickly respond upon exposure to one or more GBS and/or GAS and/or *S. pneumoniae* antigens. The method may raise a booster response.

The invention provides a method of neutralizing GBS, GAS, or *S. pneumoniae* infection in a mammal comprising the step of administering to the mammal an effective amount of the immunogenic compositions of the invention, a vaccine of the invention, or antibodies which recognize an immunogenic composition of the invention.

The mammal is preferably a human. Where the vaccine is for prophylactic use, the human is preferably a female (either of child bearing age or a teenager). Alternatively, the human may be elderly (e.g., over the age of 50, 55, 60, 65, 70 or 75) and may have an underlying disease such as diabetes or cancer. Where the vaccine is for therapeutic use, the human is preferably a pregnant female or an elderly adult.

These uses and methods are preferably for the prevention and/or treatment of a disease caused by *Streptococcus agalactiae*, or *S. pyogenes*, or *S. pneumoniae*. The compositions may also be effective against other streptococcal bacteria. The compositions may also be effective against other Gram positive bacteria.

One way of checking efficacy of therapeutic treatment involves monitoring Gram positive bacterial infection after administration of the composition of the invention. One way of checking efficacy of prophylactic treatment involves monitoring immune responses against the Gram positive bacterial antigens in the compositions of the invention after administration of the composition.

One way of checking efficacy of therapeutic treatment involves monitoring GBS infection after administration of the composition of the invention. One way of checking efficacy of prophylactic treatment involves monitoring immune responses against the GBS antigens in the compositions of the invention after administration of the composition.

A way of assessing the immunogenicity of the component proteins of the immunogenic compositions of the present invention is to express the proteins recombinantly and to screen patient sera or mucosal secretions by immunoblot. A positive reaction between the protein and the patient serum indicates that the patient has previously mounted an immune response to the protein in question—that is, the protein is an immunogen. This method may also be used to identify immunodominant proteins and/or epitopes.

Another way of checking efficacy of therapeutic treatment involves monitoring GBS or GAS or *S. pneumoniae* infection after administration of the compositions of the invention. One way of checking efficacy of prophylactic treatment involves monitoring immune responses both systemically (such as monitoring the level of IgG1 and IgG2a production) and mucosally (such as monitoring the level of IgA production) against the GBS and/or GAS and/or *S. pneumoniae* antigens in the compositions of the invention after administration of the composition. Typically, GBS and/or GAS and/or *S. pneumoniae* serum specific antibody responses are determined post-immunization but pre-challenge whereas mucosal GBS and/or GAS and/or *S. pneumoniae* specific antibody body responses are determined post-immunization and post-challenge.

The vaccine compositions of the present invention can be evaluated in in vitro and in vivo animal models prior to host, e.g., human, administration.

The efficacy of immunogenic compositions of the invention can also be determined in vivo by challenging animal models of GBS and/or GAS and/or *S. pneumoniae* infection, e.g., guinea pigs or mice, with the immunogenic compositions. The immunogenic compositions may or may not be derived from the same serotypes as the challenge serotypes. Preferably the immunnogenic compositions are derivable from the same serotypes as the challenge serotypes. More preferably, the immunogenic composition and/or the challenge serotypes are derivable from the group of GBS and/or GAS and/or *S. pneumoniae* serotypes.

In vivo efficacy models include but are not limited to: (i) A murine infection model using human GBS and/or GAS and/or *S. pneumoniae* serotypes; (ii) a murine disease model which is a murine model using a mouse-adapted GBS and/or GAS and/or *S. pneumoniae* strain, such as those strains outlined above which is particularly virulent in mice and (iii) a primate model using human GBS or GAS or *S. pneumoniae* isolates.

The immune response may be one or both of a TH1 immune response and a TH2 response.

The immune response may be an improved or an enhanced or an altered immune response.

The immune response may be one or both of a systemic and a mucosal immune response.

Preferably the immune response is an enhanced system and/or mucosal response.

An enhanced systemic and/or mucosal immunity is reflected in an enhanced TH1 and/or TH2 immune response. Preferably, the enhanced immune response includes an increase in the production of IgG1 and/or IgG2a and/or IgA Preferably the mucosal immune response is a TH2 immune response. Preferably, the mucosal immune response includes an increase in the production of IgA.

Activated TH2 cells enhance antibody production and are therefore of value in responding to extracellular infections. Activated TH2 cells may secrete one or more of IL-4, IL-5, IL-6, and IL-10. A TH2 immune response may result in the production of IgG1, IgE, IgA and memory B cells for future protection.

A TH2 immune response may include one or more of an increase in one or more of the cytokines associated with a TH2 immune response (such as IL-4, IL-5, IL-6 and IL-10), or an increase in the production of IgG1, IgE, IgA and memory B cells. Preferably, the enhanced TH2 immune response will include an increase in IgG1 production.

A TH1 immune response may include one or more of an increase in CTLs, an increase in one or more of the cytokines associated with a TH1 immune response (such as IL-2, IFN-.gamma, and TNFβ, an increase in activated macrophages, an increase in NK activity, or an increase in the production of IgG2a. Preferably, the enhanced TH1 immune response will include an increase in IgG2a production.

Immunogenic compositions of the invention, in particular, immunogenic composition comprising one or more GAS antigens of the present invention may be used either alone or in combination with other GAS antigens optionally with an immunoregulatory agent capable of eliciting a Th1 and/or Th2 response.

Compositions of the invention will generally be administered directly to a patient. Certain routes may be favored for certain compositions, as resulting in the generation of a more effective immune response, preferably a CMI response, or as being less likely to induce side effects, or as being easier for administration. Direct delivery may be accomplished by parenteral injection (e.g. subcutaneously, intraperitoneally, intradermally, intravenously, intramuscularly, or to the interstitial space of a tissue), or by rectal, oral (e.g. tablet, spray), vaginal, topical, transdermal (e.g. see WO 99/27961) or transcutaneous (e.g. see WO 02/074244 and WO 02/064162), intranasal (e.g. see WO03/028760), ocular, aural, pulmonary or other mucosal administration.

The invention may be used to elicit systemic and/or mucosal immunity.

In one particularly preferred embodiment, the immunogenic composition comprises one or more GBS or GAS or *S. pneumoniae* antigen(s) which elicits a neutralising antibody response and one or more GBS or GAS or *S. pneumoniae* antigen(s) which elicit a cell mediated immune response. In this way, the neutralising antibody response prevents or inhibits an initial GBS or GAS or *S. pneumoniae* infection while the cell-mediated immune response capable of eliciting an enhanced Th1 cellular response prevents further spreading of the GBS or GAS or *S. pneumoniae* infection. Preferably, the immunogenic composition comprises one or more GBS or GAS or *S. pneumoniae* surface antigens and one or more GBS or GAS or *S. pneumoniae* cytoplasmic antigens. Preferably the immunogenic composition comprises one or more GBS or GAS or *S. pneumoniae* surface antigens or the like and one or other antigens, such as a cytoplasmic antigen capable of eliciting a Th1 cellular response.

Dosage treatment can be a single dose schedule or a multiple dose schedule. Multiple doses may be used in a primary immunisation schedule and/or in a booster immunisation schedule. In a multiple dose schedule the various doses may be given by the same or different routes e.g. a parenteral prime and mucosal boost, a mucosal prime and parenteral boost, etc.

The compositions of the invention may be prepared in various forms. For example, the compositions may be prepared as injectables, either as liquid solutions or suspensions. Solid forms suitable for solution in, or suspension in, liquid vehicles prior to injection can also be prepared (e.g. a lyophilised composition). The composition may be prepared for topical administration e.g. as an ointment, cream or powder. The composition may be prepared for oral administration e.g. as a tablet or capsule, as a spray, or as a syrup (optionally flavoured). The composition may be prepared for pulmonary administration e.g. as an inhaler, using a fine powder or a spray. The composition may be prepared as a suppository or pessary. The composition may be prepared for nasal, aural or ocular administration e.g. as drops. The composition may be in kit form, designed such that a combined composition is reconstituted just prior to administration to a patient. Such kits may comprise one or more antigens in liquid form and one or more lyophilised antigens.

Immunogenic compositions used as vaccines comprise an immunologically effective amount of antigen(s), as well as any other components, such as antibiotics, as needed. By 'immunologically effective amount', it is meant that the administration of that amount to an individual, either in a single dose or as part of a series, is effective for treatment or prevention, or increases a measurable immune response or prevents or reduces a clinical symptom. This amount varies depending upon the health and physical condition of the individual to be treated, age, the taxonomic group of individual to be treated (e.g. non-human primate, primate, etc.), the capacity of the individual's immune system to synthesise antibodies, the degree of protection desired, the formulation of the vaccine, the treating doctor's assessment of the medical situation, and other relevant factors. It is expected that the amount will fall in a relatively broad range that can be determined through routine trials.

Further Components of the Composition

The composition of the invention will typically, in addition to the components mentioned above, comprise one or more 'pharmaceutically acceptable carriers', which include any carrier that does not itself induce the production of antibodies harmful to the individual receiving the composition. Suitable carriers are typically large, slowly metabolised macromolecules such as proteins, polysaccharides, polylactic acids, polyglycolic acids, polymeric amino acids, amino acid copolymers, and lipid aggregates (such as oil droplets or liposomes). Such carriers are well known to those of ordinary skill in the art. The vaccines may also contain diluents, such as water, saline, glycerol, etc. Additionally, auxiliary substances, such as wetting or emulsifying agents, pH buffering substances, and the like, may be present. A thorough discussion of pharmaceutically acceptable excipients is available in Gennaro (2000) Remington: The Science and Practice of Pharmacy. 20th ed., ISBN: 0683306472.

Adjuvants

Vaccines of the invention may be administered in conjunction with other immunoregulatory agents. In particular, compositions will usually include an adjuvant. Adjuvants for use with the invention include, but are not limited to, one or more of the following set forth below:

A. Mineral Containing Compositions

Mineral containing compositions suitable for use as adjuvants in the invention include mineral salts, such as aluminum salts and calcium salts. The invention includes mineral salts such as hydroxides (e.g. oxyhydroxides), phosphates (e.g. hydroxyphosphates, orthophosphates), sulfates, etc. (e.g. see chapters 8 & 9 of Vaccine Design . . . (1995) eds. Powell & Newman. ISBN: 030644867X. Plenum.), or mixtures of different mineral compounds (e.g. a mixture of a phosphate and a hydroxide adjuvant, optionally with an excess of the phosphate), with the compounds taking any suitable form (e.g. gel, crystalline, amorphous, etc.), and with adsorption to the salt(s) being preferred. The mineral containing compositions may also be formulated as a particle of metal salt (WO 00/23105).

Aluminum salts may be included in vaccines of the invention such that the dose of $Al^3+$ is between 0.2 and 1.0 mg per dose.

B. Oil-Emulsions

Oil-emulsion compositions suitable for use as adjuvants in the invention include squalene-water emulsions, such as MF59 (5% Squalene, 0.5% Tween 80, and 0.5% Span 85, formulated into submicron particles using a microfluidizer). See WO90/14837. See also, Podda, "The adjuvanted influenza vaccines with novel adjuvants: experience with the MF59-adjuvanted vaccine", Vaccine (2001) 19: 2673-2680; Frey et al., "Comparison of the safety, tolerability, and immunogenicity of a MF59-adjuvanted influenza vaccine and a non-adjuvanted influenza vaccine in non-elderly adults", Vaccine (2003) 21:42344237. MF59 is used as the adjuvant in the FLUAD™ influenza virus trivalent subunit vaccine.

Particularly preferred adjuvants for use in the compositions are submicron oil-in-water emulsions. Preferred submicron oil-in-water emulsions for use herein are squalene/water emulsions optionally containing varying amounts of MTP-PE, such as a submicron oil-in-water emulsion containing 4-5% w/v squalene, 0.25-1.0% w/v Tween 80™ (polyoxyelthylenesorbitan monooleate), and/or 0.25-1.0% Span85™ (sorbitan trioleate), and, optionally, N-acetylmuramyl-L-alanyl-D-isogluatminyl-L-alanine-2-(1'-2'-dipalmitoyl-s-n-glycero-3-huydroxyphosphosphoryloxy)-ethylamine (MTP-PE), for example, the submicron oil-in-water emulsion known as "MF59" (International Publication No. WO 90/14837; U.S. Pat. Nos. 6,299,884 and 6,451,325, incorporated herein by reference in their entireties; and Ott et al., "MF59—Design and Evaluation of a Safe and Potent Adjuvant for Human Vaccines" in Vaccine Design: The Subunit and Adjuvant Approach (Powell, M. F. and Newman, M. J. eds.) Plenum Press, New York, 1995, pp. 277-296). MF59 contains 4-5% w/v Squalene (e.g. 4.3%), 0.25-0.5% w/v Tween 80™, and 0.5% w/v Span 85™ and optionally contains various amounts of MTP-PE, formulated into submicron particles using a microfluidizer such as Model 110Y microfluidizer (Microfluidics, Newton, Mass.). For example, MTP-PE may be present in an amount of about 0-500 μg/dose, more preferably 0-250 μg/dose and most preferably, 0-100 μg/dose. As used herein, the term "MF59-0" refers to the above submicron oil-in-water emulsion lacking MTP-PE, while the term MF59-MTP denotes a formulation that contains MTP-PE. For instance, "MF59-100" contains 100 μg MTP-PE per dose, and so on. MF69, another submicron oil-in-water emulsion for use herein, contains 4.3% w/v squalene, 0.25% w/v Tween 80™, and 0.75% w/v Span 85™ and optionally MTP-PE. Yet another submicron oil-in-water emulsion is MF75, also known as SAF, containing 10% squalene, 0.4% Tween 80™, 5% pluronic-blocked polymer L121, and thr-MDP, also microfluidized into a submicron emulsion. MF75-MTP denotes an MF75 formulation that includes MTP, such as from 100-400 μg MTP-PE per dose.

Submicron oil-in-water emulsions, methods of making the same and immunostimulating agents, such as muramyl peptides, for use in the compositions, are described in detail in International Publication No. WO 90/14837 and U.S. Pat. Nos. 6,299,884 and 6,451,325, incorporated herein by reference in their entireties.

Complete Freund's adjuvant (CFA) and incomplete Freund's adjuvant (IFA) may also be used as adjuvants in the invention.

C. Saponin Formulations

Saponin formulations, may also be used as adjuvants in the invention. Saponins are a heterologous group of sterol glycosides and triterpenoid glycosides that are found in the bark, leaves, stems, roots and even flowers of a wide range of plant species. Saponin from the bark of the *Quillaia saponaria* Molina tree have been widely studied as adjuvants. Saponin can also be commercially obtained from *Smilax ornata* (sarsaprilla), *Gypsophilla paniculata* (brides veil), and *Saponaria officianalis* (soap root). Saponin adjuvant formulations include purified formulations, such as QS21, as well as lipid formulations, such as ISCOMs.

Saponin compositions have been purified using High Performance Thin Layer Chromatography (HP-LC) and Reversed Phase High Performance Liquid Chromatography (RP-HPLC). Specific purified fractions using these techniques have been identified, including QS7, QS17, QS18, QS21, QH-A, QH-B and QH-C. Preferably, the saponin is QS21. A method of production of QS21 is disclosed in U.S. Pat. No. 5,057,540. Saponin formulations may also comprise a sterol, such as cholesterol (see WO96/33739).

Combinations of saponins and cholesterols can be used to form unique particles called Immunostimulating Complexs (ISCOMs). ISCOMs typically also include a phospholipid such as phosphatidylethanolamine or phosphatidylcholine. Any known saponin can be used in ISCOMs. Preferably, the ISCOM includes one or more of Quil A, QHA and QHC. ISCOMs are further described in EP0109942, WO 96/11711 and WO 96/33739. Optionally, the ISCOMS may be devoid of additional detergent. See WO 00/07621.

A review of the development of saponin based adjuvants can be found at Barr, et al., "ISCOMs and other saponin based adjuvants", Advanced Drug Delivery Reviews (1998) 32:247-271. See also Sjolander, et al., "Uptake and adjuvant activity of orally delivered saponin and ISCOM vaccines", Advanced Drug Delivery Reviews (1998) 32:321-338.

D. Virosomes and Virus Like Particles (VLPs)

Virosomes and Virus Like Particles (VLPs) can also be used as adjuvants in the invention. These structures generally contain one or more proteins from a virus optionally combined or formulated with a phospholipid. They are generally non-pathogenic, non-replicating and generally do not contain any of the native viral genome. The viral proteins may be recombinantly produced or isolated from whole viruses. These viral proteins suitable for use in virosomes or VLPs include proteins derived from influenza virus (such as HA or NA), Hepatitis B virus (such as core or capsid proteins), Hepatitis E virus, measles virus, Sindbis virus, Rotavirus, Foot-and-Mouth Disease virus, Retrovirus, Norwalk virus, human Papilloma virus, HIV, RNA-phages, Qβ-phage (such as coat proteins), GA-phage, fr-phage, AP205 phage, and Ty (such as retrotransposon Ty protein p1). VLPs are discussed further in WO 03/024480, WO 03/024481, and Niikura et al., "Chimeric Recombinant Hepatitis E Virus-Like Particles as an Oral Vaccine Vehicle Presenting Foreign Epitopes", Virology (2002) 293:273-280; Lenz et al., "Papillomarivurs-Like Particles Induce Acute Activation of Dendritic Cells", Journal of Immunology (2001) 5246-5355; Pinto, et al., "Cellular Immune Responses to Human Papillomavirus (HPV)-16 L1 Healthy Volunteers Immunized with Recombinant HPV-16 L1 Virus-Like Particles", Journal of Infectious Diseases (2003) 188:327-338; and Gerber et al., "Human Papillomavirus Virus-Like Particles Are Efficient Oral Immunogens when Coadministered with *Escherichia coli* Heat-Labile Entertoxin Mutant R192G or CpG", Journal of Virology (2001) 75 (10):4752-4760. Virosomes are discussed further in, for example, Gluck et al., "New Technology Platforms in the Development of Vaccines for the Future", Vaccine (2002) 20:B10-B16. Immunopotentiating reconstituted influenza virosomes (IRIV) are used as the subunit antigen delivery system in the intranasal trivalent IFLEXAL™ product {Mischler & Metcalfe (2002) Vaccine 20 Suppl 5:B17-23} and the INFLUVAC PLUS™ product.

E. Bacterial or Microbial Derivatives

0 Adjuvants suitable for use in the invention include bacterial or microbial derivatives such as:

1 (1) Non-Toxic Derivatives of Enterobacterial Lipopolysaccharide (LPS)

Such derivatives include Monophosphoryl lipid A (MPL) and 3-O-deacylated MPL (3dMPL). 3dMPL is a mixture of 3 De-O-acylated monophosphoryl lipid A with 4, 5 or 6 acylated chains. A preferred "small particle" form of 3 De-O-acylated monophosphoryl lipid A is disclosed in EP 0 689 454. Such "small particles" of 3dMPL are small enough to be sterile filtered through a 0.22 micron membrane (see EP 0 689 454). Other non-toxic LPS derivatives include monophosphoryl lipid A mimics, such as aminoalkyl glucosaminide phosphate derivatives e.g. RC-529. See Johnson et al. (1999) Bioorg Med Chem Lett 9:2273-2278.

(2) Lipid A Derivatives

Lipid A derivatives include derivatives of lipid A from *Escherichia coli* such as OM-174. OM-174 is described for example in Meraldi et al., "OM-174, a New Adjuvant with a Potential for Human Use, Induces a Protective Response with Administered with the Synthetic C-Terminal Fragment 242-310 from the circumsporozoite protein of *Plasmodium berghei*", Vaccine (2003) 21:2485-2491; and Pajak, et al., "The Adjuvant OM-174 induces both the migration and maturation of murine dendritic cells in vivo", Vaccine (2003) 21:836-842.

(3) Immunostimulatory Oligonucleotides

Immunostimulatory oligonucleotides suitable for use as adjuvants in the invention include nucleotide sequences containing a CpG motif (a sequence containing an unmethylated cytosine followed by guanosine and linked by a phosphate bond). Bacterial double stranded RNA or oligonucleotides containing palindromic or poly(dG) sequences have also been shown to be immunostimulatory.

The CpG's can include nucleotide modifications/analogs such as phosphorothioate modifications and can be double-stranded or single-stranded. Optionally, the guanosine may be replaced with an analog such as 2'-deoxy-7-deazaguanosine. See Kandimalla, et al., "Divergent synthetic nucleotide motif recognition pattern: design and development of potent immunomodulatory oligodeoxyribonucleotide agents with distinct cytokine induction profiles", Nucleic Acids Research (2003) 31 (9): 2393-2400; WO02/26757 and WO99/62923 for examples of possible analog substitutions. The adjuvant effect of CpG oligonucleotides is further discussed in Krieg, "CpG motifs: the active ingredient in bacterial extracts?", Nature Medicine (2003) 9 (7): 831-835; McCluskie, et al., "Parenteral and mucosal prime-boost immunization strategies in mice with hepatitis B surface antigen and CpG DNA", FEMS Immunology and Medical Microbiology (2002) 32:179-185; WO98/40100; U.S. Pat. No. 6,207,646; U.S. Pat. No. 6,239,116 and U.S. Pat. No. 6,429,199.

The CpG sequence may be directed to TLR9, such as the motif GTCGTT or TTCGTT. See Kandimalla, et al., "Toll-like receptor 9: modulation of recognition and cytokine induction by novel synthetic CpG DNAs", Biochemical Society Transactions (2003) 31 (part 3): 654-658. The CpG sequence may be specific for inducing a Th1 immune response, such as a CpG-A ODN, or it may be more specific for inducing a B cell response, such a CpG-B ODN. CpG-A and CpG-B ODNs are discussed in Blackwell, et al., "CpG-A-Induced Monocyte IFN-gamma-Inducible Protein-10 Production is Regulated by Plasmacytoid Dendritic Cell Derived IFN-alpha", J. Immunol. (2003) 170 (8):4061-4068; Krieg, "From A to Z on CpG", TRENDS in Immunology (2002) 23 (2): 64-65 and WO01/95935. Preferably, the CpG is a CpG-A ODN.

Preferably, the CpG oligonucleotide is constructed so that the 5' end is accessible for receptor recognition. Optionally, two CpG oligonucleotide sequences may be attached at their 3' ends to form "immunomers". See, for example, Kandimalla, et al., "Secondary structures in CpG oligonucleotides affect immunostimulatory activity", BBRC (2003) 306:948-953; Kandimalla, et al., "Toll-like receptor 9: modulation of recognition and cytokine induction by novel synthetic GpG DNAs", Biochemical Society Transactions (2003) 31 (part 3):664-658; Bhagat et al., "CpG penta- and hexadeoxyribonucleotides as potent immunomodulatory agents" BBRC (2003) 300:853-861 and WO 03/035836.

(4) ADP-Ribosylating Toxins and Detoxified Derivatives Thereof.

Bacterial ADP-ribosylating toxins and detoxified derivatives thereof may be used as adjuvants in the invention. Preferably, the protein is derived from *E. coli* (i.e., *E. coli* heat labile enterotoxin "LT), cholera ("CT"), or pertussis ("PT"). The use of detoxified ADP-ribosylating toxins as mucosal adjuvants is described in WO95/17211 and as parenteral adjuvants in WO98/42375. Preferably, the adjuvant is a detoxified LT mutant such as LT-K63, LT-R72, and LTR192G. The use of ADP-ribosylating toxins and detoxified derivatives thereof, particularly LT-K63 and LT-R72, as adjuvants can be found in the following references, each of which is specifically incorporated by reference herein in their entirety: Beignon, et al., "The LTR72 Mutant of Heat-Labile Enterotoxin of *Escherichia coli* Enhances the Ability of Peptide Antigens to Elicit CD4+ T Cells and Secrete Gamma Interferon after Coapplication onto Bare Skin", Infection and Immunity (2002) 70 (6):3012-3019; Pizza, et al., "Mucosal vaccines: non toxic derivatives of LT and CT as mucosal adjuvants", Vaccine (2001) 19:2534-2541; Pizza, et al., "LTK63 and LTR72, two mucosal adjuvants ready for clinical trials" Int. J. Med. Microbiol. (2000) 290 (4-5):455-461; Scharton-Kersten et al., "Transcutaneous Immunization with Bacterial ADP-Ribosylating Exotoxins, Subunits and Unrelated Adjuvants", Infection and Immunity (2000) 68(9):53 June 5313; Ryan et al., "Mutants of *Escherichia coli* Heat-Labile Toxin Act as Effective Mucosal Adjuvants for Nasal Delivery of an Acellular Pertussis Vaccine: Differential Effects of the Nontoxic AB Complex and Enzyme Activity on Th1 and Th2 Cells" Infection and Immunity (1999) 67 (12): 6270-6280; Partidos et al., "Heat-labile enterotoxin of *Escherichia coli* and its site-directed mutant LTK63 enhance the proliferative and cytotoxic T-cell responses to intranasally co-immunized synthetic peptides", Immunol. Lett. (1999) 67 (3):209-216; Peppoloni et al., "Mutants of the *Escherichia coli* heat-labile enterotoxin as safe and strong adjuvants for intranasal delivery of vaccines", Vaccines (2003) 2 (2):285-293; and Pine et al., (2002) "Intranasal immunization with influenza vaccine and a detoxified mutant of heat labile enterotoxin from *Escherichia coli* (LTK63)" J. Control Release (2002) 85 (1-3):263-270. Numerical reference for amino acid substitutions is preferably based on the alignments of the A and B subunits of ADP-ribosylating toxins set forth in Domenighini et al., Mol. Microbiol. (1995) 15 (6): 1165-1167, specifically incorporated herein by reference in its entirety.

F. Bioadhesives and Mucoadhesives

Bioadhesives and mucoadhesives may also be used as adjuvants in the invention. Suitable bioadhesives include esterified hyaluronic acid microspheres (Singh et al. (2001) J. Cont. Rele. 70:267-276) or mucoadhesives such as cross-linked derivatives of poly(acrylic acid), polyvinyl alcohol, polyvinyl pyrollidone, polysaccharides and carboxymethylcellulose. Chitosan and derivatives thereof may also be used as adjuvants in the invention. E.g. WO99/27960.

G. Microparticles

Microparticles may also be used as adjuvants in the invention. Microparticles (i.e. a particle of .about.100 nm to .about.150 μm in diameter, more preferably .about.200 nm to .about.30 μm in diameter, and most preferably .about.500 nm to .about.10 μm in diameter) formed from materials that are biodegradable and non-toxic (e.g. a poly(α-hydroxy acid), a polyhydroxybutyric acid, a polyorthoester, a polyanhydride, a polycaprolactone, etc.), with poly(lactide-co-glycolide) are preferred, optionally treated to have a negatively-charged surface (e.g. with SDS) or a positively-charged surface (e.g. with a cationic detergent, such as CTAB).

H. Liposomes

Examples of liposome formulations suitable for use as adjuvants are described in U.S. Pat. No. 6,090,406, U.S. Pat. No. 5,916,588, and EP 0 626 169.

I. Polyoxyethylene Ether and Polyoxyethylene Ester Formulations

Adjuvants suitable for use in the invention include polyoxyethylene ethers and polyoxyethylene esters. WO99/52549. Such formulations further include polyoxyethylene sorbitan ester surfactants in combination with an octoxynol (WO01/21207) as well as polyoxyethylene alkyl ethers or ester surfactants in combination with at least one additional non-ionic surfactant such as an octoxynol (WO 01/21152).

Preferred polyoxyethylene ethers are selected from the following group: polyoxyethylene-9-lauryl ether (laureth 9), polyoxyethylene-9-steoryl ether, polyoxytheylene-8-steoryl ether, polyoxyethylene-4-lauryl ether, polyoxyethylene-35-lauryl ether, and polyoxyethylene-23-lauryl ether.

J. Polyphosphazene (PCPP)

PCPP formulations are described, for example, in Andrianov et al., "Preparation of hydrogel microspheres by coacervation of aqueous polyphophazene solutions", Biomaterials (1998) 19 (1-3):109-115 and Payne et al., "Protein Release from Polyphosphazene Matrices", Adv. Drug. Delivery Review (1998) 31 (3):185-196.

K. Muramyl Peptides

Examples of muramyl peptides suitable for use as adjuvants in the invention include N-acetyl-muramyl-L-threonyl-D-isoglutamine (thr-MDP), N-acetyl-normuramyl-1-alanyl-d-isoglutamine (nor-MDP), and N-acetylmuramyl-1-alanyl-d-isoglutaminyl-1-alanine-2-(1'-2'-dipalmitoyl-s-n-glycero-3-hydroxyphosphoryloxy)-ethylamine MTP-PE).

L. Imidazoquinolone Compounds.

Examples of imidazoquinolone compounds suitable for use adjuvants in the invention include Imiquamod and its homologues, described further in Stanley, "Imiquimod and the imidazoquinolones: mechanism of action and therapeutic potential" Clin Exp Dermatol (2002) 27 (7):571-577 and Jones, "Resiquimod 3M", Curr Opin Investig Drugs (2003) 4 (2):214-218.

The invention may also comprise combinations of aspects of one or more of the adjuvants identified above. For example, the following adjuvant compositions may be used in the invention:

(1) a saponin and an oil-in-water emulsion (WO 99/11241);

(2) a saponin (e.g., QS21)+a non-toxic LPS derivative (e.g. 3dMPL) (see WO 94/00153);

(3) a saponin (e.g., QS21)+a non-toxic LPS derivative (e.g. 3dMPL)+a cholesterol;

(4) a saponin (e.g. QS21)+3dMPL+IL-12 (optionally+a sterol) (WO 98/57659);

(5) combinations of 3dMPL with, for example, QS21 and/or oil-in-water emulsions (See European patent applications 0835318, 0735898 and 0761231);

(6) SAF, containing 10% Squalane, 0.4% Tween 80, 5% pluronic-block polymer L121, and thr-MDP, either microfluidized into a submicron emulsion or vortexed to generate a larger particle size emulsion.

(7) Ribi™ adjuvant system (RAS), (Ribi Immunochem) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™);

(8) one or more mineral salts (such as an aluminum salt)+a non-toxic derivative of LPS (such as 3dPML).

(9) one or more mineral salts (such as an aluminum salt)+an immunostimulatory oligonucleotide (such as a nucleotide sequence including a CpG motif). Combination No. (9) is a preferred adjuvant combination.

M. Human Immunomodulators

Human immunomodulators suitable for use as adjuvants in the invention include cytokines, such as interleukins (e.g. IL-1, IL-2, IL-4, IL-5, IL-6, IL-7, IL-12, etc.), interferons (e.g. interferon-.gamma.), macrophage colony stimulating factor, and tumor necrosis factor.

Aluminum salts and MF59 are preferred adjuvants for use with injectable influenza vaccines. Bacterial toxins and bioadhesives are preferred adjuvants for use with mucosally-delivered vaccines, such as nasal vaccines.

The immunogenic compositions of the present invention may be administered in combination with an antibiotic treatment regime. In one embodiment, the antibiotic is administered prior to administration of the antigen of the invention or the composition comprising the one or more of the antigens of the invention.

In another embodiment, the antibiotic is administered subsequent to the administration of the one or more antigens of the invention or the composition comprising the one or more antigens of the invention. Examples of antibiotics suitable for use in the treatment of the Streptococcal infections of the invention include but are not limited to penicillin or a derivative thereof or clindamycin or the like.

Further Antigens

The compositions of the invention may further comprise one or more additional Gram positive bacterial antigens which are not associated with an AI. Preferably, the Gram positive bacterial antigens that are not associated with an AI can provide protection across more than one serotype or strain isolate. For example, a first non-AI antigen, in which the first non-AI antigen is at least 90% (i.e., at least 90, 91, 92, 93, 94, 95, 96, 97, 98, 99, or 100%) homologous to the amino acid sequence of a second non-AI antigen, wherein the first and the second non-AI antigen are derived from the genomes of different serotypes of a Gram positive bacteria, may be further included in the compositions. The first non-AI antigen may also be homologous to the amino acid sequence of a third non-AI antigen, such that the first non-AI antigen, the second non-AI antigen, and the third non-AI antigen are derived from the genomes of different serotypes of a Gram positive bacteria. The first non-AI antigen may also be homologous to the amino acid sequence of a fourth non-AI antigen, such that the first non-AI antigen, the second non-AI antigen, the third non-AI antigen, and the fourth non-AI antigen are derived from the genomes of different serotypes of a Gram positive bacteria.

The first non-AI antigen may be GBS 322. The amino acid sequence of GBS 322 across GBS strains from serotypes Ia, Ib, II, III, V, and VIII is greater than 90%. Alternatively, the first non-AI antigen may be GBS 276. The amino acid sequence of GBS 276 across GBS strain from serotypes Ia, Ib, II, III, V, and VIII is greater than 90%. Table 13 provides the percent amino acid sequence identity of GBS 322 and GBS 276 across different GBS strains and serotypes.

TABLE 13

Conservation of GBS 322 and GBS 276 amino acid sequences

| | | GBS 322 | | GBS 276 | |
|---|---|---|---|---|---|
| Serotype | Strains | cGH | % AA identity | cGH | % AA identity |
| Ia | 090 | + | 98.60 | + | 97.90 |
| | A909 | + | 98.30 | + | 97.90 |
| | 515 | + | 98.80 | + | 97.50 |
| | DK1 | + | | + | |
| | DK8 | + | | + | |
| | Davis | + | | + | |
| Ib | 7357b | + | | + | |
| | H36B | + | 98.30 | + | 97.80 |
| II | 18RS21 | + | 100.00 | + | 99.90 |
| | DK21 | + | | + | |
| III | NEM316 | + | 100.00 | + | 97.00 |
| | COH31 | + | | + | |
| | D136 | + | | + | |
| | M732 | + | 98.00 | + | 100.00 |
| | COH1 | + | 98.30 | + | 100.00 |
| | M781 | + | 98.30 | + | 99.60 |
| No type | CJB110 | + | 98.60 | + | 97.90 |
| | 1169NT | + | 97.40 | + | 97.90 |
| V | CJB111 | + | 100.00 | + | |
| | 2603 | + | 100.00 | + | 100.00 |
| VIII | JM130013 | + | 100.00 | + | 97.90 |
| | SMU014 | + | | + | |
| | total | 22/22 | 98.28 +/− 0.4 | 22/22 | 98.44 +/− 1.094 |

As an example, inclusion of a non-AI protein, GBS 322, in combination with AI antigens GBS 67, GBS 80, and GBS 104 provided protection to newborn mice in an active maternal immunization assay.

TABLE 14

Active maternal immunization assay for a combination of fragments from GBS 322, GBS 80, GBS 104, and GBS 67

| | | FACS (Δ Mean) | | | MIX = 322 + 80 + 104 + 67 | | PBS | |
|---|---|---|---|---|---|---|---|---|
| GBS strains | Type | GBS 80 | GBS 67 | GBS 322 | alive/treated | % protection | alive/treated | % protection |
| 515 | Ia | 0 | 409 | 227 | 39/40 | 97 | 6/40 | 15 |
| 7357b- | Ib | 91 | 316 | 102 | 19/30 | 63 | 1/30 | 3 |
| DK21 | II | 0 | 331 | 416 | 25/34 | 73 | 17/48 | 35 |
| 5401 | II | 170 | 618 | 135 | 35/40 | 87 | 3/37 | 8 |
| 3050 | II | 43 | 460 | 188 | 48/48 | 100 | 1/30 | 3 |
| COH1 | III | 305 | 0 | 130 | 36/36 | 100 | 7/40 | 17 |
| M781 | III | 65 | 0 | 224 | 30/40 | 75 | 4/39 | 10 |
| 2603 | V | 125 | 105 | 313 | 27/33 | 82 | 10/35 | 28 |
| CJB111 | V | 370 | 481 | 63 | 25/28 | 89 | 4/46 | 9 |
| JM9130013 | VIII | 597 | 83 | 143 | 37/39 | 95 | 5/40 | 12 |
| JMU071 | VIII | 556 | 79 | 170 | 44/50 | 88 | 18/50 | 36 |
| NT1169 | NT | 0 | 443 | 213 | 12/32 | 37 | 11/35 | 31 |

In fact, the non-AI GBS 322 antigen may itself provide protection to newborn mice in an active maternal immunization assay.

TABLE 16

Active maternal immunization assay for each of GBS 80 and GBS 322 antigens

| | | GBS 80 | | | GBS 322 | | |
|---|---|---|---|---|---|---|---|
| | | FACS | Protection (% survival) | | FACS | Protection (% survival) | |
| GBS strains | Type | Δ Mean | antigen | ctrl- | Δ Mean | antigen | ctrl- |
| CJB111 | V | 370 | 72% | 40% | 63 | 57% | 40% |
| COH1 | III | 305 | 76% | 10% | 130 | 3% | 10% |
| 2603 | V | 82 | 22% | 34% | 313 | 83% | 34% |
| 7357b- | Ib | 91 | 36% | 34% | 102 | 43% | 34% |
| 18RS21 | II | 0 | 15% | 24% | 268 | 84% | 24% |
| DK21 | II | 0 | 10% | 21% | 416 | 67% | 25% |
| A909 | Ia | 0 | 0% | 14% | | | |
| 090 | Ia | 0 | 0% | 0% | | | |
| H36B | Ib | | | | 105 | 34% | 32% |

Thus, inclusion of a non-AI protein in an immunogenic composition of the invention may provide increased protection a mammal The immunogenic compositions comprising *S. pneumoniae* AI polypeptides may further secondary SP protein antigens which include (a) any of the SP protein antigens disclosed in WO 02/077021 or U.S. provisional application 60/672,857, filed Apr. 20, 2005, (2) immunogenic portions of the antigens comprising at least 7 contiguous amino acids, (3) proteins comprising amino acid sequences which retain immunogenicity and which are at least 95% identical to these SP protein antigens (e.g., 95%, 96%, 97%, 98%, 99%, or 99.5% identical), and (4) fusion proteins, including hybrid SP protein antigens, comprising (1)-(3).

Alternatively, the invention may include an immunogenic composition comprising a first and a second Gram positive bacteria non-AI protein, wherein the polynucleotide sequence encoding the sequence of the first non-AI protein is less than 90% (i.e., less than 90, 88, 86, 84, 82, 81, 78, 76, 74, 72, 70, 65, 60, 55, 50, 45, 40, 35, or 30 percent) homologous than the corresponding sequence in the genome of the second non-AI protein.

The compositions of the invention may further comprise one or more additional non-Gram positive bacterial antigens, including additional bacterial, viral or parasitic antigens. The compositions of the invention may further comprise one or more additional non-GBS antigens, including additional bacterial, viral or parasitic antigens.

In another embodiment, the GBS antigen combinations of the invention are combined with one or more additional, non-GBS antigens suitable for use in a vaccine designed to protect elderly or immunocomprised individuals. For example, the GBS antigen combinations may be combined with an antigen derived from the group consisting of *Enterococcus faecalis, Staphylococcus aureus, Staphylococcus epidermis, Pseudomonas aeruginosa, Legionella pneumophila, Listeria monocytogenes, Neisseria meningitides*, influenza, and Parainfluenza virus ('PIV').

Where a saccharide or carbohydrate antigen is used, it is preferably conjugated to a carrier protein in order to enhance immunogenicity {e.g. Ramsay et al. (2001) Lancet 357 (9251):195-196; Lindberg (1999) Vaccine 17 Suppl 2:S28-36; Buttery & Moxon (2000) J R Coll Physicians Lond 34:163-168; Ahmad & Chapnick (1999) Infect Dis Clin North Am 13:113-133, vii.; Goldblatt (1998) J. Med. Microbiol. 47:563-567; European patent 0 477 508; U.S. Pat. No. 5,306,492; International patent application WO98/42721; Conjugate Vaccines (eds. Cruse et al.) ISBN 3805549326, particularly vol. 10:48-114; and Hermanson (1996) Bioconjugate Techniques ISBN: 0123423368 or 012342335X}. Preferred carrier proteins are bacterial toxins or toxoids, such as diphtheria or tetanus toxoids. The $CRM_1$97 diphtheria toxoid is particularly preferred {Research Disclosure, 453077 (January 2002)}. Other carrier polypeptides include the *N. meningitidis* outer membrane protein (EP-A-0372501), synthetic peptides (EP-A-0378881; EP-A-0427347), heat shock proteins (WO 93/17712; WO 94/03208), pertussis proteins (WO 98/58668; EP A 0471177), protein D from *H. influenzae* (WO 00/56360), cytokines (WO 91/01146), lymphokines, hormones, growth factors, toxin A or B from *C. difficile* (WO00/61761), iron-uptake proteins (WO01/72337), etc. Where a mixture comprises capsular saccharides from both serogroups A and C, it may be preferred that the ratio (w/w) of MenA saccharide:MenC saccharide is greater than 1 (e.g. 2:1, 3:1, 4:1, 5:1, 10:1 or higher). Different saccharides can be conjugated to the same or different type of carrier protein. Any suitable conjugation reaction can be used, with any suitable linker where necessary.

Toxic protein antigens may be detoxified where necessary e.g. detoxification of pertussis toxin by chemical and/or genetic means.

Where a diphtheria antigen is included in the composition it is preferred also to include tetanus antigen and pertussis antigens. Similarly, where a tetanus antigen is included it is preferred also to include diphtheria and pertussis antigens. Similarly, where a pertussis antigen is included it is preferred also to include diphtheria and tetanus antigens.

Antigens in the composition will typically be present at a concentration of at least 1 μg/ml each. In general, the concentration of any given antigen will be sufficient to elicit an immune response against that antigen.

As an alternative to using protein antigens in the composition of the invention, nucleic acid encoding the antigen may be used {e.g. refs. Robinson & Torres (1997) Seminars in Immunology 9:271-283; Donnelly et al. (1997) Annu Rev Immunol 15:617-648; Scott-Taylor & Dalgleish (2000) Expert Opin Investig Drugs 9:471480; Apostolopoulos & Plebanski (2000) Curr Opin Mol Ther 2:441-447; Ilan (1999) Curr Opin Mol Ther 1:116-120; Dubensky et al. (2000) Mol Med 6:723-732; Robinson & Pertmer (2000) Adv Virus Res 55:1-74; Donnelly et al. (2000) Am J Respir Crit Care Med 162 (4 Pt 2):S190-193; and Davis (1999) Mt. Sinai J. Med. 66:84-90}. Protein components of the compositions of the invention may thus be replaced by nucleic acid (preferably DNA e.g. in the form of a plasmid) that encodes the protein.

DEFINITIONS

The term "comprising" means "including" as well as "consisting" e.g. a composition "comprising" X may consist exclusively of X or may include something additional e.g. X+Y.

The term "about" in relation to a numerical value x means, for example, x.+−0.10%.

References to a percentage sequence identity between two amino acid sequences means that, when aligned, that percentage of amino acids are the same in comparing the two sequences. This alignment and the percent homology or sequence identity can be determined using software programs known in the art, for example those described in section 7.7.18 of Current Protocols in Molecular Biology (F. M. Ausubel et al., eds., 1987) Supplement 30. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in Smith & Waterman (1981) Adv. Appl. Math. 2: 482-489.

The invention is further illustrated, without limitation, by the following examples.

Example 1

Binding of an Adhesin Island Surface Protein, GBS 80, to Fibrinogen and Fibronectin This example demonstrates that an Adhesin Island surface protein, GBS 80 can bind to fibrinogen and fibronectin.

An enzyme-linked immunosorbent assay (ELISA) was used to analyse the in vitro binding ability of recombinant GBS 80 to immobilized extra-cellular matrix (ECM) proteins but not to bovine serum albumin (BSA). Microtiter plates were coated with ECM proteins (fibrinogen, fibronectin, laminin, collagen type IV) and binding assessed by adding varying concentrations of a recombinant form of GBS 80, over-expressed and purified from *E. coli* (FIG. 5A). Plates were then incubated sequentially with a) mouse anti-GBS 80 primary antibody; b) rabbit anti-mouse AP-conjugated secondary antibody; c) pNPP colorimetric substrate. Relative binding was measured by monitoring absorbance at 405 nm, using 595 nm as a reference wavelength. FIG. 5*b* shows binding of recombinant GBS 80 to immobilized ECM proteins (1 μg) as a function of concentration of GBS 80. BSA was used as a negative control. Data points represent the means of $OD_{405}$ values±standard deviation for 3 wells.

Binding of GBS 80 to the tested ECM proteins was found to be concentration dependent and exhibited saturation kinetics. As is also evident from FIG. 5, binding of GBS 80 to fibronectin and fibrinogen was greater than binding to laminin and collagen type IV at all the concentrations tested.

Example 2

GBS 80 is Required for Surface Localization of GBS 104

This example demonstrates that co-expression of GBS 80 is required for surface localization of GBS 104.

The polycistronic nature of the Adhesin Island I mRNA was investigated through reverse transcriptase-PCR (RT-PCR) analysis employing primers designed to detect transcripts arising from contiguous genes. Total RNA was isolated from GBS cultures grown to an optical density at 600 nm ($OD_{600}$) of 0.3 in THB (Todd-Hewitt broth) by the RNeasy Total RNA isolation method (Qiagen) according to the manufacturer's instructions. The absence of contaminating chromosomal DNA was confirmed by failure of the gene amplification reactions to generate a product detectable by agarose gel electrophoresis, in the absence of reverse transcriptase. RT-PCR analysis was performed with the Access RT-PCR system (Promega) according to the manufacturer's instructions, employing PCR cycling temperatures of 60° C. for annealing and 70° C. for extension. Amplification products were visualized alongside 100-bp DNA markers in 2% agarose gels after ethidium bromide staining.

FIG. 5 shows that all the genes are co-transcribed as an operon. A schematic of the AI-1 operon is shown above the agarose gel analysis of the RT-PCR products. Large rectangular arrows indicate the predicted transcript direction. Primer pairs were selected such as "1-4" cross the 3' finish-5' start of successive genes and overlap each gene by at least 200 bp. Additionally, "1" crosses a putative rho-independent transcriptional terminator. "5" is an internal GBS 80 control and "6" is an unrelated control from a highly expressed gene. Lanes: "a": RNA plus RTase enzyme; "b" RNA without RTase; "c": genomic DNA control.

Figure 8A:
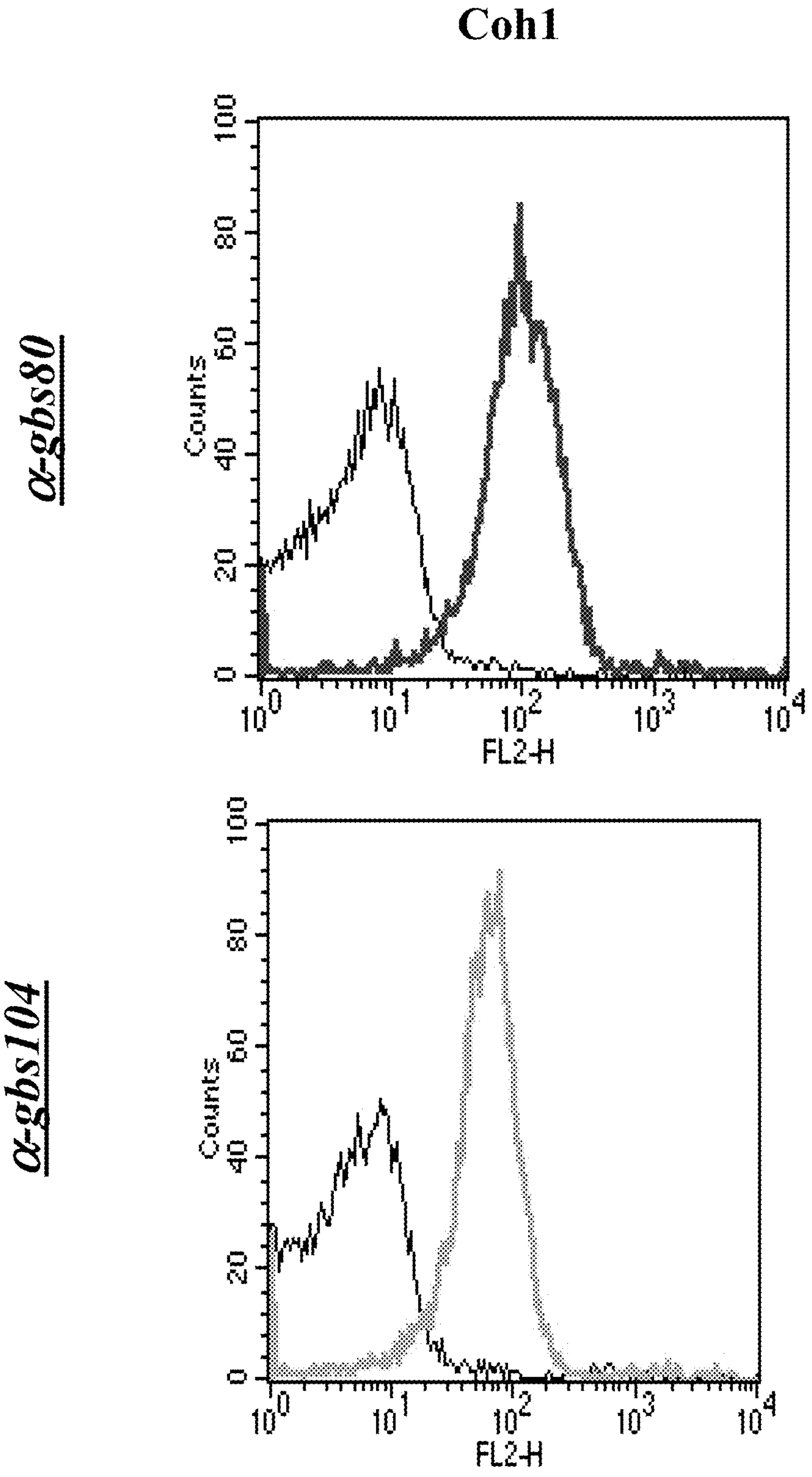
Figure 8D:
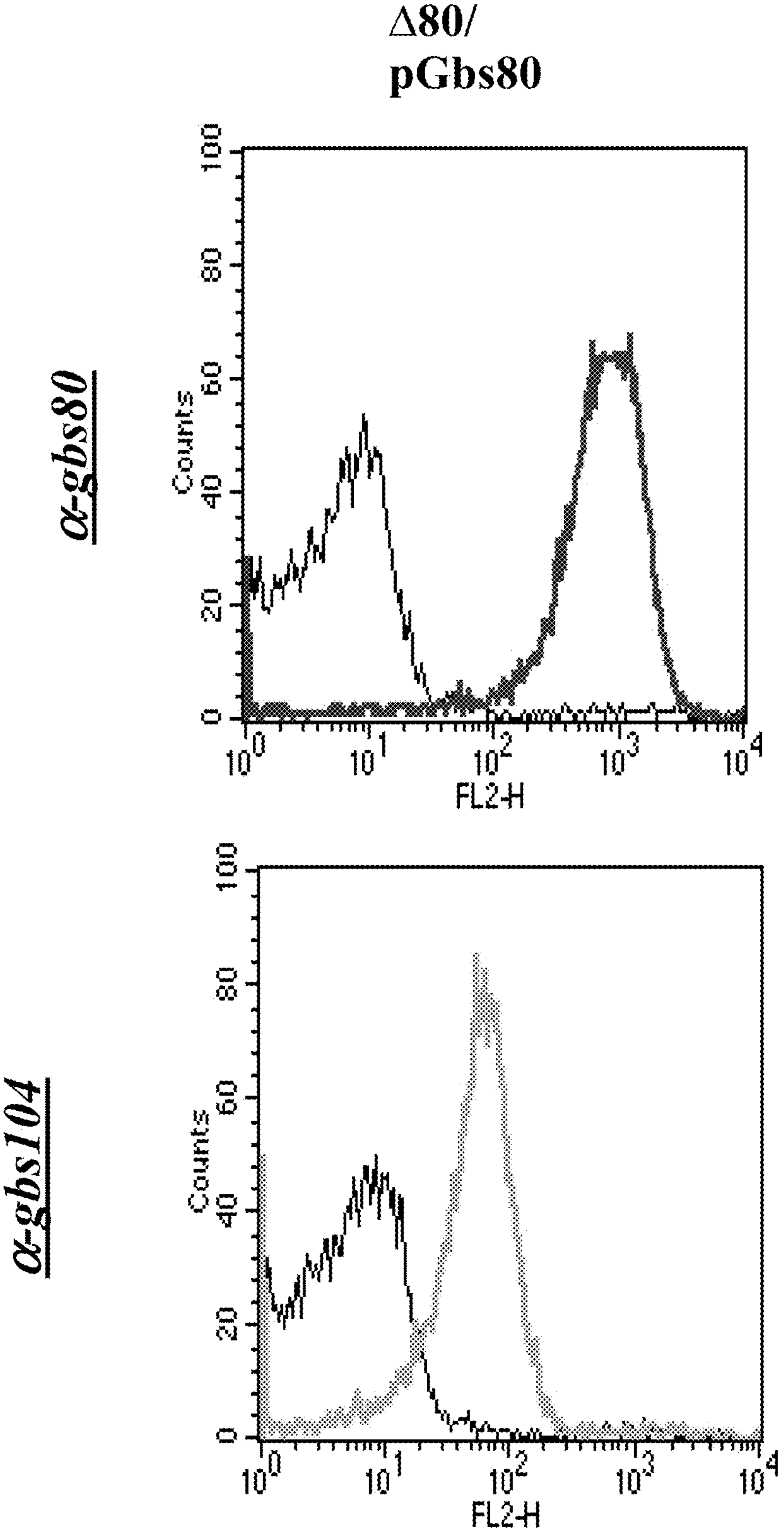
Figure 8E:
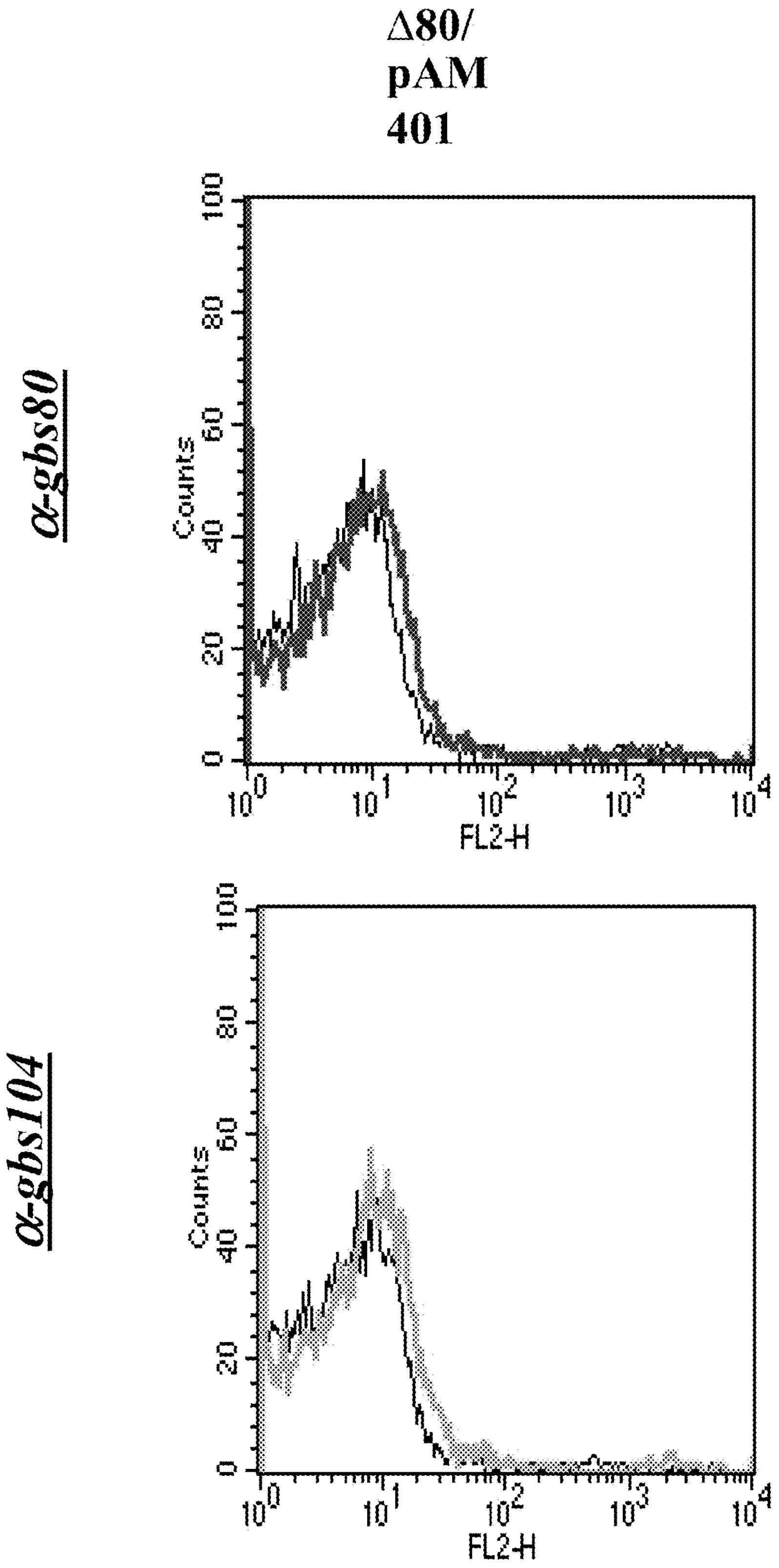
Figure 9A:
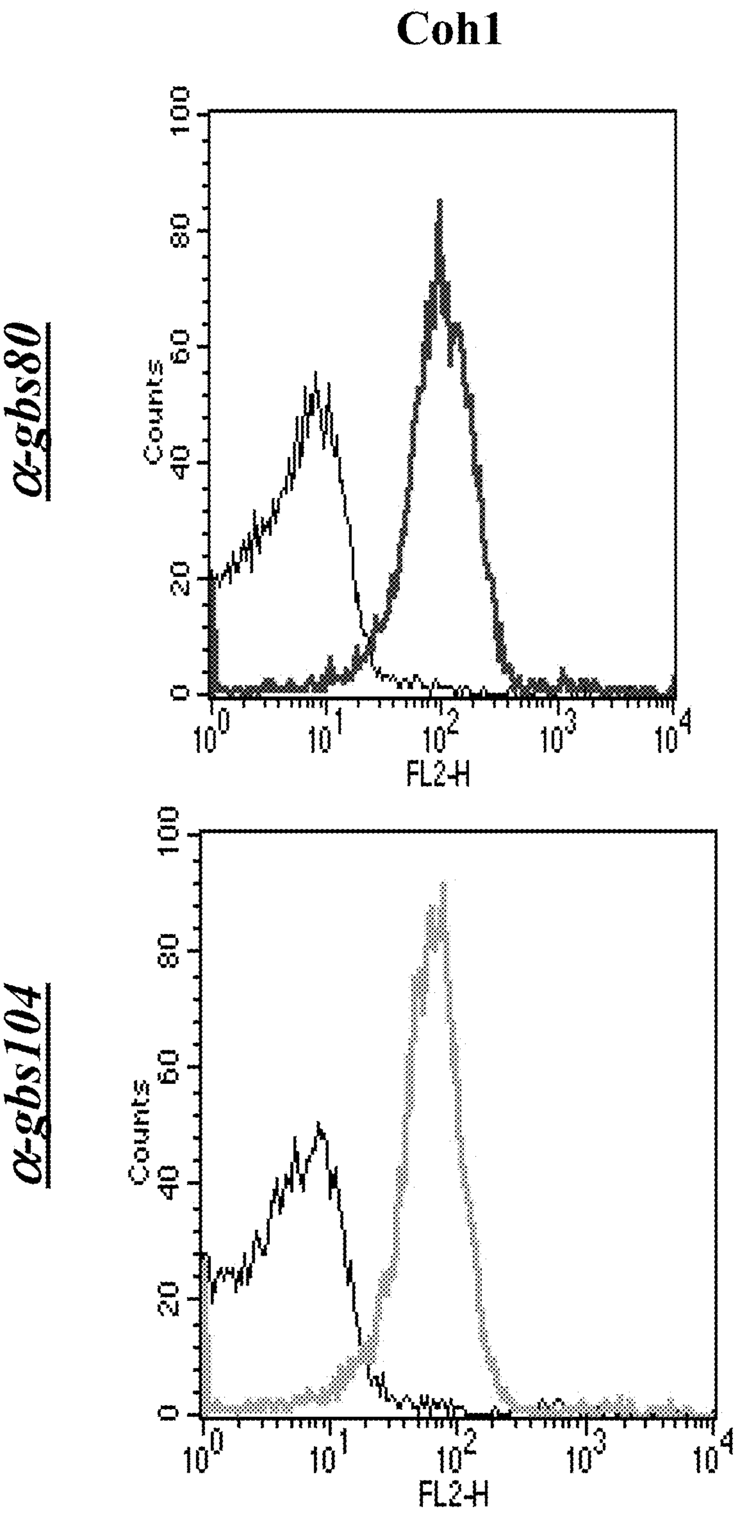
Figure 9B:
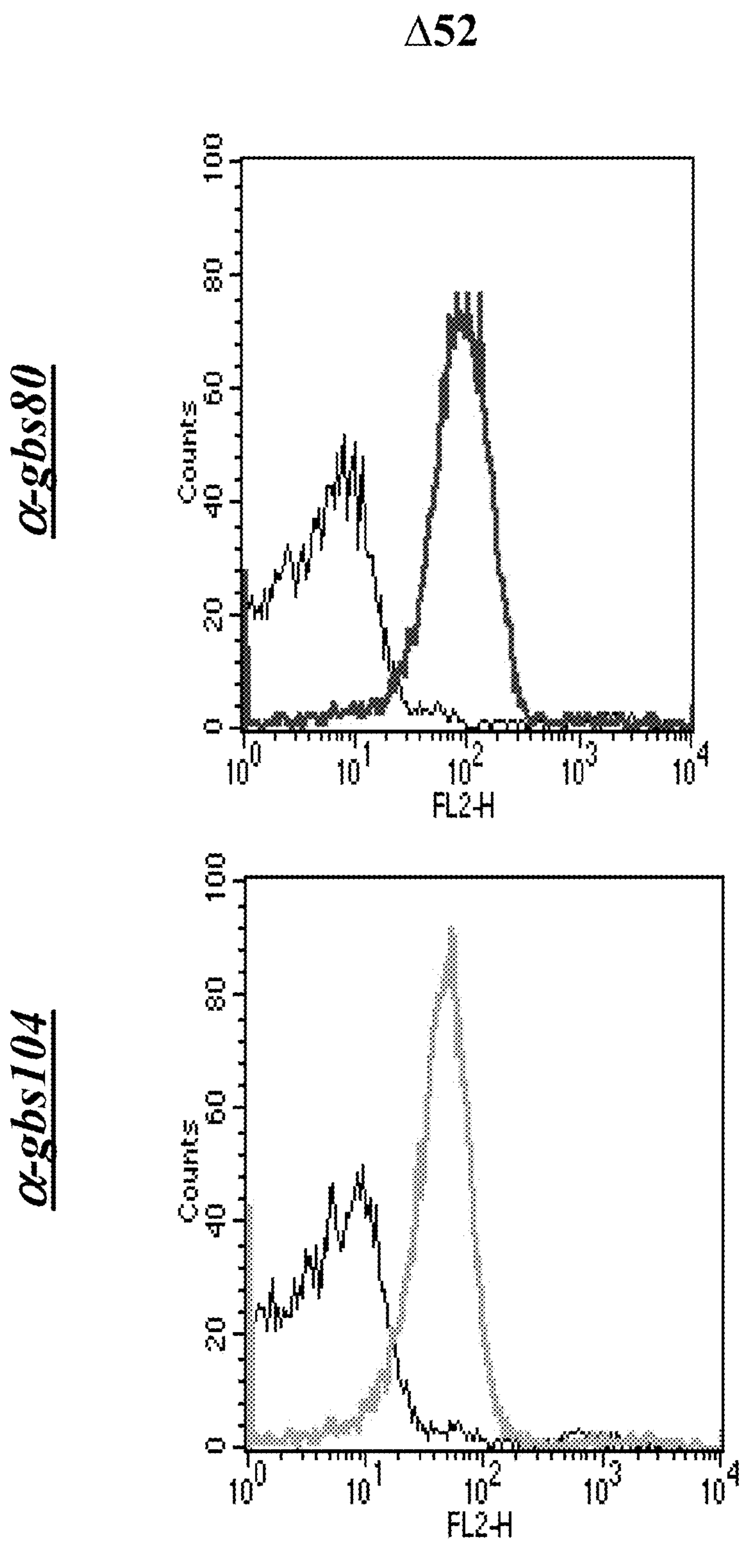
Figure 9C:
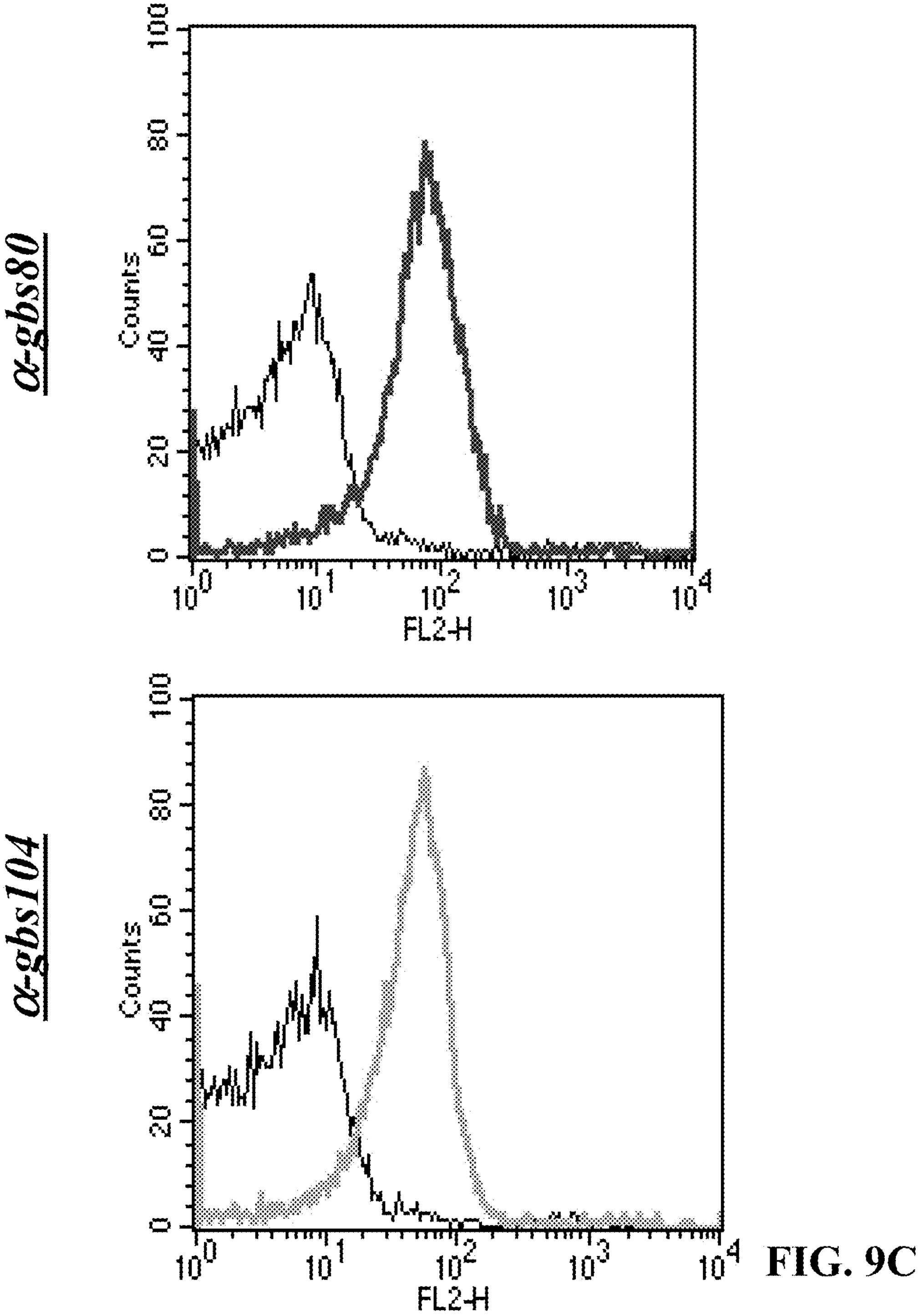
Figure 9E:
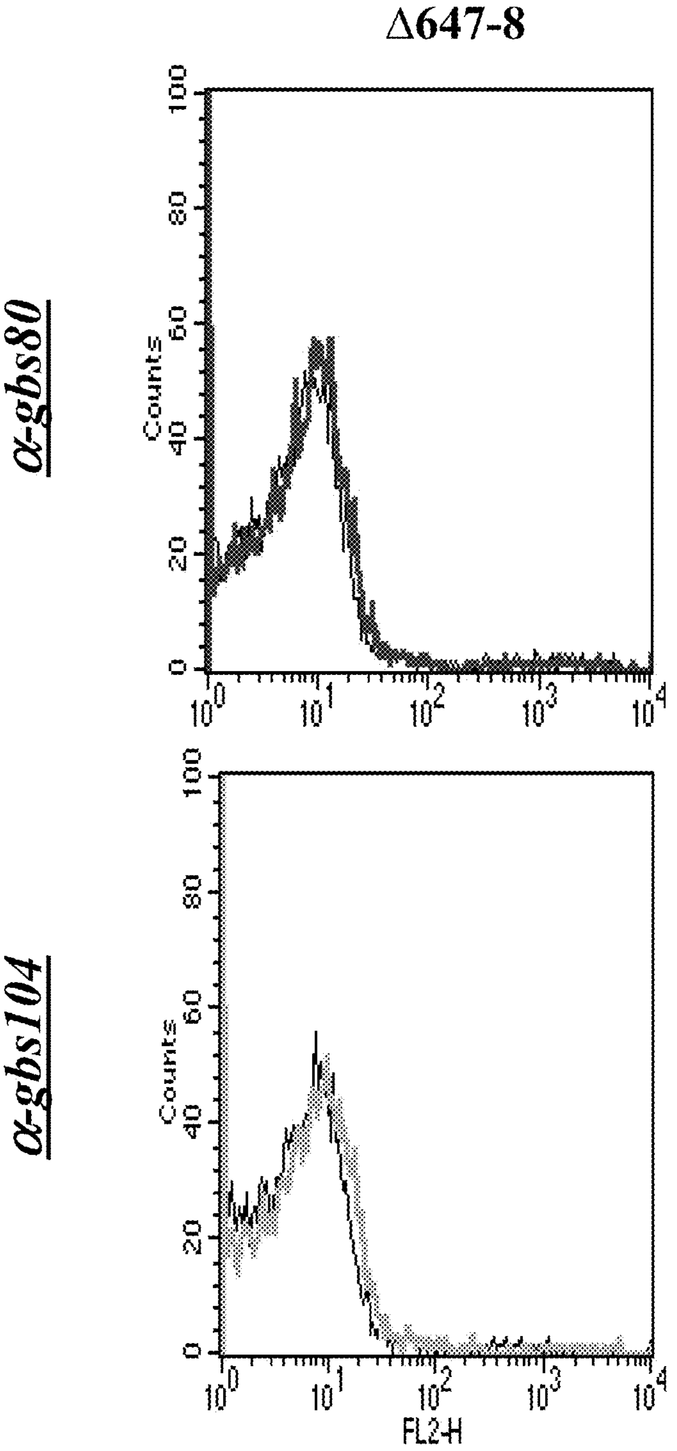

In the effort to elucidate the functions of the AI-1 proteins, in frame deletions of all of the genes within the operon have been constructed and the resulting mutants characterized with respect to surface exposure of the encoded antigens (see FIG. 8).

Each in-frame deletion mutation was constructed by splice overlap extension PCR (SOE-PCR) essentially as described by Horton et al. Horton R. M., Z. L. Cai, s. N. Ho, L. R. Pease (1990) Biotechniques 8:528-35 using suitable primers and cloned into the temperature sensitive shuttle vector pJRS233 to replace the wild type copy by allelic exchange Perez-Casal, J., J. A. Price, et al. (1993) Mol Microbiol 8 (5): 809-19. All plasmid constructions utilized standard molecular biology techniques, and the identities of DNA fragments generated by PCR were verified by sequencing. Following SOE-PCR, the resulting mutant DNA fragments were digested with XhoI and EcoRI, and ligated into a similarly digested pJRS233. The resulting vectors were introduced by electroporation into the chromosome of 2603 and COH1 GBS strains in a three-step process, essentially as described in Framson et al. Framson, P. E., A. Nittayajarn, J. Merry, P. Youngman, and C. E. Rubens. (1997) Appl. Environ. Microbiol. 63 (9):353947. Briefly, the vector pJRS233 contains an erm gene encoding erythromycin resistance and a temperature-sensitive gram-positive replicon that is active at 30° C. but not at 37° C. Initially, the constructs are electroporated into GBS electrocompetent cells prepared as described by Frameson et al., and transformants containing free plasmid are selected by their ability to grow at 30° C. on Todd-Hewitt Broth (THB) agar plates containing 1 μg/ml erythromycin. The second step includes a selection step for strains in which the plasmid has integrated into the chromosome via a single recombination event over the homologous plasmid insert and chromosome sequence by their ability to grow at 37° C. on THB agar medium containing 1 mg/ml erythromycin. In the third step, GBS cells containing the plasmid integrated within the chromosome (integrants) are serially passed in broth culture in the absence of antibiotics at 30° C. Plasmid excision from the chromosome via a second recombination event over the duplicated target gene sequence either completed the allelic exchange or reconstituted the wild-type genotype. Subsequent loss of the plasmid in the absence of antibiotic selection pressure resulted in an erythromycin-sensitive phenotype. In order to assess gene replacement a screening of erythromycin-sensitive colonies was performed by analysis of the target gene PCR amplicons.

FIG. 7 reports a schematic of the IS-1 operon for each knock-out strain generated, along with the deletion position within the amino acidic sequence. Most data presented here concern the COH1 deletion strains, in which the expression of each of the antigens is higher by DNA microarray analysis (data not shown) as well as detectable by FACS analysis (see FIG. 8). The double mutant in 2603 480, 4104 double mutant was constructed by sequential allelic exchanges of the shown alleles.

Immunization Protocol

Immune sera for FACS experiments were obtained as follows.

Groups of 4 CD-1 outbred female mice 6-7 weeks old (Charles River Laboratories, Calco Italy) were immunized with the selected GBS antigens, (20 μg of each recombinant GBS antigen), suspended in 100 μl of PBs. Each group received 3 doses at days 0, 21 and 35. Immunization was performed through intra-peritoneal injection of the protein with an equal volume of Complete Freund's Adjuvant (CFA) for the first dose and Incomplete Freund's Adjuvant (IFA) for the following two doses. In each immunization scheme negative and positive control groups are used. Immune response was monitored by using serum samples taken on day 0 and 49.

FACS Analysis

Preparation of Paraformaldehyde Treated GBS Cells and their FACS Analysis were carried out as follows.

GBS serotype COH1 strain cells were grown in Todd Hewitt Broth (THB; Difco Laboratories, Detroit, Mich.) to OD600 nm=0.5. The culture was centrifuged for 20 minutes at 5000 rpm and bacteria were washed once with PBS, resuspended in PBS containing 0.05% paraformaldehyde, and incubated for 1 hours at 37° C. and then overnight at 4° C. 50 μl of fixed bacteria (OD600 0.1) were washed once with PBS, resuspended in 20 μl of Newborn Calf Serum, (Sigma) and incubated for 20 min. at room temperature. The cells were then incubated for 1 hour at 4° C. in 100 μl of preimmune or immune sera, diluted 1:200 in dilution buffer (PBS, 20% Newborn Calf Serum, 0.1% BSA). After centrifugation and washing with 200 μl of washing buffer (0.1% BSA in PBS), samples were incubated for 1 hour at 4° C. with 50 μl of R-Phicoerytrin conjugated $F(ab)_2$ goat anti-mouse IgG (Jackson ImmunoResearch Laboratories; Inc.), diluted 1:100 in dilution buffer. Cells were washed with 200 μl of washing buffer and resuspended in 200 μl of PBs. Samples were analysed using a FACS Calibur apparatus (Becton Dickinson, Mountain View, Calif.) and data were analyzed using the Cell Quest Software (Becton Dickinson). A shift in mean fluorescence intensity of >75 channels compared to preimmune sera from the same mice was considered positive. This cutoff was determined from the mean plus two standard deviations of shifts obtained with control sera raised against mock purified recombinant proteins from cultures of *E. coli* carrying the empty expression vector and included in every experiment. Artifacts due to bacterial lysis were excluded using antisera raised against 6 different known cytoplasmic proteins all of which were negative FACS data on COH1 single KO mutants for GBS 104 and GBS 80 indicated that GBS 80 is required for surface localization of GBS 104.

As shown in FIG. 8, GBS 104 is not surface exposed in the 480 strain (second column, bottom), but is present in the whole protein extracts (see FIG. 10). Mean shift values suggest that GBS 104 is partially responsible for GBS 80 surface exposure (Mean shift of GBS 80 is reduced to .about.60% wild-type levels in Δ104), and that GBS 80 is over-expressed in the complemented strain (mean shift value .about.200% wild-type level). The Δ80/pGBS 80 strain contains the GBS 80 orf cloned in the shuttle-vector pAM401 (Wirth, R., F. Y. An, et al. (1986). J Bacteriol 165 (3): 831-6). The vector alone does not alter the secretion pattern of GBS 104 (right column) FACS was performed on mid-log fixed bacteria with mouse polyclonal antibodies as indicated at left. Black peak is pre-immune sera, colored peaks are sera from immunized animals.

Example 3

Deletion of GBS 80 Causes Attenuation In Vivo

This example demonstrates that deletion of GBS 80 causes attenuation in vivo, suggesting that this protein contributes to bacterial virulence.

By using a mouse animal model, we studied the role of GBS 80 and GBS 104 in the virulence of *S. agalactiae.*

Groups of ten outbred female mice 5-6 week weeks old (Charles River Laboratories, Calco Italy) were inoculated intraperitoneally with different dilutions of the mutant strains and LD50 (lethal dose 50) were calculated according to the method of Reed and Muench Reed, L. J. and H. Muench (1938). The American Journal of Hygiene 27 (3): 493-7. As presented in the table below the number of colony forming units (cfu) counted for both the Δ80 and the Δ80, Δ104 double mutants is about 10 fold higher when compared to the wild type strain suggesting that inactivation of GBS 80 but not GBS 104 is responsible for an attenuation in virulence. This finding indicates that GBS 80 gene in the AI-1 might contribute to virulence.

Table

Lethal dose 50% analysis of AI-1 mutants in the 2603 strain background. $LD_{50}$s were performed by IP injection of female CD1 mice at an age of 5-6 weeks. $LD_{50}$s were calculated by the method of Reed and Muench (8)

| GBS strain | $LD_{50}$, cfu | Number of Experiments |
|---|---|---|
| Wild Type 2603 | $2 \times 10^8$ | 4 |
| Δ104 mutant | $\sim 2 \times 10^8$ | 1 |
| Δ80 mutant | $2.6 \times 10^9$ | 3 |
| Δ80, Δ104 double mutant | $\sim 2 \times 10^9$ | 1 |

Example 4

Effect of Adhesin Island Sortase Deletions on Surface Antigen Presentation

This example demonstrates the effect of adhesin island sortase deletions on surface antigen presentation.

FACS analysis results set forth in FIG. 9 show that a deletion in sortase SAG0648 prevented GBS 104 from reaching the surface and slightly reduced the surface exposure of GBS 80 (fourth panel; mean shift value .about.60% wild-type COH1). In the double sortase knock-out strain, neither antigen was surface exposed (far right panel). Either sortase alone was sufficient for GBS 80 to arrive at the bacterial surface (third and fourth columns, top). No effect was seen on surface exposure of antigens GBS 80 or GBS 104 in the ΔGBS 52 strain. Antibodies derived from purified GBS 52 were either non-specific or were FACS negative for GBS 52 (data not shown). FACS analysis was performed as described above (see EXAMPLE 2).

As shown in FIG. 10, inactivation of GBS 80 has no effect on GBS 104 expression as much as GBS 104 knock out doesn't change the total amount GBS 80 expressed. The Western blot of whole protein extracts (strains noted above lanes) probed with anti-GBS 80 antisera is shown in panel A. Arrow indicates expected size of GBS 80 (60 kDa). GBS 80 antibodies recognize a doublet, the lower band is not present in ΔGBS 80 strains. Panel B shows a Western blot of whole protein extracts probed with anti-GBS 104 antisera. Arrow indicates expected size of GBS 104 (99.4 kDa). Protein extracts were prepared from the same bacterial cultures used for FACS (FIGS. 8 and 9). In conclusion, although GBS 104 does not arrive at the surface in the Δ80 strain by FACS (FIG. 8, second column), it is present at approximately wild-type levels in the whole protein preps (B, second lane). Approximately 20 μg of each protein extract was loaded per lane.

Western-Blot Analysis

Aliquots of total protein extract mixed with SDS loading buffer (1.times.:60 mM TRIS-HCl pH 6.8, 5% w/v SDS, 10% v/v glycerin, 0.1% Bromophenol Blue, 100 mM DTT) and boiled 5 minutes at 95° C., were loaded on a 12.5% SDS-PAGE precast gel (Biorad). The gel is run using a SDS-PAGE running buffer containing 250 mM TRIS, 2.5 mM Glycine and 0.1% SDs. The gel is electroblotted onto nitrocellulose membrane at 200 mA for 60 minutes. The membrane is blocked for 60 minutes with PBS/0.05% Tween-20 (Sigma), 10% skimmed milk powder and incubated O/N at 4° C. with PBS/0.05% Tween 20, 1% skimmed milk powder, with the appropriate dilution of the sera. After washing twice with PBS/0.05% Tween, the membrane is incubated for 2 hours with peroxidase-conjugated secondary anti-mouse antibody (Amersham) diluted 1:4000. The nitrocellulose is washed three times for 10 minutes with PBS/0.05% Tween and once with PBS and thereafter developed by Opti-4CN Substrate Kit (Biorad).

Example 5

Binding of Adhesin Island Proteins to Epithelial Cells and Effect of Adhesin Island Proteins on Capacity of GBS to Adhere to Epithelial Cells This example illustrates the binding of AI proteins to epithelial cells and the effect of AI proteins on the capacity of GBS to adhere to epithelial cells.

Applicants analysed whether recombinant AI surface proteins GBS 80 or GBS 104 would demonstrate binding to various epithelial cells in a FACS analysis. Applicants also analysed whether deletion of AI surface proteins GBS 80 or GBS 104 would effect the capacity of GBS to adhere to and invade ME180 cervical epithelial cells.

Figure 28:
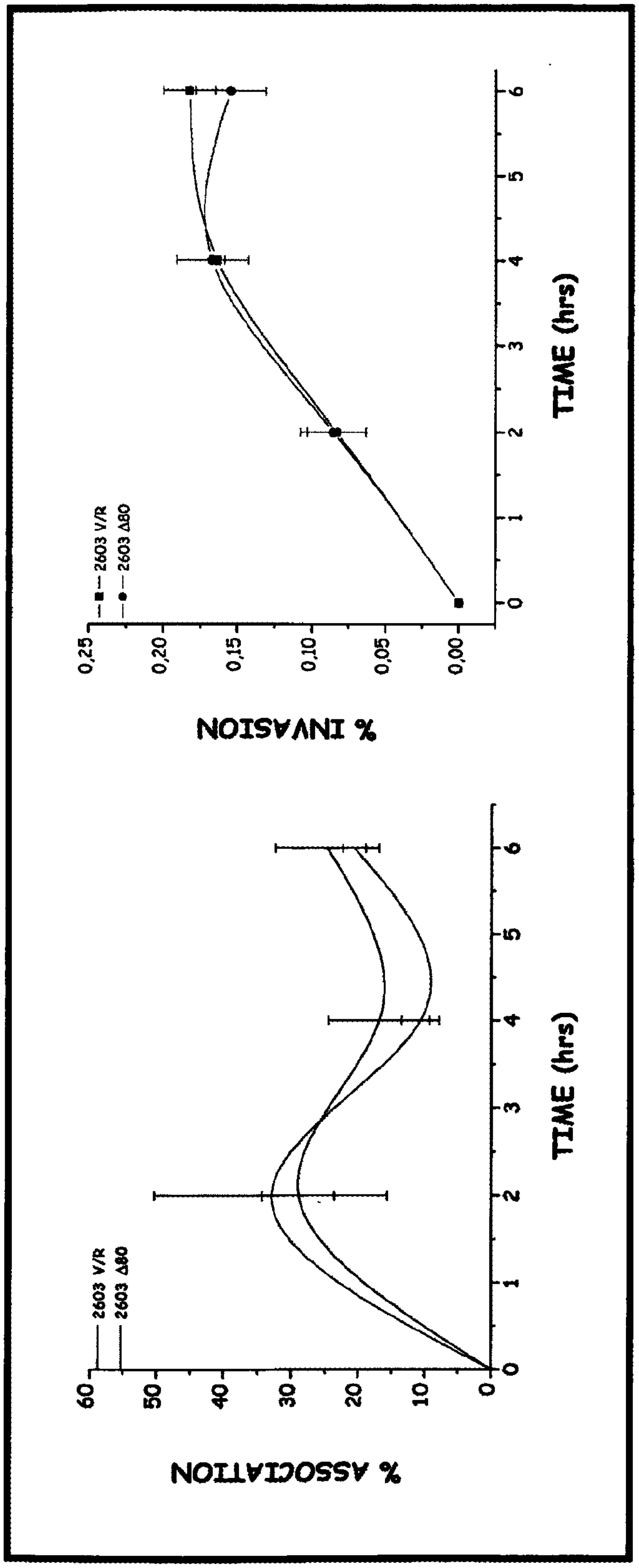
FIG. 28: Illustrates that deletion of GBS 80 does not effect the capacity of GBS strain 2603 V/R to adhere and invade ME180 cervical epithelial cells.

As shown in FIG. 28, deletion of GBS sequence from GBS strain isolate 2603 (serotype V) did not affect the capacity of the mutated GBS to adhere to and invade ME180 cervical epithelial cells. Here ME180 cervical carcinoma epithelial cells were infected with wild type GBS 2603 or GBS 2603 Δ80 isogenic mutant. After two hours of infection, non-adherent bacteria were washed off and infection prolonged for a further two hours and four hours. In invasion experiments, after each time point, was followed by a two hour antibiotic treatment. Cells were then lysed with 1% saponin and lysates platedon TSA plates. As shown in FIG. 28, there was little difference between the percent invasion or percent adhesion of wild type and mutant strains up to the four hour time point.

FIG. 30 repeats this experiment with both Δ104 and Δ80 mutants from a different strain isolate. Here, ME180 cervical carcinoma epithelial cells were infected with GBS strain isolate COH (serotype III) wild type or COH1 ΔGBS 104 or COH1 Δ80 isogenic mutant. After one hour of infection, non-adherent bacteria were washed off and the cells were lysed with 1% saponin. The lysates were plated on TSA plates. As shown in FIG. 30, while there was little difference in the percent invasion, there was a significant decrease in the percent association of the Δ104 mutant compared to both the wild type and Δ80 mutant.

Figure 31:
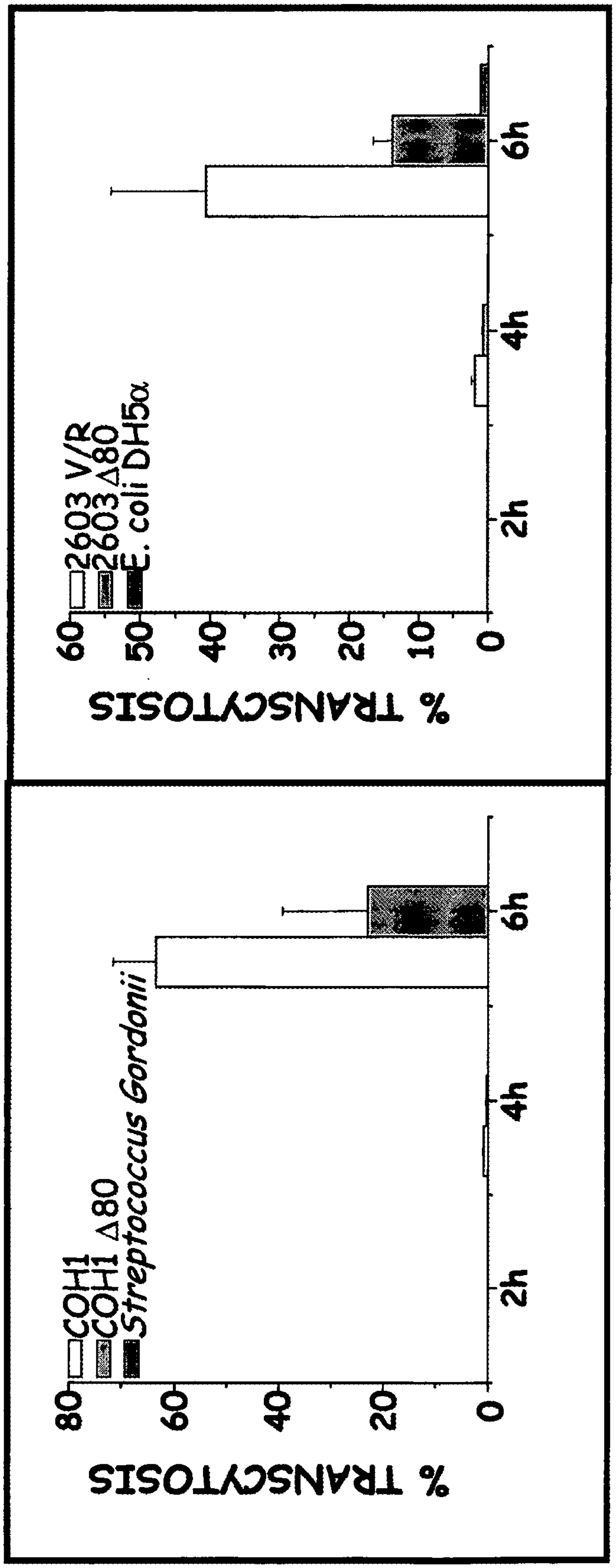
FIG. 31: Illustrates that GBS 80 knockout mutant strain partially loses the ability to translocate through an epithelial cell monolayer.

The affect of AI surface proteins on the ability of GBS to translocate through an epithelial monolayer was also analysed. As shown in FIG. 31, a GBS 80 knockout mutant strain partially loses the ability to translocate through an epithelial monolayer. Here epithelial monolayers were inoculated with wildtype or knockout mutant in the apical chamber of a transwell system for two hours and then non-adherent bacteria were washed off. Infection was prolonged for a further two and four hours. Samples were taken from the media of the basolateral side and the number of colony forming unties measured. Transepithelial electrical resistance measured prior to and after infection gave comparable values, indicating the maintenance of the integrity of the monolayer. By the six hour time point, the Δ80 mutants demonstrated a reduced percent transcytosis.

A similar experiment was conducted with GBS 104 knock out mutants. Here, as shown in FIG. 22, the Δ104 mutants also demonstrated a reduced percent transcytosis, indicating that the mutant strains translocate through an epithelial monolayer less efficiently than their isogenic wild type counterparts.

Figure 32:
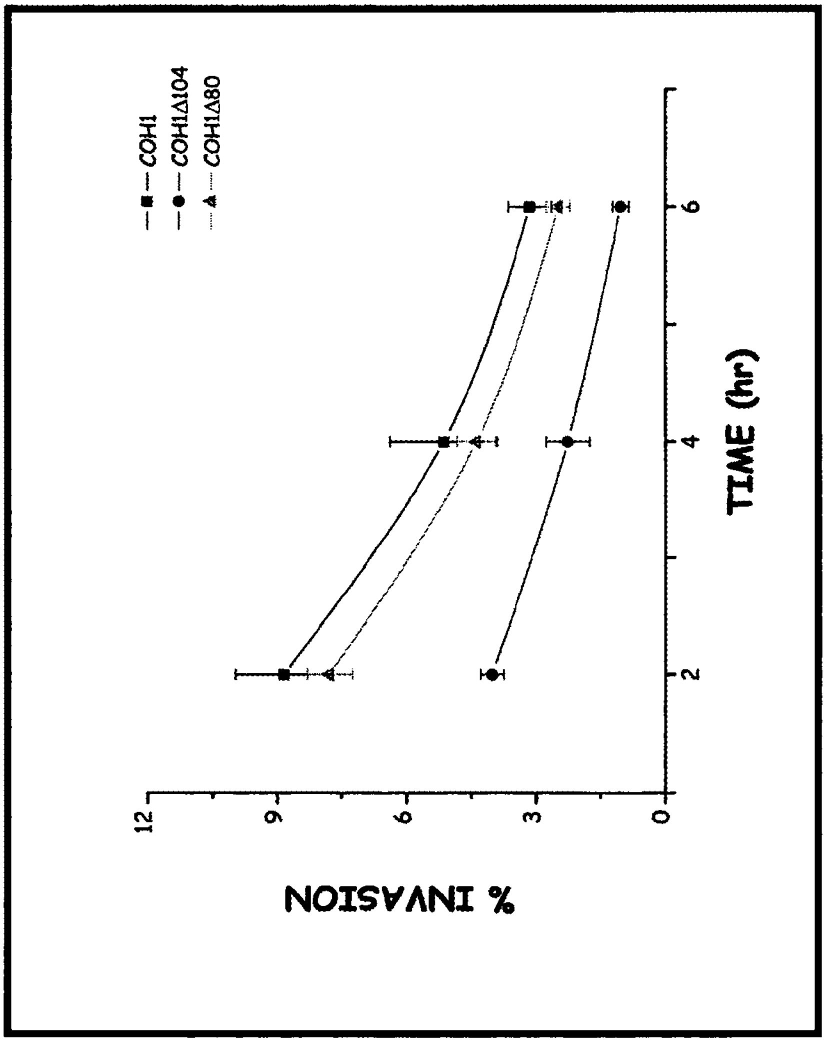
FIG. 32: Illustrates that deletion of GBS 104, but not GBS 80, reduces the capacity of GBS to invade J774 macrophage-like cell line.

Applicants also studied the effect of AI proteins on the capacity of a GBS strain to invade J774 macrophage-like cells. Here, J774 cells were infected with GBS COH1 wild type or COH1 ΔGBS 104 or COH1 ΔGBS80 isogenic mutants. After one hour of infection, non-adherent bacteria were washed off and intracellular bacteria were recovered at two, four and six hours post antibiotic treatment. At each time point, cells were lysed with 0.25% Triton X-100 and lysates plated on TSA plates. As shown in FIG. 32, the Δ104 mutant demonstrated a significantly reduced percent invasion compared to both the wild type and Δ80 mutant.

Example 6

Hyperoligomeric Structures Comprising AI Surface Proteins GBS 80 and GBS 104

Figure 36:
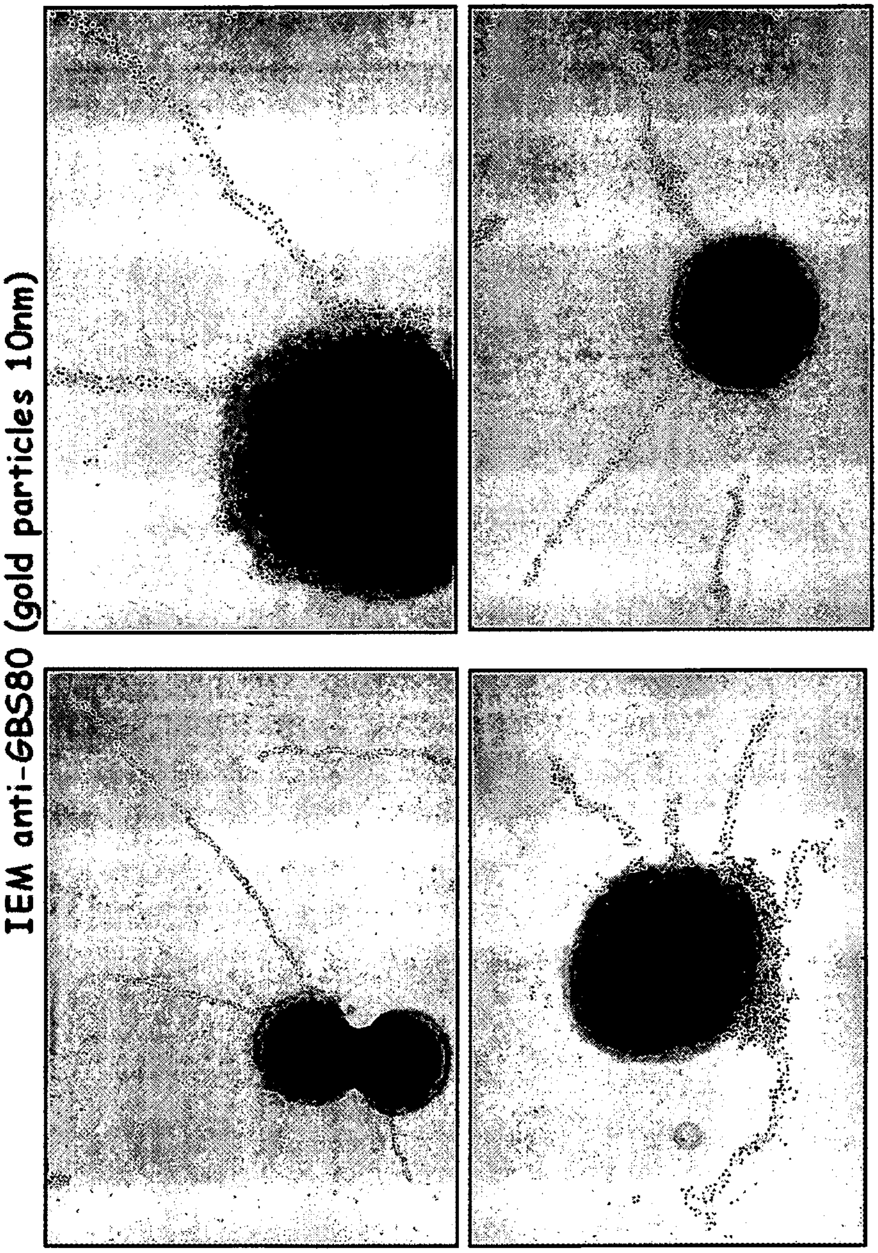
FIG. 36: Electron micrographs of surface exposed pili structures on GBS serotype III, strain isolate COH1, containing a plasmid insert to over-express GBS 80, stained with anti-GBS 80 antibodies (visualized with 10 nm gold particles).
Figure 37:
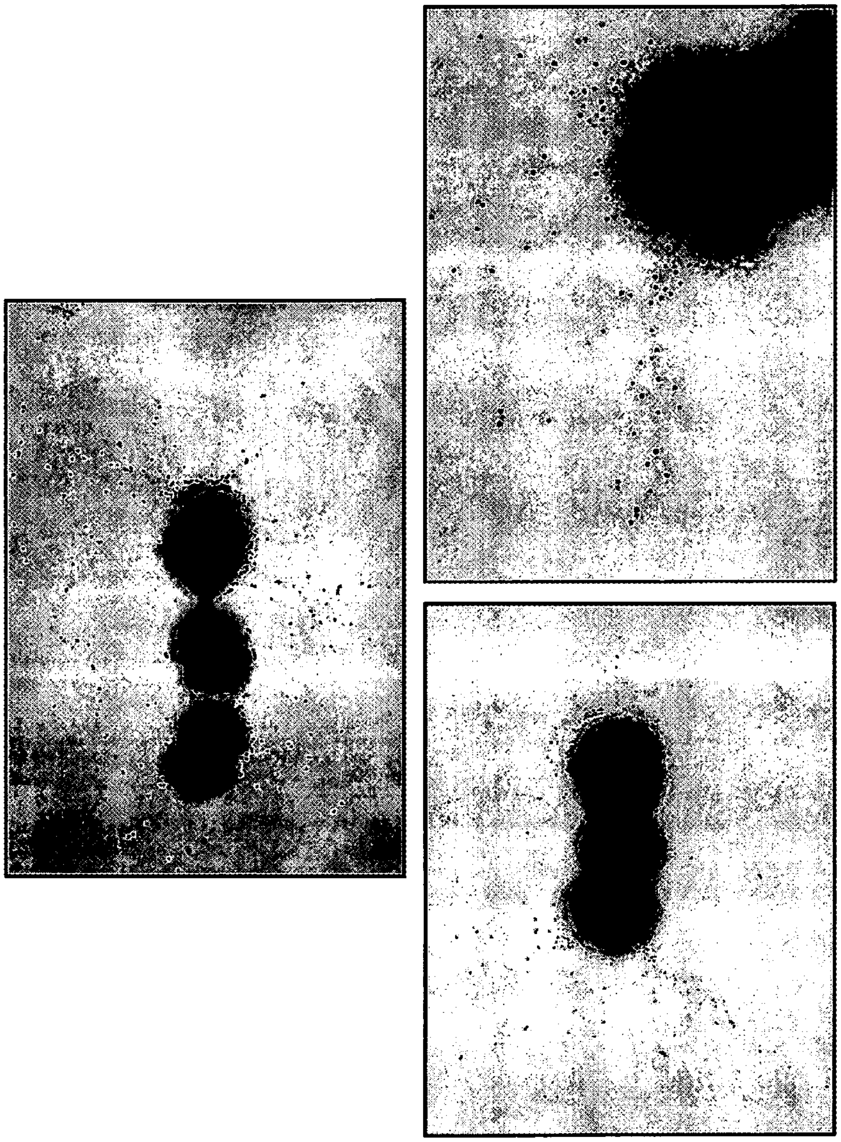
FIG. 37: Electron micrographs of surface exposed pili structures on GBS serotype III, strain isolate COH1, containing a plasmid insert to over-express GBS 80, stained with anti-GBS 80 antibodies (visualized with 20 nm gold particles).
Figure 38:
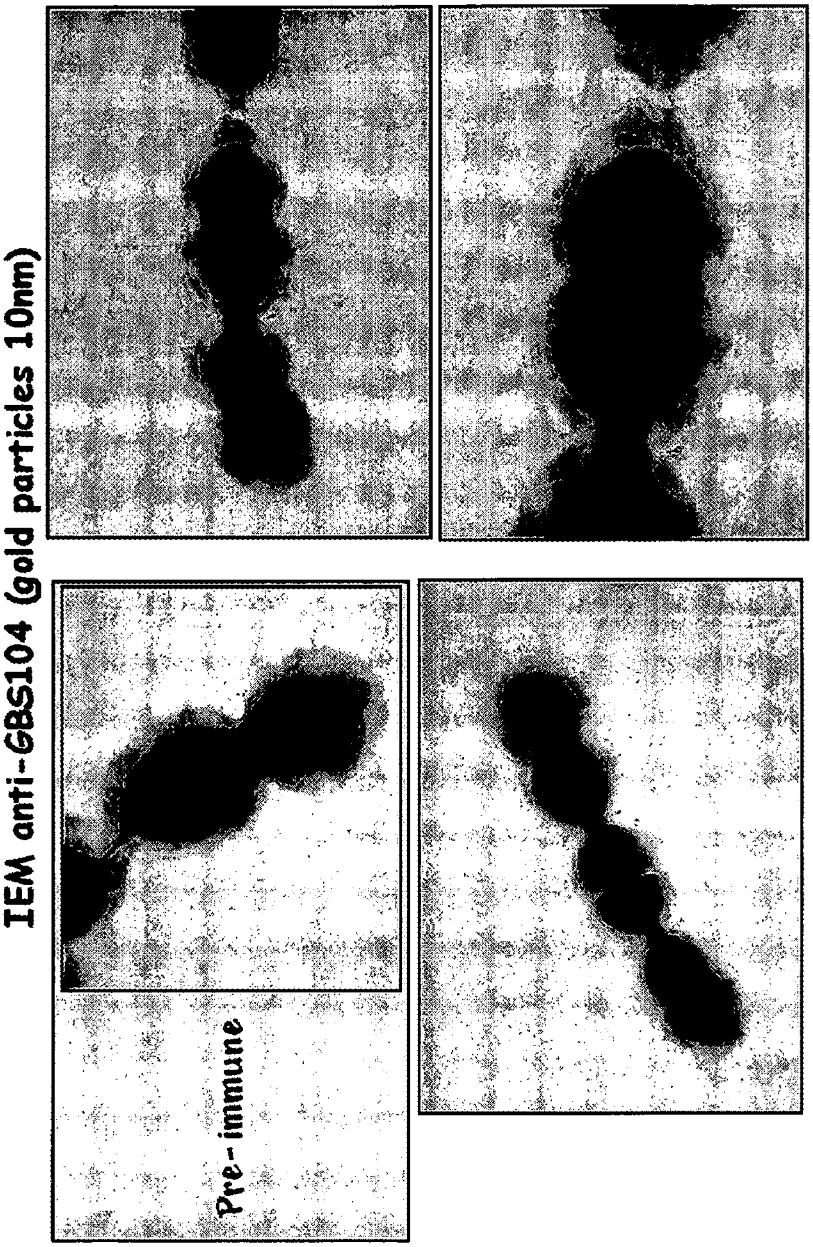
FIG. 38: Electron micrographs of surface exposed pili structures on GBS serotype III, strain isolate COH1, containing a plasmid insert to over-express GBS 80, stained with anti-GBS 104 antibodies or preimmune sera (visualized with 10 nm gold particles).
Figure 39:
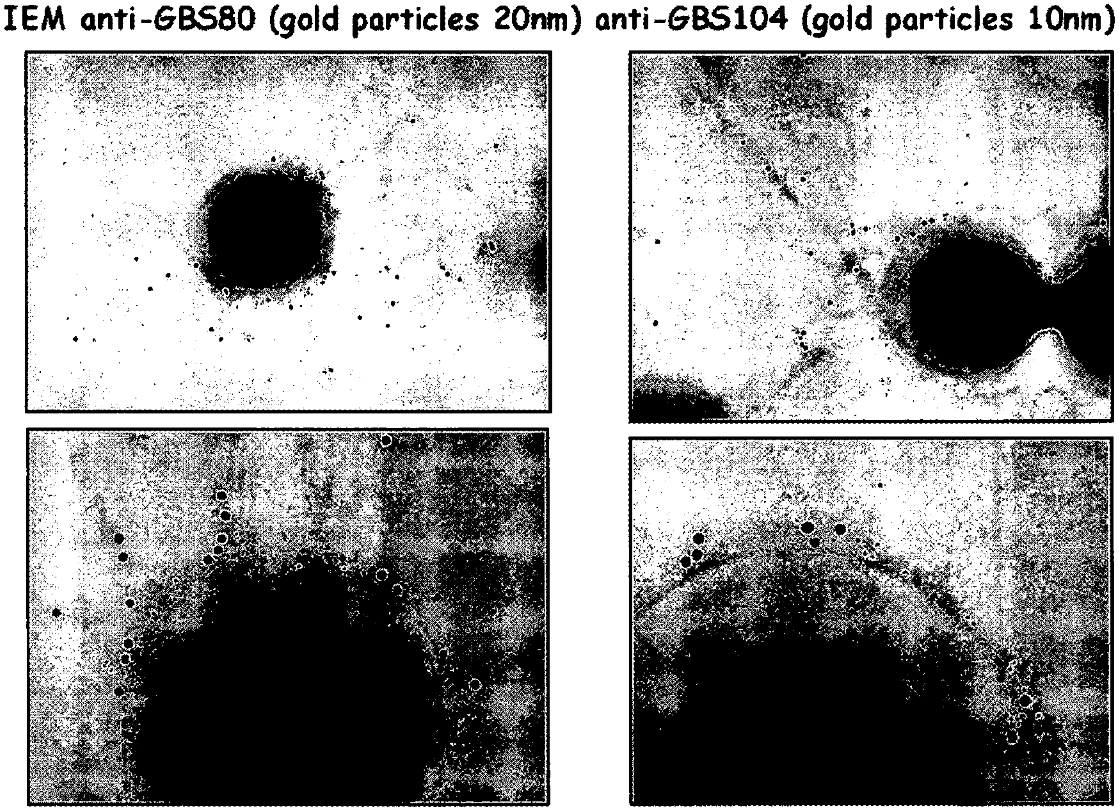
FIG. 39: Electron micrographs of surface exposed pili structures on GBS serotype III, strain isolate COH1, containing a plasmid insert to over-express GBS 80, stained with anti-GBS 80 antibodies (visualized with 20 nm gold particles) and anti-GBS 104 antibodies (visualized with 10 nm gold particles).
Figure 40:
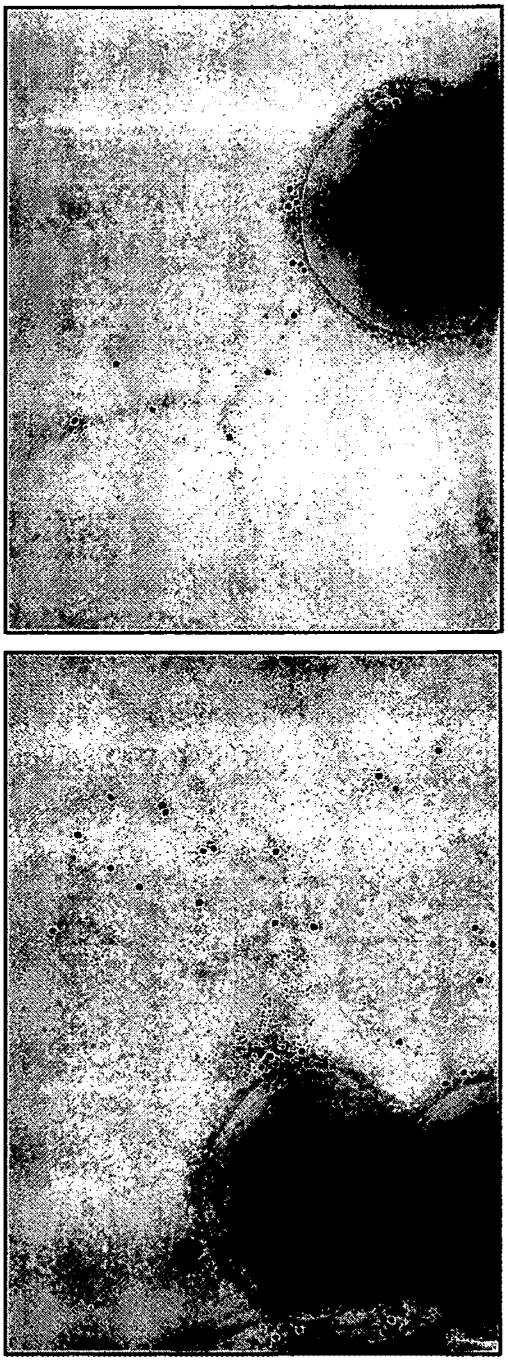
FIG. 40: Electron micrographs of surface exposed pili structures on GBS serotype III, strain isolate COH1, containing a plasmid insert to over-express GBS 80, stained with anti-GBS 80 antibodies (visualized with 20 nm gold particles) and anti-GBS 104 antibodies (visualized with 10 nm gold particles).

This example illustrates hyperoligomeric structures comprising AI surface proteins GBS 80 and GBS 104. A GBS isolate COH1 (serotype III) was adapted to increase expression of GBS 80. FIG. 34 presents a regular negative stain electron micrograph of this mutant; no pilus or hyperoligomeric structures are distinguishable on the surface of the bacteria. When the EM stain is based on anti-GBS 80 antibodies labelled with 10 or 20 nm gold particles, the presence of GBS 80 throughout the hyperoligomeric structure is clearly indicated (FIGS. 36, 37 and 38). EM staining against GBS 104 (anti-GBS 104 antibodies labelled with 10 nm gold particles) also reveals the presence of GBS 104 primarily on or near the surface of the bacteria or potentially associated with bacterial peptidoglycans (FIG. 39). Analysis of this same strain (over-expressing GBS 80) with a combination of both anti-GBS 80 (using 20 nm gold particles) and anti-GBS 104 (using 10 nm gold particles) reveals the presence of GBS 104 on the surface and within the hyperoligomeric structures (see FIGS. 40 and 41).

Example 7

Figure 41:
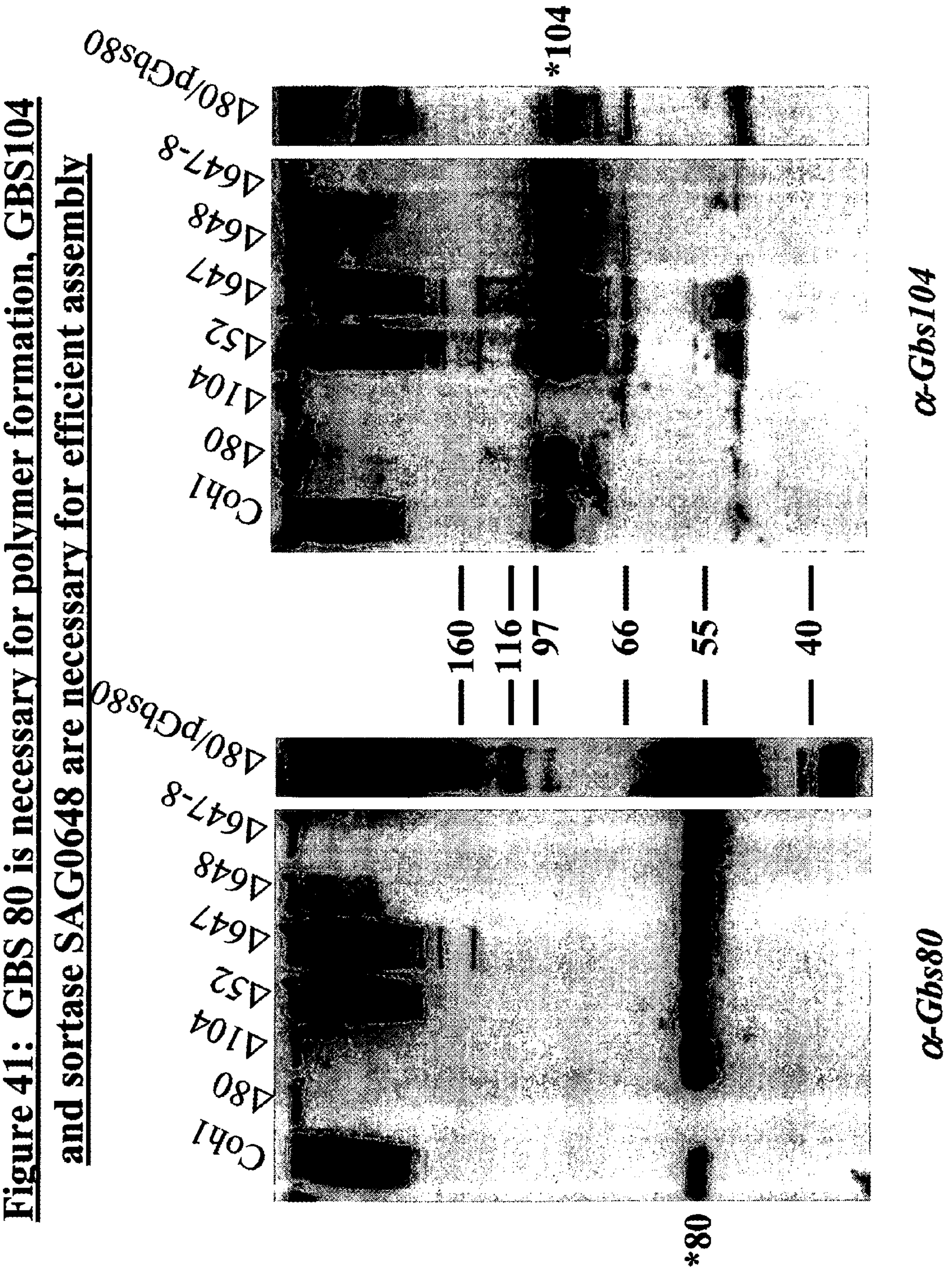
FIG. 41: Illustrates that GBS 80 is necessary for polymer formation and GBS104 and sortase SAG0648 are necessary for efficient assembly of pili.

GBS 80 is Necessary for Polymer Formation and GBS 104 and Sortase SAG0648 are Necessary for Efficient Pili Assembly This example demonstrates that GBS 80 is necessary for formation of polymers and that GBS 104 and sortase SAG0648 are necessary for efficient pili assembly. GBS 80 and GBS 104 polymeric assembly was systematically analyzed in Coh1 strain single knock out mutants of each of the relevant coding genes in AI-1 (GBS 80, GBS 104, GBS 52, sag0647, and sag0648). FIG. 41 provides Western blots of total protein extracts (strains noted above lanes) probed with either anti-GBS 80 (left panel) sera or anti-GBS 104 sera (right panel) for each of these Coh1 and Coh1 knock out strains. (Coh1, wild type Coh1; 480, Coh1 with GBS 80 knocked out; Δ104, Coh1 with GBS 104 knocked out; Δ52, Coh1 with GBS 52 knocked out; A647, Coh1 with SAG0647 knocked out; A648, Coh1 with SAG0648 knocked out, A647-8, Coh1 with SAG0647 and SAG0648 knocked out; Δ80/pGBS80, Coh1 with GBS 80 knocked out but complemented with a high copy number plasmid expressing GBS 80. Asterisks identify the monomer of GBS 80 and GBS 104.)

The smear of immunoreactive material observed in the wild type strain, along with its disappearance in Δ80 and Δ104 mutants, is consistent with the notion that such high molecular weight structures are composed of covalently linked (SDS-resistant) GBS 80 and GBS 104 subunits. The immunoblotting with both anti-GBS 80 (α-GBS 80) and anti-GBS 104 (α-GBS 104) revealed that deletion of sortase SAG0648 also interferes with the assembly of high molecular weight species, whereas the knock out mutant of the second sortase (SAG0647), even if somehow reduced, still maintains the ability to form polymeric structures.

Total extracts form GBS were prepared as follows. Bacteria were grown in 50 ml of Todd-Hewitt broth (Difco) to an $OD_{600}$ nm of 0.5-0.6 and successively pelleted. After two washes in PBS the pellet was resuspended and incubated 3 hours at 37° C. with mutanolisin. Cells were then lysed with at least three freezing-thawing cycles in dry ice and a 37° C. bath. The lysate was then centrifuged to eliminate the cellular debris and the supernatant was quantified. Approximately 40 mg of each protein extract was separated on SDS-PAGE. The gel was then subjected to immunoblotting with mice antisera and detected with chemiluminescence.

Example 8

GBS 80 is Polymerized by an AI-2 Sortase

Figure 42:
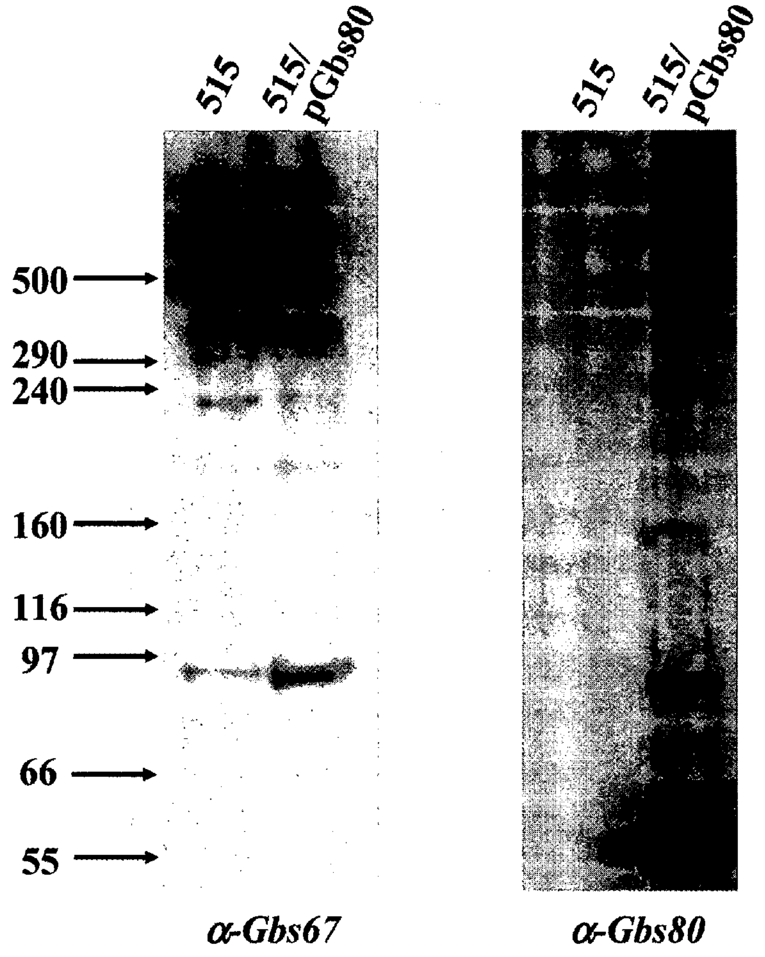
FIG. 42: Illustrates that GBS 67 is part of a second pilus and that GBS 80 is polymerized in strain 515.

This example illustrates that GBS 80 can be polymerized not only by AI-1 sortases, but also by AI-2 sortases. FIG. 42 shows total cell extract immunoblots of GBS 515 strain, which lacks AI-1. The left panel, where an anti-GBS 67 sera was used, shows that GBS 67 from AI-2 is assembled into high-molecular weight-complexes, suggesting the formation of a second type of pilus. The same high molecular structure is observed when GBS 80 is highly expressed by reintroducing the gene within a plasmid (pGBS 80). By using anti-GBS 80 (right panel) sera on the same extracts, again it is observed that, with GBS 80 over expression (515/pGBS 80), a high-molecular weight structure is assembled. This implies that, in the absence of AI-1 sortases, AI-2 sortases (SAG1405 and SAG1406) can complement the lacking function, still being able to assemble GBS 80 in a pilus structure.

Example 9

Coh1 Produces a High Molecular Weight Molecule, the GBS 80 Pilin

Figure 43:
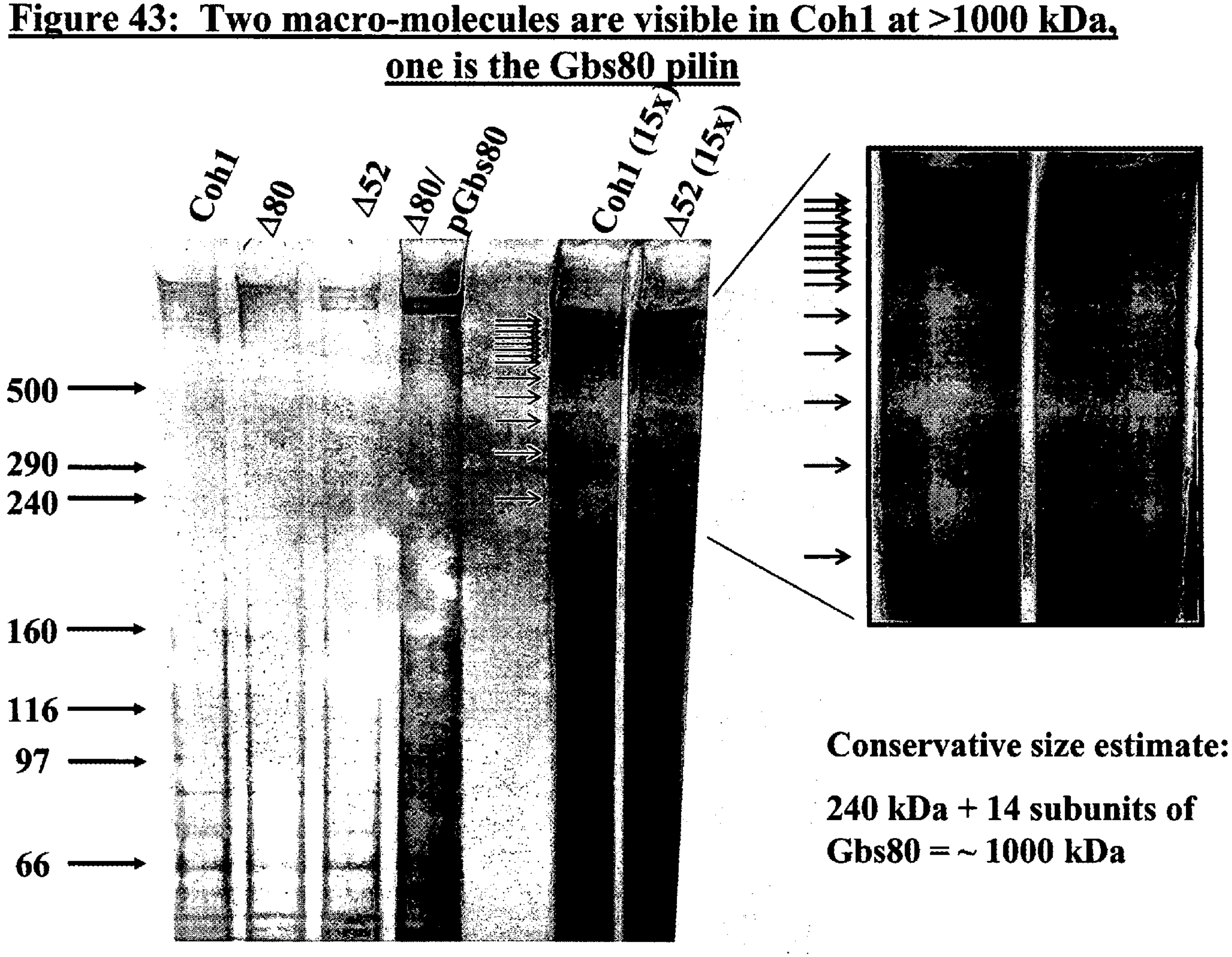
FIG. 43: Illustrates that two macro-molecules are visible in Coh1, one of which is the GBS 80 pilin.

This example illustrates that Coh1 produces a high molecular weight molecule, greater than 1000 kDa, which is the GBS 80 pilin. FIG. 43 provides silver-stained electrophoretic gels that show that Coh1 produces two macromolecules. One of these macromolecules disappears in the Coh1 GBS 80 knock out cells, but does not disappear in the Coh1 GBS 52 knock out mutant cells. The last two lanes on the right were loaded with 15 times the amount loaded in the other lanes. This was done in order to be able to count the bands. By doing this, a conservative size estimate of the top bands was calculated by starting at 240 kDa and considering each of 14 higher bands as the result of consecutive additions of a GBS 80 monomer.

Coh1, wild type Coh1; Δ80, Coh1 cells with GBS 80 knocked out; Δ52, Coh1 cells with GBS 52 knocked out; Δ80/pGBS 80, Coh1 cells with GBS 80 knocked out and complemented with a high copy number construct expressing GBS 80.

Example 10

GBS 52 is a Minor Component of the GBS Pilus

Figure 45:
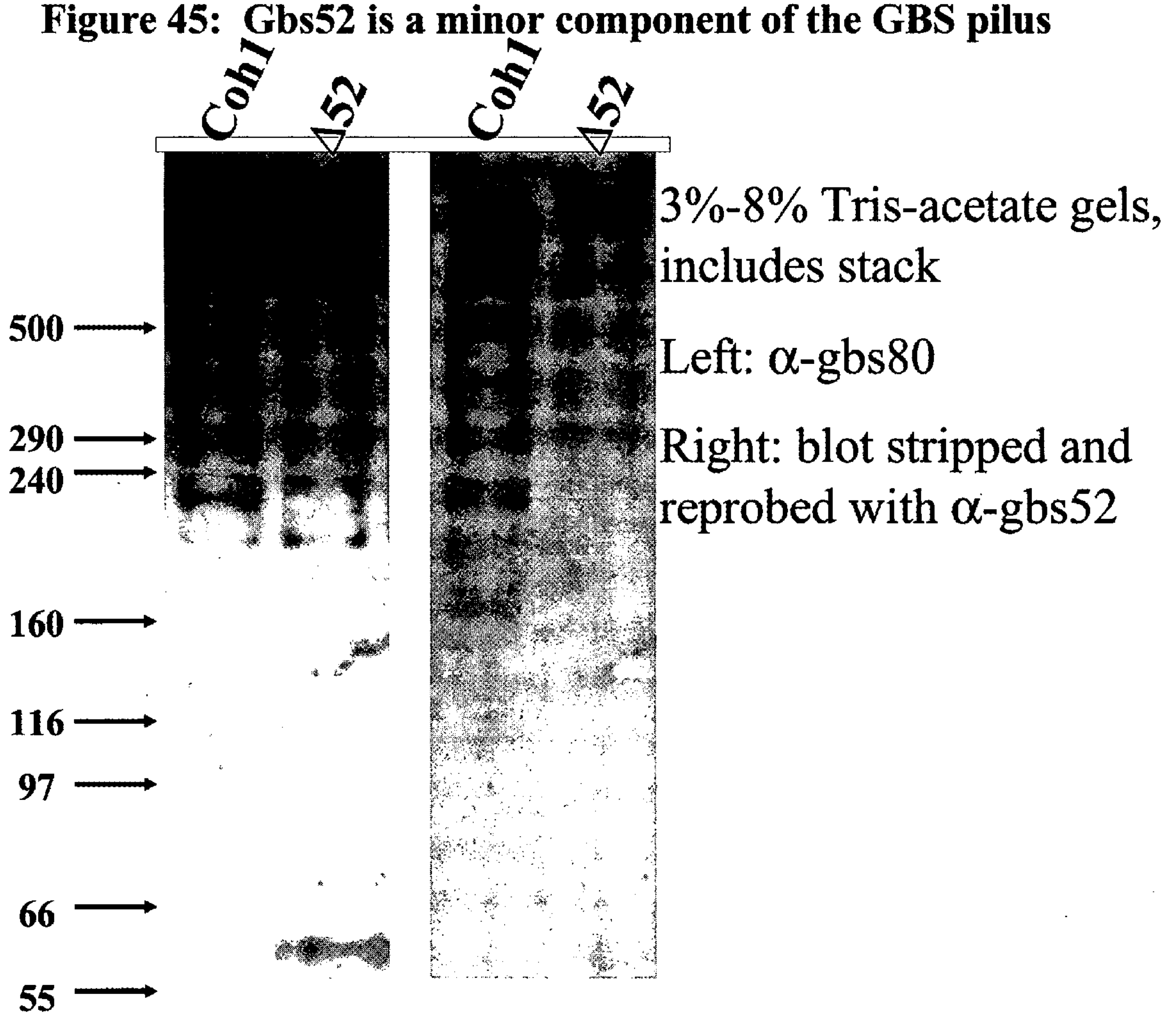
FIG. 45: Illustrates that GBS 52 is a minor component of the GBS pilus.

This example illustrates that GBS 52 is present in the GBS pilus and is a minor component of the pilus. FIG. 45 shows an immunoblot of total cell extracts from a GBS Coh1 strain and a GBS Coh1 strain knocked out for GBS 52 (Δ52). The total cell extracts were immunoblotted anti-GBS 80 antisera (left) and anti-GBS 52 antisera (right) Immunoblotting was performed using a 3-8% Tris-acetate polyacrylamide gel (Invitrogen) which provided excellent separation of large molecular weight proteins (see FIG. 41). When the gel was incubated with anti-GBS 80 sera, the bands from the Coh1 wild-type strain appeared shifted when compared to the Δ52 mutant. This observation indicated a different size of the pilus polymeric components in the two strains. When the same gel was stripped and incubated with anti-GBS 52 sera the high-molecular subunits in the Coh1 wild-type strain showed similar molecular size of those in the correspondent lane in the left panel. These findings confirmed that GBS 52 is indeed associated with GBS 80 macro-molecular structures but represents a minor component of the GBS pilus.

Example 11

Pilus Structures are Present in the Supernatant of GBS Bacterial Cultures

Figure 46:
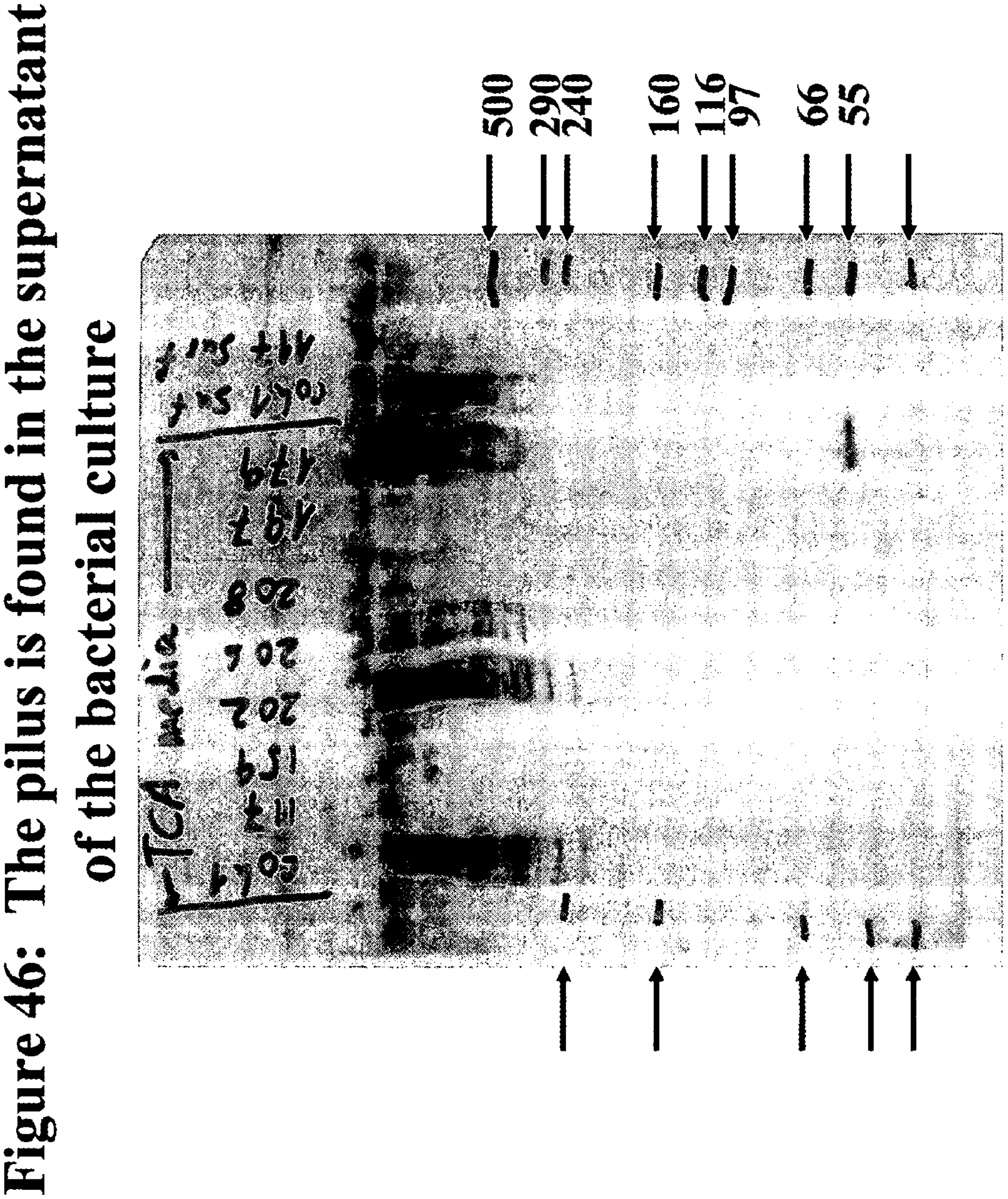
FIG. 46: Illustrates that the pilus is found in the supernatant of a bacterial culture.

This example illustrates that the pilus structure assembled in Coh1 GBS is present in the supernatant of a bacterial cell culture. FIG. 46 shows an immunoblot where the protein extract of the supernatant from cultures of different GBS mutant strains (117=Coh1 GBS 80 knockout; 159=Coh1 GBS 104 knockout; 202=Coh1 GBS 52 knockout; 206=Coh1 GBS sag0647 knockout; 208=Coh1 GBS sag0648 knockout; 197=Coh1 GBS sag0647/sag0648 knockout; 179=Coh1 GBS 80 knockout complemented with a high copy plasmid expressing GBS 80). GBS 80 antisera detects the presence of pilus structures in the appropriate Coh1 strains.

The protein extract was prepared as follows. Bacteria were grown in THB to an $OD_{600}$ nm of 0.5-0.6 and the supernatant was separated from the cells by centrifugation. The supernatant was then filtered (527 0.2 μm) and 1 ml was added with 60% TCA for protein precipitation.

GBS pili were also extracted from the fraction of surface-exposed proteins in Coh1 strain and its GBS 80 knock out mutant as described hereafter. Bacteria were grown to an $OD_{600}$ nm of 0.6 in 50 ml of THB at 37° C. Cells were washed once with PBS and the pellet was then resuspended in 0.1 M KPO4 pH 6.2, 40% sucrose, 10 mM MgCl2, 400 U/ml mutanolysin and incubated 3 hours at 37° C. Protoplasts were separated by centrifugation and the supernatant was recovered and its protein content measured.

Figure 47:
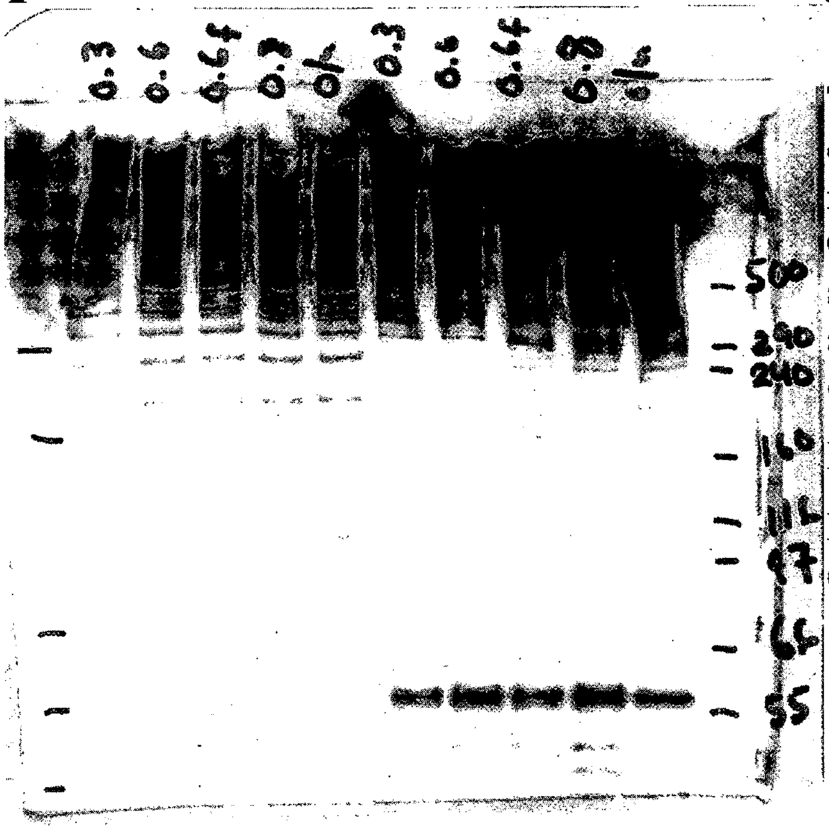
FIG. 47: Illustrates that the pilus is found in the supernatant of bacterial cultures in all phases.

In order to study the dynamics of pilus production during different growth phases, 1 ml supernatant of a culture at different $OD_{600}$ nm was TCA precipitated and loaded onto a 3-8% SDS-PAGE as described before. FIG. 47 shows the corresponding Western blot with GBS 80 anti-sera. The first group of lanes (left five sample lanes) refer to a Coh1 strain growth ($OD_{600}$ nm are noted above the lanes) whereas the second group of lanes (right five samples) are from a GBS 80 knock out strain over expressing GBS 80. The experiment shows that pilus macromolecular structures can be found in the supernatant in all of the growth phases tested.

Example 12

Figure 48:
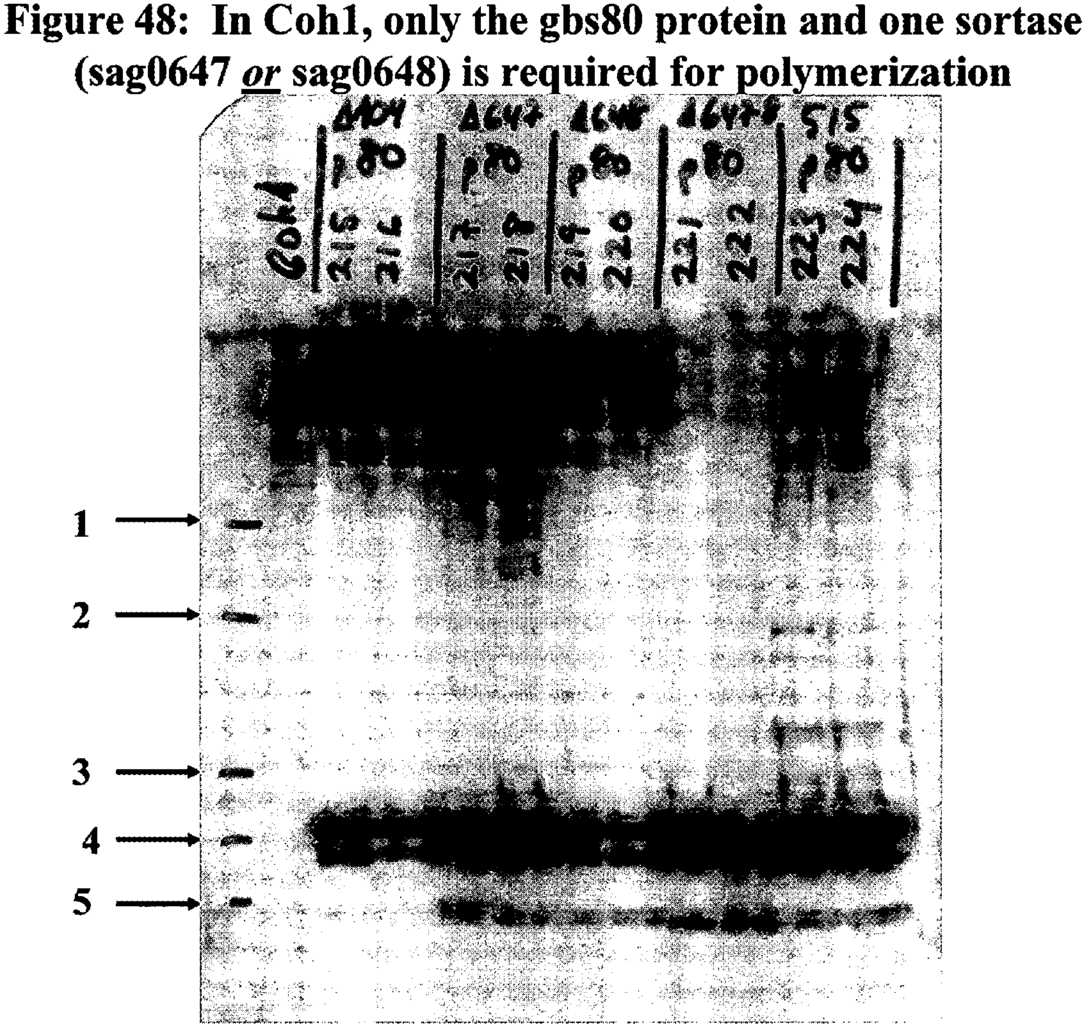
FIG. 48: Illustrates that in Coh1, only the GBS 80 protein and one sortase (sag0647 or sag0648) is required for polymerization.

In GBS Strain Coh1, only GBS 80 and a Sortase (sag0647 or sag0648) is Required for Polymerization This example describes requirements for pilus formation in Coh1. FIG. 48 shows a Western blot of total protein extracts (prepared as described before) using anti-GBS 80 sera on Coh1 clones. (Coh1, wild type Coh1; Δ104, Coh1 knocked out for GBS 104, Δ647, Coh1 knocked out for sag0647, Δ648, Coh1 knocked for sag0648, Δ647-8, Coh1 knocked out for sag0647 and sag0648; 515, wild type bacterial strain 515, which lacks an AI-1; p80 a high copy number plasmid which expresses GBS 80.) The data show that only the double sortase mutant is unable to polymerize GBS 80 indicating that the 'conditio sine qua non' for pilus polymerization is the co-existence of GBS 80 with at least one sortase. This result leads to a reasonable assumption that SAG1405 and SAG1406 are responsible for polymerization in this strain.

Example 13

GBS 80 can be Expressed in *L. lactis* Under its Own Promoter and Terminator Sequences This example demonstrates that *L. lactis*, a non-pathogenic bacterium, can express GBS AI polypeptides such as GBS 80. *L. lactis* M1363 (J. Bacteriol. 154 (1983):1-9) was transformed with a construct encoding GBS 80. Briefly, the construct was prepared by cloning a DNA fragment containing the gene coding for GBS 80 under its own promoter and terminator sequences into plasmid pAM401 (a shuttle vector for *E. coli* and other Gram positive bacteria; J. Bacteriol. 163 (1986):831-836). Total extracts of the transformed bacteria in log phase were separated on SDS-PAGE, transferred to membranes, and incubated with antiserum against GBS 80. A polypeptide corresponding to the molecular weight of GBS 80 was detected in the lanes containing total extracts of *L. lactis* transformed with the GBS 80 construct. See FIGS.

133A and 133B, lanes 6 and 7. This same polypeptide was not detected in the lane containing total extracts of *L. lactis* not transformed with the GBS 80 construct, lane 9. This example shows that *L. lactis* can express GBS 80 under its own promoter and terminator.

Example 14

*L. lactis* Modified to Express GBS AI-1 Under the GBS 80 Promoter and Terminator Sequences Expresses GBS 80 in Polymeric Structures This example demonstrates the ability of *L. lactis* to express GBS AI-1 polypeptides and to incorporate at least some of the polypeptides into oligomers. *L. lactis* was transformed with a construct containing the genes encoding GBS AI-1 polypeptides. Briefly, the construct was prepared by cloning a DNA fragment containing the genes for GBS 80, GBS 52, SAG0647, SAG0648, and GBS 104 under the GBS 80 promoter and terminator sequences into construct pAM401. The construct was transformed into *L. lactis* M1363. Total extracts of log phase transformed bacteria were separated on reducing SDS-PAGE, transferred to membranes, and incubated with antiserum against GBS 80. A polypeptide with a molecular weight corresponding to the molecular weight of GBS 80 was detected in the lanes containing *L. lactis* transformed with the GBS AI-1 encoding construct. See FIG. 134, lane 2. In addition, the same lane also showed immunoreactivity of polypeptides having higher molecular weights than the polypeptide having the molecular weight of GBS 80. These higher molecular weight polypeptides are likely oligomers of GBS 80. Oligomers of similar molecular weights were also observed on a Western blot of the culture supernatant of the transformed *L. lactis*. See lane 4 of FIG. 135. Thus, this example shows that *L. lactis* transformed to express GBS AI-1 can efficiently polymerize GBS 80 in the form of a pilus. This pilus structure can likely be purified from either the cell culture supernatant or cell extracts.

Example 15

Cloning and Expression of *S. pneumoniae* Sp0462

This example describes the production of a clone encoding a Sp0462 polypeptide and expression of the clone. To produce a clone encoding Sp0462, the open reading frame encoding Sp0462 was amplified using primers that annealed within the full-length Sp0462 open reading frame sequence. FIG. 150A provides a 893 amino acid sequence of Sp0462. The primers used to produce a clone encoding the Sp0462 polypeptide are shown in FIG. 150B. These primers annealed to the nucleotide sequences encoding the amino acid residues indicated by underlining in FIG. 150A. Amplification of the open reading frame encoding Sp0462 using these primers produced the amplicon shown at lane 2 of the agarose gel provided in FIG. 160. The Sp0462 clone encodes amino acid residues 38-862 of the 893 amino acid residue Sp0462 protein; the italicized residues in FIG. 150A were eliminated. FIG. 151A provides a schematic depiction of the recombinant Sp0462 polypeptide. FIG. 151B shows a schematic depiction of the full-length Sp0462 polypeptide. Both the recombinant Sp0462 encoded by the clone and the full-length Sp0462 protein have two collagen binding protein type B (Cna B) domains and a von Hillebrand factor A (vWA) domain. The cloned recombinant Sp0462 lacks the LPXTG motif present in the full-length Sp0462 protein. Western blot analysis for expression of the Sp0462 clone did not result in detection of polypeptides with serum obtained from *S. pneumoniae*-infected patients (FIG. 152A) or GBS 80 antiserum (FIG. 152B).

Example 16

Cloning and Expression of *S. pneumoniae* Sp0463

This example describes the production of a clone encoding a Sp0463 polypeptide and detection of recombinant Sp0463 polypeptide expressed from the clone. To produce a clone encoding Sp0463, the open reading frame encoding Sp0463 was amplified using primers that annealed within the full-length Sp0463 open reading frame sequence. FIG. 153A provides a 665 amino acid sequence of Sp0463. The primers used to produce the clone encoding Sp0463 polypeptide are shown in FIG. 153B. These primers annealed to the nucleotide sequences encoding the amino acid residues indicated by underlining in FIG. 153A. Amplification of the open reading frame encoding Sp0463 using these primers produced the amplicon shown at lane 3 of the agarose gel provided in FIG. 160. The Sp0463 clone encodes amino acid residues 23-627 of the 665 amino acid residue Sp0463 protein; the italicized residues in FIG. 153A were eliminated. FIG. 154A provides a schematic depiction of the recombinant Sp0463 polypeptide. FIG. 154B shows a schematic depiction of the full-length Sp0463 polypeptide. Both the recombinant Sp0463 encoded by the clone and the full-length Sp0463 protein have a Cna B domain and an E box motif. The cloned recombinant Sp0463 lacks the LPXTG motif present in the full-length Sp0463 protein. Expression of the Sp0463 clone resulted in the detection of a 60 kD polypeptide, the expected molecular weight of the recombinant Sp0463 polypeptide, by Western blot analysis. See FIG. 155.

Example 17

Cloning and Expression of *S. pneumoniae* Sp0464

0 This example describes the production of a clone encoding a Sp0464 polypeptide and detection of recombinant Sp0464 polypeptide expressed from the clone. To produce a clone encoding Sp0464, the open reading frame encoding Sp0464 was amplified using primers that annealed either within the full-length Sp0464 open reading frame sequence. FIG. 157A provides a 393 amino acid sequence of Sp0464. The primers used to produce a clone encoding the Sp0464 polypeptide are shown in FIG. 157B. These primers annealed to the nucleotide sequences encoding the amino acid residues indicated by underlining in FIG. 157A. Amplification of the open reading frame encoding Sp0464 using these primers produced the amplicon shown at lane 4 of the agarose gel provided in FIG. 160. The Sp0464 clone encodes amino acid residues 19-356 of the 393 amino acid residue Sp0464 protein; the italicized residues in FIG. 157A were eliminated. FIG. 158A provides a schematic depiction of the recombinant Sp0464 polypeptide. FIG. 158B shows a schematic depiction of the full-length Sp0464 polypeptide. Both the recombinant Sp0464 encoded by the clone and the full-length Sp0464 protein have two Cna B domains. The cloned recombinant Sp0464 lacks the LPXTG motif present in the full-length Sp0464 protein. Expression of the Sp0464 clone resulted in the detection of a 38 kD polypeptide, the expected molecular weight of the recombinant Sp0464 polypeptide, by Western blot analysis. See FIG. 159.

Example 18

Intranasal Immunization of Mice with Recombinant *L. lactis* Expressing GBS 80 and Subsequent Challenge 1 This example describes a method of intranasally immunizing mice using *L. lactis* that express GBS 80. Intranasal immunization consisted of 3 doses at days 0, 14 and 28, each dose administered in three consecutive days. Each day, groups of 3 CD-1 outbred female mice 6-7 weeks old (Charles River Laboratories, Calco Italy) were immunized intranasally with $10^9$ or $10^10$ CFU of the recombinant *Lactococcus* lactis suspended in 20 µl of PBs. In each immunization scheme negative (wild-type *L. lactis*) and positive (recombinant GBS80) control groups were used. The immune response of the dams was monitored by using serum samples taken on day 0 and 49. The female mice were bred 2-7 days after the last immunization (at approximately t=36-37), and typically had a gestation period of 21 days. Within 48 hours of birth, the pups were challenged via I.P. with GBS in a dose approximately equal to an amount which would be sufficient to kill 90% of immunized pups (as determined by empirical data gathered from PBS control groups). The GBS challenge dose is preferably administered in 50 ml of THB medium. Preferably, the pup challenge takes place at 56 to 61 days after the first immunization. The challenge inocula were prepared starting from frozen cultures diluted to the appropriate concentration with THB prior to use. Survival of pups was monitored for 5 days after challenge.

Example 19

Subcutaneous Immunization of Mice with Recombinant *L. lactis* Expressing GBS 80 and Subsequent Challenge This example describes a method of subcutaneous immunization mice using *L. lactis* that express GBS 80. Subcutaneous immunization consists of 3 doses at days 0, 14 and 28. Groups of 3 CD-1 outbred female mice 6-7 weeks old (Charles River Laboratories, Calco Italy) were injected subcutaneously with $10^9$ or $10^10$ CFU of the recombinant *Lactococcus* lactis suspended in 100 µl of PBs. In each immunization scheme, negative (wild-type *L. lactis*) and positive (recombinant GBS80) control groups were used. The immune response of the dams was monitored by using serum samples taken on day 0 and 49. The female mice were bred 2-7 days after the last immunization (at approximately t=36-37), and typically had a gestation period of 21 days. Within 48 hours of birth, the pups were challenged via I.P. with GBS in a dose approximately equal to an amount which would be sufficient to kill 90% of immunized pups (as determined by empirical data gathered from PBS control groups). The GBS challenge dose is preferably administered in 50 ml of THB medium. Preferably, the pup challenge takes place at 56 to 61 days after the first immunization. The challenge inocula were prepared starting from frozen cultures diluted to the appropriate concentration with THB prior to use. Survival of pups was monitored for 5 days after challenge.

Example 20

Immunization of Mice with GAS AI Polypeptides and Subsequent Intranasal Challenge This example describes a method of immunizing mice with GAS AI polypeptides and subsequently intranasally challenging the mice with GAS bacteria. Groups of 10 CD 1 female mice aged between 6 and 7 weeks are immunized with a combination of GAS antigens of the invention GAS 15, GAS 16, and GAS 18, (15 mg of each recombinant antigen, derived from M1 strain SF370) or *L. lactis* expressing the M1 strain SF370 adhesin island, suspended in 100 µl of suitable solution. Each group receives 3 doses at days 0, 21 and 45. Immunization is performed through subcutaneous or intraperitoneal injection for the GAS 15, GAS 16, GAS 18 protein combination. The protein combination is administered with an equal volume of Complete Freund's Adjuvant (CFA) for the first dose and Incomplete Freund's Adjuvant (IFA) for the following two doses. Immunization is performed intranasally for the *L. lactis* expressing the M1 strain SF370 adhesin island. In each immunization scheme negative and positive control groups are used.

The negative control group for the mice immunized with the GAS 15, GAS 16, GAS 18 protein combination included mice immunized with PBs. The negative control group for the mice immunized with *L. lactis* expressing the M1 strain SF370 adhesin island, included mice immunized with either wildtype *L. lactis* or *L. lactis* transformed with the pAM401 expression vector lacking any cloned adhesin island sequence.

The positive control groups included mice immunized with purified M1 strain SF370 M protein.

Immunized mice are then anaesthetized with Zoletil and challenged intranasally with a 25 µL suspension containing 1.2.times.$10^6$ or 1.2.times.$10^8$ CFU of ISS 3348 in THB. Animals are observed daily and checked for survival.

Example 21

Active Maternal Immunization Assay

As used herein, an Active Maternal Immunization assay refers to an in vivo protection assay where female mice are immunized with the test antigen composition. The female mice are then bred and their pups are challenged with a lethal dose of GBs. Serum titers of the female mice during the immunization schedule are measured as well as the survival time of the pups after challenge.

Mouse Immunization

Specifically, groups of 4 CD-1 outbred female mice 6-8 weeks old (Charles River Laboratories, Calco Italy) are immunized with one or more GBS antigens, (20 ng of each recombinant GBS antigen), suspended in 100 µl of PBs. Each group receives 3 doses at days 0, 21 and 35. Immunization is performed through intra-peritoneal injection of the protein with an equal volume of Complete Freund's Adjuvant (CFA) for the first dose and Incomplete Freund's Adjuvant (IFA) for the following two doses. In each immunization scheme negative and positive control groups are used.

Immune response is monitored by using serum samples taken on day 0 and 49. The sera are analyzed as pools from each group of mice.

Active Maternal Immunization

A maternal immunization/neonatal pup challenge model of GBS infection was used to verify the protective efficacy of the antigens in mice. The mouse protection study was adapted from Rodewald et al. (Rodewald et al. J. Infect. Diseases 166, 635 (1992)). In brief, CD-1 female mice (6-8 weeks old) were immunized before breeding, as described above. The mice received 20 µg of protein per dose when immunized with a single antigen and 60 µg of protein per dose (15 µg of each antigen) when immunized with the combination of antigens. Mice were bred 2-7 days after the last immunization. Within 48 h of birth, pups were injected intraperitoneally with 50 µl of GBS culture. Challenge inocula were prepared starting from frozen cultures diluted to the appropriate concentration with THB before use. In preliminary experiments (not shown), the challenge doses per pup for each strain tested were determined to cause 90% lethality. Survival of pups was monitored for 2 days after challenge. Protection was calculated as (percentage deadControl minus percentage deadVaccine) divided by percentage deadControl multiplied by 100. Data were evaluated for statistical significance by Fisher's exact test.

SEQUENCE LISTING (548 sequences)

SEQ ID NO: 1 - DNA, 1662 bp, Streptococcus agalactiae
atgaaattatcgaagaagttattgttttcggctgctgttttaacaatggtggcggggtcaactgttgaaccagtagctcagtttgcgactggaatgagtattgtaagagctgcagaagtgtcacaagaacgcccagcgaaaacaacagtaaatatctataaattacaagctgatagttataaatcggaaattacttctaatggtggtatcgagaataaagacggcgaagtaatatctaactatgctaaacttggtgacaatgtaaaaggtttgcaaggtgtacagtttaaacgttataaagtcaagacggatatttctgttgatgaattgaaaaaattgacaacagttgaagcagcagatgcaaaagttggaacgattcttgaagaaggtgtcagtctacctcaaaaaactaatgctcaaggtttggtcgtcgatgctctggattcaaaaagtaatgtgagatacttgtatgtagaagatttaaagaattcaccttcaaacattaccaaagcttatgctgtaccgtttgtgttggaattaccagttgctaactctacaggtacaggtttcctttctgaaattaatatttaccctaaaaacgttgtaactgatgaaccaaaaacagataaagatgttaaaaaattaggtcaggacgatgcaggttatacgattggtgaagaattcaaatggttcttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactaggtggtgctgagtttgatttgttggcttctgatgggacagcagtaaaatggacagatgctcttattaaagcgaatactaataaaaactatattgctggagaagctgttactgggcaaccaatcaaattgaaatcacatacagacggtacgtttgagattaaaggtttggcttatgcagttgatgcgaatgcagagggtacagcagtaacttacaaattaaaagaaacaaaagcaccagaaggttatgtaatccctgataaagaaatcgagtttacagtatcacaaacatcttataatacaaaaccaactgacatcacggttgatagtgctgatgcaacacctgatacaattaaaaacaacaaacgtccttcaatccctaatactggtggtattggtacggctatctttgtcgctatcggtgctgcggtgatggcttttgctgttaaggggatgaagcgtcgtacaaaagataac

SEQ ID NO: 2 - protein, 554 aa, Streptococcus agalactiae
MKLSKKLLFSAAVLTMVAGSTVEPVAQFATGMSIVRAAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPSIPNTGGIGTAIFVAIGAAVMAFAVKGMKRRTKDN

SEQ ID NO: 3 - protein, 517 aa, Streptococcus agalactiae
AEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPSIPNTGGIGTAIFVAIGAAVMAFAVKGMKRRTKDN

SEQ ID NO: 4 - protein, 525 aa, Streptococcus agalactiae
MKLSKKLLFSAAVLTMVAGSTVEPVAQFATGMSIVRAAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPSIPNTG

SEQ ID NO: 5 - protein, 5 aa, Artificial
  cell wall anchor motif
IPNTG

SEQ ID NO: 6 - protein, 520 aa, Streptococcus agalactiae
MKLSKKLLFSAAVLTMVAGSTVEPVAQFATGMSIVRAAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 7 - protein, 483 aa, Streptococcus agalactiae
AEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 8 - protein, 271 aa, Streptococcus agalactiae
AEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKG

SEQ ID NO: 9 - protein, 212 aa, Streptococcus agalactiae
MTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 10 - DNA, 2670 bp, Streptococcus agalactiae
atgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaattacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattg

SEQ ID NO: 11 - protein, 890 aa, Streptococcus agalactiae
MKKRQKIWRGLSVTLLILSQIPFGILVQGETQDTNQALGKVIVKKTGDNATPLGKATFVLKNDNDKSETSHETVEGSGEATFENIKPGDYTLREETAPIGYKKTDKTWKVKVADNGATIIEGMDADKAEKRKEVLNAQYPKSAIYEDTKENYPLVNVEGSKVGEQYKALNPINGKDGRREIAEGWLSKKITGVNDLDKNKYKIELTVEGKTTVETKELNQPLDVVVLLDNSNSMNNERANNSQRALKAGEAVEKLIDKITSNKDNRVALVTYASTIFDGTEATVSKGVADQNGKALNDSVSWDYHKTTFTATTHNYSYLNLTNDANEVNILKSRIPKEAEHINGDRTLYQFGATFTQKALMKANEILETQSSNARKKLIFHVTDGVPTMSYAINFNPYISTSYQNQFNSFLNKIPDRSGILQEDFIINGDDYQIVKGDGESFKLFSDRKVPVTGGTTQAAYRVPQNQLSVMSNEGYAINSGYIYLYWRDYNWVYPFDPKTKKVSATKQIKTHGEPTTLYFNGNIRPKGYDIFTVGIGVNGDPGATPLEAEKFMQSISSKTENYTNVDDTNKIYDELNKYFKTIVEEKHSIVDGNVTDPMGEMIEFQLKNGQSFTHDDYVLVGNDGSQLKNGVALGGPNSDGGILKDVTVTYDKTSQTIKINHLNLGSGQKVVLTYDVRLKDNYISNKFYNTNNRTTLSPKSEKEPNTIRDFPIPKIRDVREFPVLTISNQKKMGEVEFIKVNKDKHSESLLGAKFQLQIEKDFSGYKQFVPEGSDVTTKNDGKIYFKALQDGNYKLYEISSPDGYIEVKTKPVVTFTIQNGEVTNLKADPNANKNQIGYLEGNGKHLITNTPKRPPGVFPKTGGIGTIVYILVGSTFMILTICSFRRKQL

SEQ ID NO: 12 - protein, 862 aa, Streptococcus agalactiae
GETQDTNQALGKVIVKKTGDNATPLGKATFVLKNDNDKSETSHETVEGSGEATFENIKPGDYTLREETAPIGYKKTDKTWKVKVADNGATIIEGMDADKAEKRKEVLNAQYPKSAIYEDTKENYPLVNVEGSKVGEQYKALNPINGKDGRREIAEGWLSKKITGVNDLDKNKYKIELTVEGKTTVETKELNQPLDVVVLLDNSNSMNNERANNSQRALKAGEAVEKLIDKITSNKDNRVALVTYASTIFDGTEATVSKGVADQNGKALNDSVSWDYHKTTFTATTHNYSYLNLTNDANEVNILKSRIPKEAEHINGDRTLYQFGATFTQKALMKANEILETQSSNARKKLIFHVTDGVPTMSYAINFNPYISTSYQNQFNSFLNKIPDRSGILQEDFIINGDDYQIVKGDGESFKLFSDRKVPVTGGTTQAAYRVPQNQLSVMSNEGYAINSGYIYLYWRDYNWVYPFDPKTKKVSATKQIKTHGEPTTLYFNGNIRPKGYDIFTVGIGVNGDPGATPLEAEKFMQSISSKTENYTNVDDTNKIYDELNKYFKTIVEEKHSIVDGNVTDPMGEMIEFQLKNGQSFTHDDYVLVGNDGSQLKNGVALGGPNSDGGILKDVTVTYDKTSQTIKINHLNLGSGQKVVLTYDVRLKDNYISNKFYNTNNRTTLSPKSEKEPNTIRDFPIPKIRDVREFPVLTISNQKKMGEVEFIKVNKDKHSESLLGAKFQLQIEKDFSGYKQFVPEGSDVTTKNDGKIYFKALQDGNYKLYEISSPDGYIEVKTKPVVTFTIQNGEVTNLKADPNANKNQIGYLEGNGKHLITNTPKRPPGVFPKTGGIGTIVYILVGSTFMILTICSFRRKQL

SEQ ID NO: 13 - protein, 851 aa, Streptococcus agalactiae
MKKRQKIWRGLSVTLLILSQIPFGILVQGETQDTNQALGKVIVKKTGDNATPLGKATFVLKNDNDKSETSHETVEGSGEATFENIKPGDYTLREETAPIGYKKTDKTWKVKVADNGATIIEGMDADKAEKRKEVLNAQYPKSAIYEDTKENYPLVNVEGSKVGEQYKALNPINGKDGRREIAEGWLSKKITGVNDLDKNKYKIELTVEGKTTVETKELNQPLDVVVLLDNSNSMNNERANNSQRALKAGEAVEKLIDKITSNKDNRVALVTYASTIFDGTEATVSKGVADQNGKALNDSVSWDYHKTTFTATTHNYSYLNLTNDANEVNILKSRIPKEAEHINGDRTLYQFGATFTQKALMKANEILETQSSNARKKLIFHVTDGVPTMSYAINFNPYISTSYQNQFNSFLNKIPDRSGILQEDFIINGDDYQIVKGDGESFKLFSDRKVPVTGGTTQAAYRVPQNQLSVMSNEGYAINSGYIYLYWRDYNWVYPFDPKTKKVSATKQIKTHGEPTTLYFNGNIRPKGYDIFTVGIGVNGDPGATPLEAEKFMQSISSKTENYTNVDDTNKIYDELNKYFKTIVEEKHSIVDGNVTDPMGEMIEFQLKNGQSFTHDDYVLVGNDGSQLKNGVALGGPNSDGGILKDVTVTYDKTSQTIKINHLNLGSGQKVVLTYDVRLKDNYISNKFYNTNNRTTLSPKSEKEPNTIRDFPIPKIRDVREFPVLTISNQKKMGEVEFIKVNKDKHSESLLGAKFQLQIEKDFSGYKQFVPEGSDVTTKNDGKIYFKALQDGNYKLYEISSPDGYIEVKTKPVVTFTIQNGEVTNLKADPNANKNQIGYLEGNGKHLITNT

SEQ ID NO: 14 - protein, 823 aa, Streptococcus agalactiae
GETQDTNQALGKVIVKKTGDNATPLGKATFVLKNDNDKSETSHETVEGSGEATFENIKPGDYTLREETAPIGYKKTDKTWKVKVADNGATIIEGMDADKAEKRKEVLNAQYPKSAIYEDTKENYPLVNVEGSKVGEQYKALNPINGKDGRREIAEGWLSKKITGVNDLDKNKYKIELTVEGKTTVETKELNQPLDVVVLLDNSNSMNNERANNSQRALKAGEAVEKLIDKITSNKDNRVALVTYASTIFDGTEATVSKGVADQNGKALNDSVSWDYHKTTFTATTHNYSYLNLTNDANEVNILKSRIPKEAEHINGDRTLYQFGATFTQKALMKANEILETQSSNARKKLIFHVTDGVPTMSYAINFNPYISTSYQNQFNSFLNKIPDRSGILQEDFIINGDDYQIVKGDGESFKLFSDRKVPVTGGTTQAAYRVPQNQLSVMSNEGYAINSGYIYLYWRDYNWVYPFDPKTKKVSATKQIKTHGEPTTLYFNGNIRPKGYDIFTVGIGVNGDPGATPLEAEKFMQSISSKTENYTNVDDTNKIYDELNKYFKTIVEEKHSIVDGNVTDPMGEMIEFQLKNGQSFTHDDYVLVGNDGSQLKNGVALGGPNSDGGILKDVTVTYDKTSQTIKINHLNLGSGQKVVLTYDVRLKDNYISNKFYNTNNRTTLSPKSEKEPNTIRDFPIPKIRDVREFPVLTISNQKKMGEVEFIKVNKDKHSESLLGAKFQLQIEKDFSGYKQFVPEGSDVTTKNDGKIYFKALQDGNYKLYEISSPDGYIEVKTKPVVTFTIQNGEVTNLKADPNANKNQIGYLEGNGKHLITNT

SEQ ID NO: 15 - DNA, 2703 bp, Streptococcus agalactiae
atgagaaaataccaaaaattttctaaaatattgacgttaagtcttttttgtttgtcgcaaataccgcttaataccaatgttttaggggaaagtaccgtaccggaaaatggtgctaaaggaaagttagttgttaaaaagacagatgaccagaacaaaccactttcaaaagctacctttgttttaaaaactactgctcatccagaaagtaaaatagaaaaagtaactgctgagctaacaggtgaagctacttttgataatctcatacctggagattatactttatcagaagaaacagcgcccgaaggttataaaaagactaaccagacttggcaagttaaggttgagagtaatggaaaaactacgatacaaaatagtggtgataaaaattccacaattggacaaaatcaggaagaactagataagcagtatccccccacaggaatttatgaagatacaaaggaatcttataaacttgagcatgttaaaggttcagttccaaatggaaagtcagaggcaaaagcagttaacccatattcaagtgaaggtgagcatataagagaaattccagagggaacattatctaaacgtatttcagaagtaggtgatttagctcataataaatataaaattgagttaactgtcagtggaaaaaccatagtaaaaccagtggacaaacaaaagccgttagatgttgtcttcgtactcgataattctaactcaatgaataacgatggcccaaattttcaaaggcataataaagccaagaaagctgccgaagctcttgggaccgcagtaaaagatattttaggagcaaacagtgataatagggttgcattagttacctatggttcagatatttttgatggtaggagtgtagatgtcgtaaaaggatttaaagaagatgataaatattatggccttcaaactaagttcacaattcagacagagaattatagtcataaacaattaacaaataatgctgaagagattataaaaaggattccgacagaagctcctaaagctaagtggggatctactaccaatggattaactccagagcaacaaaaggagtactatcttagtaaagtaggagaaacatttactatgaaagccttcatggaggcagatgatattttgagtcaagtaaatcgaaatagtcaaaaaattattgttcatgtaactgatggtgttcctacgagatcatatgctattaataattttaaactgggtgcatcatatgaaagccaatttgaacaaatgaaaaaaaatggatatctaaataaaagtaattttctacttactgataagcccgaggatataaaaggaaatggggagagttactttttgtttcccttagatagttatcaaacacagataatctctggaaacttacaaaaacttcattatttagatttaaatcttaattaccctaaaggtacaatttatcgaaatggaccagtgaaagaacatggaacaccaaccaaactttatataaatagtttaaaacagaaaaattatgacatttttaattttggtatcgatatatctggttttagacaagtttataatgaggagtataagaaaaatcaagatggtacttttcaaaaattgaaagaggaagcttttaaactttcagatggagaaatcacagaactaatgaggtcgttctcttccaaacctgagtactacacccctatcgtaacttcagccgatacatctaacaatgaaattttatctaaaattcagcaacaatttgaaacgattttaacaaaagaaaactcaattgttaatggaactatcgaagatcctatgggtgataaaatcaatttacagcttggtaatggacaaacattacagccaagtgattatactttacagggaaatgatggaagtgtaatgaaggatggtattgcaactggtgggcctaataatgatggtggaatacttaagggggttaaattagaatacatcggaaataaactctatgttagaggtttgaatttaggagaaggtcaaaaagtaacactcacatatgatgtgaaactagatgacagttttataagtaacaaattctatgacactaatggtagaacaacattgaatcctaagtcagaggatcctaatacacttagagattttccaatccctaaaattcgtgatgtgagagaatatcctacaataacgattaaaaacgagaagaagttaggtgaaattgaatttataaaagttgataaagataataataagttgcttctcaaaggagctacgtttgaacttcaagaatttaatgaagattataaactttatttaccaataaaaaataataattcaaaagtagtgacgggagaaaacggcaaaatttcttacaaagatttgaaagatggcaaatatcagttaatagaagcagtttcgccggaggattatcaaaaaattactaataaaccaattttaacttttgaagtggttaaaggatcgataaaaaatataatagctgttaataaacagatttctgaatatcatgaggaaggtgacaagcatttaattaccaacacgcatattccaccaaaaggaattattcctatgacaggtgggaaaggaattctatctttcattttaataggtggagctatgatgtctattgcaggtggaatttatatttggaaaaggtataagaaatctagtgatatgtccatcaaaaaagat

SEQ ID NO: 16 - protein, 901 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKGILSFILIGGAMMSIAGGIYIWKRYKKSSDMSIKKD

SEQ ID NO: 17 - protein, 869 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKGILS

SEQ ID NO: 18 - protein, 5 aa, Artificial
  cell wall anchor motif
IPMTG

SEQ ID NO: 19 - protein, 858 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGI

SEQ ID NO: 20 - DNA, 921 bp, Streptococcus agalactiae
atgaaacaaacattaaaacttatgttttcttttctgttgatgttagggactatgtttggaattagccaaactgttttagcgcaagaaactcatcagttgacgattgttcatcttgaagcaagggatattgatcgtccaaatccacagttggagattgcccctaaagaagggactccaattgaaggagtactctatcagttgtaccaattaaaatcaactgaagatggcgatttgttggcacattggaattccctaactatcacagaattgaaaaaacaggcgcagcaggtttttgaagccactactaatcaacaaggaaaggctacatttaaccaactaccagatggaatttattatggtctggcggttaaagccggtgaaaaaaatcgtaatgtctcagctttcttggttgacttgtctgaggataaagtgatttatcctaaaatcatctggtccacaggtgagttggacttgcttaaagttggtgtggatggtgataccaaaaaaccactagcaggcgttgtctttgaactttatgaaaagaatggtaggactcctattcgtgtgaaaaatggggtgcattctcaagatattgacgctgcaaaacatttagaaacagattcatcagggcatatcagaatttccgggctcatccatggggactatgtcttaaaagaaatcgagacacagtcaggatatcagatcggacaggcagagactgctgtgactattgaaaaatcaaaaacagtaacagtaacgattgaaaataaaaaagttccgacacctaaagtgccatctcgaggaggtcttattcccaaaacaggtgagcaacaggcaatggcacttgtaattattggtggtattttaattgctttagccttacgattactatcaaaacatcggaaacatcaaaataaggat

SEQ ID NO: 21 - protein, 307 aa, Streptococcus agalactiae
MKQTLKLMFSFLLMLGTMFGISQTVLAQETHQLTIVHLEARDIDRPNPQLEIAPKEGTPIEGVLYQLYQLKSTEDGDLLAHWNSLTITELKKQAQQVFEATTNQQGKATFNQLPDGIYYGLAVKAGEKNRNVSAFLVDLSEDKVIYPKIIWSTGELDLLKVGVDGDTKKPLAGVVFELYEKNGRTPIRVKNGVHSQDIDAAKHLETDSSGHIRISGLIHGDYVLKEIETQSGYQIGQAETAVTIEKSKTVTVTIENKKVPTPKVPSRGGLIPKTGEQQAMALVIIGGILIALALRLLSKHRKHQNKD

SEQ ID NO: 22 - DNA, 918 bp, Streptococcus agalactiae
atgggacaaaaatcaaaaatatctctagctacgaatattcgtatatggatttttcgtttaattttcttagcgggtttccttgttttggcatttcccatcgttagtcaggtcatgtactttcaagcctctcacgccaatattaatgcttttaaagaagctgttaccaagattgaccgggtggagattaatcggcgtttagaacttgcttatgcttataacgccagtatagcaggtgccaaaactaatggcgaatatccagcgcttaaagacccctactctgctgaacaaaagcaggcaggggtcgttgagtacgcccgcatgcttgaagtcaaagaacaaataggtcatgtgattattccaagaattaatcaggatatccctatttacgctggctctgctgaagaaaatcttcagaggggcgttggacatttagaggggaccagtcttccagtcggtggtgagtcaactcatgccgttctaactgcccatcgagggctaccaacggccaagctatttaccaatttagacaaggtaacagtaggtgaccgtttttacattgaacacatcggcggaaagattgcttatcaggtagaccaaatcaaagttatcgcccctgatcagttagaggatttgtacgtgattcaaggagaagatcacgtcaccctattaacttgcacaccttatatgataaatagtcatcgcctcctcgttcgaggcaagcgaattccttatgtggaaaaaacagtgcagaaagattcaaagaccttcaggcaacaacaatacctaacctatgctatgtgggtagtcgttggacttatcttgctgtcgcttctcatttggtttaaaaagacgaaacagaaaaagcggagaaagaatgaaaaagcggctagtcaaaatagtcacaataattcgaaataa

SEQ ID NO: 23 - protein, 305 aa, Streptococcus agalactiae
MGQKSKISLATNIRIWIFRLIFLAGFLVLAFPIVSQVMYFQASHANINAFKEAVTKIDRVEINRRLELAYAYNASIAGAKTNGEYPALKDPYSAEQKQAGVVEYARMLEVKEQIGHVIIPRINQDIPIYAGSAEENLQRGVGHLEGTSLPVGGESTHAVLTAHRGLPTAKLFTNLDKVTVGDRFYIEHIGGKIAYQVDQIKVIAPDQLEDLYVIQGEDHVTLLTCTPYMINSHRLLVRGKRIPYVEKTVQKDSKTFRQQQYLTYAMWVVVGLILLSLLIWFKKTKQKKRRKNEKAASQNSHNNSK

SEQ ID NO: 24 - DNA, 783 bp, Streptococcus agalactiae
atgggaagtctgattctcttatttccgattgtgagccaggtaagttactaccttgcttcgcatcaaaatattaatcaatttaagcgggaagtcgctaagattgatactaatacggttgaacgacgcatcgctttagctaatgcttacaatgagacgttatcaaggaatcccttgcttatagacccttttaccagtaagcaaaaagaaggtttgagagagtatgctcgtatgcttgaagttcatgagcaaataggtcatgtggcaatcccaagtattggggttgatattccaatttatgctggaacatccgaaactgtgcttcagaaaggtagtgggcatttggagggaaccagtcttccagtgggaggtttgtcaacccattcagtactaactgcccaccgtggcttgccaacagctaggctatttaccgacttaaataaagttaaaaaaggccagattttctatgtgacgaacatcaaggaaacacttgcctacaaagtcgtgtctatcaaagttgtggatccaacagctttaagtgaggttaagattgtcaatggtaaggattatataaccttgctgacttgcacaccttacatgatcaatagtcatcgtctcttggtaaaaggagagcgtattccttatgattctaccgaggcggaaaagcacaaagaacaaaccgtacaagattatcgtttgtcactagtgttgaagatactactagtattattaattggactcttcatcgtgataatgatgagaagatggatgcaacatcgtcaataa

SEQ ID NO: 25 - protein, 260 aa, Streptococcus agalactiae
MGSLILLFPIVSQVSYYLASHQNINQFKREVAKIDTNTVERRIALANAYNETLSRNPLLIDPFTSKQKEGLREYARMLEVHEQIGHVAIPSIGVDIPIYAGTSETVLQKGSGHLEGTSLPVGGLSTHSVLTAHRGLPTARLFTDLNKVKKGQIFYVTNIKETLAYKVVSIKVVDPTALSEVKIVNGKDYITLLTCTPYMINSHRLLVKGERIPYDSTEAEKHKEQTVQDYRLSLVLKILLVLLIGLFIVIMMRRWMQHRQ

SEQ ID NO: 26 - DNA, 924 bp, Streptococcus agalactiae
atgaaaaagattagaaaaagtttaggacttctactatgttgctttttaggattggtacaattagcgtttttttcggtagccagtgtaaatgctgatacccctaatcaactaacaatcacacagataggacttcagccaaatactacagaggaggggatttcttatcgtttatggactgtgactgacaacttaaaagttgatttattgagccaaatgacagatagcgaattgaaccagaagtataagagtatcttgacttctcctactgatactaatggtcagacaaagatagcactcccaaatggttcgtactttggtcgtgcttataaagctgatcaaagcgtttcaacaatagtacctttttatattgaattaccagatgataagttatcaaatcaattacagataaatcctaagcgaaaagttgaaacaggccgattaaaacttattaaatatacaaaagaaggaaagataaagaaaaggctatccggagtaatatttgtattatacgataaccagaatcagccagttcgctttaaaaatggacgatttacgaccgatcaagatgggattacttcattagtaactgatgataagggagaaattgaggttgaaggtttattacctggtaagtatatttttcgagaagcaaaagcactaactggttaccgtatatctatgaaggatgctgtagttgctgtagttgctaataaaacacaggaagtagaggtagaaaacgaaaaagaaactcctccaccaacaaatcctaaaccatcacaaccgctttttccacaatcatttcttcctaaaacaggaatgattattggtggaggactgacaattcttggttgtattattttgggaattttgtttatctttttaagaaaaactaaaaatagcaaatctgaaagaaacgatacagta

SEQ ID NO: 27 - protein, 308 aa, Streptococcus agalactiae
MKKIRKSLGLLLCCFLGLVQLAFFSVASVNADTPNQLTITQIGLQPNTTEEGISYRLWTVTDNLKVDLLSQMTDSELNQKYKSILTSPTDTNGQTKIALPNGSYFGRAYKADQSVSTIVPFYIELPDDKLSNQLQINPKRKVETGRLKLIKYTKEGKIKKRLSGVIFVLYDNQNQPVRFKNGRFTTDQDGITSLVTDDKGEIEVEGLLPGKYIFREAKALTGYRISMKDAVVAVVANKTQEVEVENEKETPPPTNPKPSQPLFPQSFLPKTGMIIGGGLTILGCIILGILFIFLRKTKNSKSERNDTV

SEQ ID NO: 28 - DNA, 885 bp, Streptococcus agalactiae
atgggaggaaaatttcagaaaaaccttaagaaatcggtcgttttaaatcgatggatgaatgtaggcttgatactattgttcttagttggtcttttgataacctcatatccttttatttcaaattggtactataatattaaagctaataatcaagtaactaactttgataatcaaacccaaaaattaaatactaaagagattaatagacgatttgagttagcaaaagcttataatagaacactggacccaagccgcctatcagatccctatactgaaaaagaaaaaaaaggtattgctgaatacgcccacatgcttgagattgctgaaatgattggatatattgatataccgtctatcaagcaaaaattacctatctatgcggggactaccagtagtgttcttgaaaaaggagcaggacaccttgaaggaacctccttgccaattggtggaaaaagttcacatactgttatcacagctcatcgcggcttacctaaagctaagttatttacagatttagataaacttaaaaaaggaaaaattttttatattcataatatcaaagaagttttagcctataaggttgatcaaataagtgttgtaaagccagataatttttctaaattattggttgttaaaggtaaggattatgcgactttgctaacatgtacaccttattcgattaattcacatcgtttactagttagagggcatcgaatcaagtatgtacctcctgttaaagaaaagaactatttaatgaaagaattgcaaacacactataaactttatttcctcttatcaatcctagttattcttatattagtcgctttactattatatttaaaacgaaaatttaaagagagaaagagaaagggaaatcaaaaatga

SEQ ID NO: 29 - protein, 294 aa, Streptococcus agalactiae
MGGKFQKNLKKSVVLNRWMNVGLILLFLVGLLITSYPFISNWYYNIKANNQVTNFDNQTQKLNTKEINRRFELAKAYNRTLDPSRLSDPYTEKEKKGIAEYAHMLEIAEMIGYIDIPSIKQKLPIYAGTTSSVLEKGAGHLEGTSLPIGGKSSHTVITAHRGLPKAKLFTDLDKLKKGKIFYIHNIKEVLAYKVDQISVVKPDNFSKLLVVKGKDYATLLTCTPYSINSHRLLVRGHRIKYVPPVKEKNYLMKELQTHYKLYFLLSILVILILVALLLYLKRKFKERKRKGNQK

SEQ ID NO: 30 - DNA, 882 bp, Streptococcus agalactiae
gtgaagactaaaaaaatcatcaaaaaaacaaaaaaaaagaagaagtcaaatcttccttttatcattctttttctaataggtctatctattttattgtatccagtggtatcacgtttttactatacgatagaatctaataatcaaacacaggattttgagagagctgctaaaaaacttagtcagaaagaaatcaatcgacgtatggctctagcacaagcttataatgattctttaaataatgtccatcttgaagatccttatgagaaaaaacgaattcaaaagggggtagcagagtacgcccgtatgttagaggtaagtgaaaaaatcggaacaatttcagttcctaagataggtcaaaaactccctatatttgcaggttcaagtcaagaagttctatctaaaggagcagggcatttagaaggtacctctcttccaattgggggcaatagtacacatactgttataacagcgcattcaggaattccagataaagaactcttttctaaccttaaaaagttaaaaaaaggagataagttttatattcaaaacataaaagaaacgatagcatatcaagtagatcagataaaagtcgttacacccgataacttttcagatttgttggttgttcctggacatgattatgcaaccttattgacttgcaccccgattatgatcaatacacacagacttttagtaaggggacatcgtatcccttataaaggtcctattgatgaaaaattaataaaagacggtcatttaaacacgatttatagatatctattctatatatctttagttattattgcttggttactttggttaataaaacgtcaacgtcaaaaaaatcgtttagcaagtgttagaaaaggaattgaatcataa

SEQ ID NO: 31 - protein, 293 aa, Streptococcus agalactiae
MKTKKIIKKTKKKKKSNLPFIILFLIGLSILLYPVVSRFYYTIESNNQTQDFERAAKKLSQKEINRRMALAQAYNDSLNNVHLEDPYEKKRIQKGVAEYARMLEVSEKIGTISVPKIGQKLPIFAGSSQEVLSKGAGHLEGTSLPIGGNSTHTVITAHSGIPDKELFSNLKKLKKGDKFYIQNIKETIAYQVDQIKVVTPDNFSDLLVVPGHDYATLLTCTPIMINTHRLLVRGHRIPYKGPIDEKLIKDGHLNTIYRYLFYISLVIIAWLLWLIKRQRQKNRLASVRKGIES

SEQ ID NO: 32 - protein, 199 aa, Streptococcus agalactiae
MIRRYSANFLAILGIILVSSGIYWGWYNINQAHQADLTSQHIVKVLDKSITHQVKGSENGELPVKKLDKTDYLGTLDIPNLKLHLPVAANYSFEQLSKTPTRYYGSYLTNNMVICAHNFPYHFDALKNVDMGTDVYFTTTTGQIYHYKISNREIIEPTAIEKVYKTATSDNDWDLSLFTCTKAGVARVLVRCQLIDVKN

SEQ ID NO: 33 - protein, 223 aa, Streptococcus agalactiae
MIYKKILKITLLLLFSLSTQLVSADTNDQMKTGSITIQNKYNNQGIAGGNLLVYQVAQAKDVDGNQVFTLTTPFQGIGIKDDDLTQVNLDSNQAKYVNLLTKAVHKTQPLQTFDNLPAEGIVANNLPQGIYLFIQTKTAQGYELMSPFILSIPKDGKYDITAFEKMSPLNAKPKKEETITPTVTHQTKGKLPFTGQVWWPIPILIMSGLLCLIIALKWRRRRD

SEQ ID NO: 34 - protein, 268 aa, Streptococcus agalactiae
MAYPSLANYWNSFHQSRAIMDYQDRVTHMDENDYKKIINRAKEYNKQFKTSGMKWHMTSQERLDYNSQLAIDKTGNMGYISIPKINIKLPLYHGTSEKVLQTSIGHLEGSSLPIGGDSTHSILSGHRGLPSSRLFSDLDKLKVGDHWTVSILNETYTYQVDQIRTVKPDDLRDLQIVKGKDYQTLVTCTPYGVNTHRLLVRGHRVPNDNGNALVVAEAIQIEPIYIAPFIAIFLTLILLLISLEVTRRARQRKKILKQAMRKEENNDL

SEQ ID NO: 35 - protein, 502 aa, Streptococcus agalactiae
MKKKMIQSLLVASLAFGMAVSPVTPIAFAAETGTITVQDTQKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTELPSTGGIGTTIFYIIGAILVIGAGIVLVARRRLRS

SEQ ID NO: 36 - protein, 1434 aa, Streptococcus agalactiae
MLKKCQTFIIESLKKKKHPKEWKIIMWSLMILTTFLTTYFLILPAITVEETKTDDVGITLENKNSSQVTSSTSSSQSSVEQSKPQTPASSVTETSSSEEAAYREEPLMFRGADYTVTVTLTKEAKIPKNADLKVTELKDNSATFKDYKKKALTEVAKQDSEIKNFKLYDITIESNGKEAEPQAPVKVEVNYDKPLEASDENLKVVHFKDDGQTEVLKSKDTAETKNTSSDVAFKTDSFSIYAIVQEDNTEVPRLTYHFQNNDGTDYDFLTASGMQVHHQIIKDGESLGEVGIPTIKAGEHFNGWYTYDPTTGKYGDPVKFGEPITVTETKEICVRPFMSKVATVTLYDDSAGKSILERYQVPLDSSGNGTADLSSFKVSPPTSTLLFVGWSKTQNGAPLSESEIQALPVSSDISLYPVFKESYGVEFNTGDLSTGVTYIAPRRVLTGQPASTIKPNDPTRPGYTFAGWYTAASGGAAFDFNQVLTKDTTLYAHWSPAQTTYTINYWQQSATDNKNATDAQKTYEYAGQVTRSGLSLSNQTLTQQDINDKLPTGFKVNNTRTETSVMIKDDGSSVVNVYYDRKLITIKFAKYGGYSLPEYYYSYNWSSDADTYTGLYGTTLAANGYQWKTGAWGYLANVGNNQVGTYGMSYLGEFILPNDTVDSDVIKLFPKGNIVQTYRFFKQGLDGTYSLADTGGGAGADEFTFTEKYLGFNVKYYQRLYPDNYLFDQYASQTSAGVKVPISDEYYDRYGAYHKDYLNLVVWYERNSYKIKYLDPLDNTELPNFPVKDVLYEQNLSSYAPDTTTVQPKPSRPGYVWDGKWYKDQAQTQVFDFNTTMPPHDVKVYAGWQKVTYRVNIDPNGGRLSKTDDTYLDLHYGDRIPDYTDITRDYIQDPSGTYYYKYDSRDKDPDSTKDAYYTTDTSLSNVDTTTKYKYVKDAYKLVGWYYVNPDGSIRPYNFSGAVTQDINLRAIWRKAGDYHIIYSNDAVGTDGKPALDASGQQLQTSNEPTDPDSYDDGSHSALLRRPTMPDGYRFRGWWYNGKIYNPYDSIDIDAHLADANKNITIKPVIIPVGDIKLEDTSIKYNGNGGTRVENGNVVTQVETPRMELNSTTTIPENQYFTRTGYNLIGWHHDKDLADTGRVEFTAGQSIGIDNNPDATNTLYAVWQPKEYTVRVSKTVVGLDEDKTKDFLFNPSETLQQENFPLRDGQTKEFKVPYGTSISIDEQAYDEFKVSESITEKNLATGEADKTYDATGLQSLTVSGDVDISFTNTRIKQKVRLQKVNVENDNNFLAGAVFDIYESDANGNKASHPMYSGLVTNDKGLLLVDANNYLSLPVGKYYLTETKAPPGYLLPKNDISVLVISTGVTFEQNGNNATPIKENLVDGSTVYTFKITNSKGTELPSTGGIGTHIYILVGLALALPSGLILYYRKKI

SEQ ID NO: 37 - protein, 189 aa, Streptococcus agalactiae
MKRQISSDKLSQELDRVTYQKRFWSVIKNTIYILMAVASIAILIAVLWLPVLRIYGHSMNKTLSAGDVVFTVKGSNFKTGDVVAFYYNNKVLVKRVIAESGDWVNIDSQGDVYVNQHKLKEPYVIHKALGNSNIKYPYQVPDKKIFVLGDNRKTSIDSRSTSVGDVSEEQIVGKISFRIWPLGKISSIN

SEQ ID NO: 38 - DNA, 1376 bp, Streptococcus agalactiae
atgaataaaaaggtactattgacatcgacaatggcagcttcgctattatcagtcgcaagtgttcaagcacaagaaacagatacgacgtggacagcacgtactgtttcagaggtaaaggctgatttggtaaagcaagacaataaatcatcatatactgtgaaatatggtgatacactaagcgttatttcagaagcaatgtcaattgatatgaatgtcttagcaaaaataaataacattgcagatatcaatcttatttatcctgagacaacactgacagtaacttacgatcagaagagtcatactgccacttcaatgaaaatagaaacaccagcaacaaatgctgctggtcaaacaacagctactgtggatttgaaaaccaatcaagtttctgttgcagaccaaaaagtttctctcaatacaatttcggaaggtatgacaccagaagcagcaacaacgattgtttcgccaatgaagacatattcttctgcgccagctttgaaatcaaaagaagtattagcacaagagcaagctgttagtcaagcagcagctaatgaacaggtatcaccagctcctgtgaagtcgattacttcagaagttccagcagctaaagaggaagttaaaccaactcagacgtcagtcagtcagtcaacaacagtatcaccagcttctgttgccgctgaaacaccagctccagtagctaaagtagcaccggtaagaactgtagcagcccctagagtggcaagtgttaaagtagtcactcctaaagtagaaactggtgcatcaccagagcatgtatcagctccagcagttcctgtgactacgacttcaccagctacagacagtaagttacaagcgactgaagttaagagcgttccggtagcacaaaaagctccaacagcaacaccggtagcacaaccagcttcaacaacaaatgcagtagctgcacatcctgaaaatgcagggctccaacctcatgttgcagcttataaagaaaaagtagcgtcaacttatggagttaatgaattcagtacataccgtgcgggagatccaggtgatcatggtaaaggtttagcagttgactttattgtaggtactaatcaagcacttggtaataaagttgcacagtactctacacaaaatatggcagcaaataacatttcatatgttatctggcaacaaaagttttactcaaatacaaacagtatttatggacctgctaatacttggaatgcaatgccagatcgtggtggcgttactgccaaccactatgaccacgttcacgtatcatttaacaaataatataaaaaaggaagctatttggcttcttttttatatgccttgaatagactttcaaggttcttatataatttttatta

SEQ ID NO: 39 - protein, 432 aa, Streptococcus agalactiae
MNKKVLLTSTMAASLLSVASVQAQETDTTWTARTVSEVKADLVKQDNKSSYTVKYGDTLSVISEAMSIDMNVLAKINNIADINLIYPETTLTVTYDQKSHTATSMKIETPATNAAGQTTATVDLKTNQVSVADQKVSLNTISEGMTPEAATTIVSPMKTYSSAPALKSKEVLAQEQAVSQAAANEQVSPAPVKSITSEVPAAKEEVKPTQTSVSQSTTVSPASVAAETPAPVAKVAPVRTVAAPRVASVKVVTPKVETGASPEHVSAPAVPVTTTSPATDSKLQATEVKSVPVAQKAPTATPVAQPASTTNAVAAHPENAGLQPHVAAYKEKVASTYGVNEFSTYRAGDPGDHGKGLAVDFIVGTNQALGNKVAQYSTQNMAANNISYVIWQQKFYSNTNSIYGPANTWNAMPDRGGVTANHYDHVHVSFNK

SEQ ID NO: 40 - protein, 392 aa, Streptococcus agalactiae
DLVKQDNKSSYTVKYGDTLSVISEAMSIDMNVLAKINNIADINLIYPETTLTVTYDQKSHTATSMKIETPATNAAGQTTATVDLKTNQVSVADQKVSLNTISEGMTPEAATTIVSPMKTYSSAPALKSKEVLAQEQAVSQAAANEQVSPAPVKSITSEVPAAKEEVKPTQTSVSQSTTVSPASVAAETPAPVAKVAPVRTVAAPRVASVKVVTPKVETGASPEHVSAPAVPVTTTSPATDSKLQATEVKSVPVAQKAPTATPVAQPASTTNAVAAHPENAGLQPHVAAYKEKVASTYGVNEFSTYRAGDPGDHGKGLAVDFIVGTNQALGNKVAQYSTQNMAANNISYVIWQQKFYSNTNSIYGPANTWNAMPDRGGVTANHYDHVHVSFNK

SEQ ID NO: 41 - protein, 429 aa, Streptococcus agalactiae
MIEKYLESSIESKCQLVVLFFKTSYLPITEVAEKTGLTFLQLNHYCEELNAFFPDSLSMTIQKRMISCQFTHPFKETYLYQLYASSNVLQLLAFLIKNGSHSRPLTDFARSHFLSNSSAYRMREALIPLLRNFELKLSKNKIVGEEYRIRYLIALLYSKFGIKVYDLTQQDKNTIHSFLSHSSTHLKTSPWLSESFSFYDILLALSWKRHQFSVTIPQTRIFQQLKKLFIYDSLKKSSRDIIETYCQLNFSAGDLDYLYLIYITANNSFASLQWTPEHIRQCCQLFEENDTFRLLLKPIITLLPNLKEQKPSLVKALMFFSKSFLFNLQHFIPETNLFVSPYYKGNQKLYTSLKLIVEEWLAKLPGKRYLNHKHFHLFCHYVEQILRNIQPPLVVVFVASNFINAHLLTDSFPRYFSDKSIDFHSYIAR

SEQ ID NO: 42 - protein, 627 aa, Streptococcus agalactiae
MVSSYMFVRGEKMNNKIFLNKEASFLAHTKRKRRFAVTLVGVFFMLLACAGAIGFGQVAYAADEKTVPSHSSPNPEFPWYGYDAYGKEYPGYNIWTRYHDLRVNLNGSRSYQVYCFNIQSNYPSQKNSFIKNWFKKIEGNGKSFVDYAHTTKLGKEELEQRLLSLLYNAYPNDANGYMKGLEHLNAITVTQYAVWHYSDNSQYQFETLWESEAKEGKISRSQVTLMREALKKLIDPNLEATAVNKIPSGYRLNIFESENEAYQNLLSAEYVPDDPPKPGETSEHNPKTPELDGTPIPEDPKHPDDNLEPTLPPVMLDGEEVPEVPSESLEPALPPLMPELDGQEVPEKPSIDLPIEVPRYEFNNKDQSPLAGESGETEYITEVYGNQQNPVDIDKKLPNETGFSGNMVETEDTKEPEVLMGGQSESVEFTKDTQTGMSGQTTPQVETEDTKEPEVLMGGQSESVEFTKDTQTGMSGQTTPQIETEDTKEPEVLMGGQSESVEFTKDTQTGMSGQTTPQIETEDTKEPEVLMGGQSESVEFTKDTQTGMSGFSETATVVEDTRPKLVFHFDNNEPKVEENREKPTKNITPILPATGDIENVLAFLGILILSVLSIFSLLKNKQSNKKV

SEQ ID NO: 43 - protein, 67 aa, Streptococcus agalactiae
MSLRHQNKKGIRKEGWKSRPQSRWSDHCQLVAQKSVLKQAISKTVLAERGLFSCLDDYLERHALKVN

SEQ ID NO: 44 - protein, 1036 aa, Streptococcus agalactiae
MYSRLKRELVIVINRKKKYKLIRLMVTVGLIFSQLVLPIRRLGLQMISTQTKVIPQEIVTQTETQGTQVVATKQKLESENSSLKVALKRESGFEHNATIDASLDTESQGDNSQRSVTQAIVTMALELRKQGLSIVDTKIVRIQSSTNQRNDITTTLTFKNGLSLEGASTEANDPNVRVGIVNPNDTVQTITPTIKQDADGKVKNLVFTGRLGKQVIIVSTTRLKEEQTISLDSYGELVIDGAVGLSQKDRPPYSKPITVNILKPKLSSIESSLDSKDFEIVKTIDNLYTWDDQFYLLDFISKQYEVLKTDYQSAKDSTPQTRDILFGEYTVEPLVMNKGHNNTINIYIRSTRPLGLKPIGAAPALIQPRSFRSLTPRSTRMKRSAPVEKFEGELEHHKRIDYLGDNQNNPDTTIDDKEDEHDTSDLYRLYLDMTGKKNPLDILVVVDKSGSMQEGIGSVQRYRYYAQRWDDYYSQWVYHGTFDYSSYQGESFNRGQIHYRYRGIVSVSDGIRRDDAVKNSLLGVNGLLQRFVNINPENKLSVIGFQGSADYHAGKWYPDQSPRGGFYQPNLNNSRDAELLKGWSTNSLLDPNTLTALHNNGTNYHAALLKAKEILNEVKDDGRRKIMIFISDGVPTFYFGEDGYRSGNGSSNDRNNVTRSQEGSKLAIDEFKARYPNLSIYSLGVSKDINSDTASSSPVVLKYLSGEEHYYGITDTAELEKTLNKIVEDSKLSQLGISDSLSQYVDYYDKQPDVLVTRKSKVNDETEILYQKDQVQEAGKDIIDKVVFTPKTTSQPKGKVTLTFKSDYKVDDEYTYTLSFNVKASDEAYEKYKDNEGRYSEMGDSDTDYGTNQTSSGKGGLPSNSDASVNYMADGREQKLPYKHPVIQVKTVPITFTKVDADNNQKKLAGVEFELRKEDKKIVWEKGTTGSNGQLNFKYLQKGKTYYLYETKAKLGYTLPENPWEVAVANNGDIKVKHPIEGELKSKDGSYMIKNYKIYQLPSSGGRGSQIFIIVGSMTATVALLFYRRQHRKKQY

SEQ ID NO: 45 - protein, 556 aa, Streptococcus agalactiae
MTNRRETVREKILITAKKLMLACLAILAVVGLGMTRVSALSKDDTAQLKITNIEGGPTVTLYKIGEGVYNTNGDSFINFKYAEGVSLTETGPTSQEITTIANGINTGKIKPFSTENVSISNGTATYNARGASVYIALLTGATDGRTYNPILLAASYNGEGNLVTKNIDSKSNYLYGQTSVAKSSLPSITKKVTGTIDDVNKKTTSLGSVLSYSLTFELPSYTKEAVNKTVYVSDNMSEGLTFNFNSLTVEWKGKMANITEDGSVMVENTKIGIAKEVNNGFNLSFIYDSLESISPNISYKAVVNNKAIVGEEGNPNKAEFFYSNNPTKGNTYDNLDKKPDKGNGITSKEDSKIVYTYQIAFRKVDSVSKTPLIGAIFGVYDTSNKLIDIVTTNKNGYAISTQVSSGKYKIKELKAPKGYSLNTETYEITANWVTATVKTSANSKSTTYTSDKNKATDNSEQVGWLKNGIFYSIDSRPTGNDVKEAYIESTKALTDGTTFSKSNEGSGTVLLETDIPNTKLGELPSTGSIGTYLFKAIGSAAMIGAIGIYIVKRRKA

SEQ ID NO: 46 - protein, 280 aa, Streptococcus agalactiae
MTERLKNLGILLLFLLGTAIFLYPTLSSQWNAYRDRQLLSTYHKQVIQKKPSEMEEVWQKAKAYNARLGIQPVPDAFSFRDGIHDKNYESLLQIENNDIMGYVEVPSIKVTLPIYHYTTDEVLTKGAGHLFGSALPVGGDGTHTVISAHRGLPSAEMFTNLNLVKKGDTFYFRVLNKVLAYKVDQILIVEPDQATSLSGVMGKDYATLVTCTPYGVNTKRLLVRGHRIAYHYKKYQQAKKAMKLVDKSRMWAEVVCAAFGVVIAIILVFMYSRVSAKKSK

SEQ ID NO: 47 - protein, 497 aa, Streptococcus agalactiae
MIEKYLESSIESKCQLIVLFFKTSYLPITEVAEKTGLTFLQLNHYCEELNAFFPGSLSMTIQKRMISCQFTHPFKETYLYQLYASSNVLQLLAFLIKNGSHSRPLTDFARSHFLSNSSAYRMREALIPLLRNFELKLSKNKIVGEEYRIRYLIALLYSKFGIKVYDLTQQDKNTIHSFLSHSSTHLKTSPWLSESFSFYDILLALSWKRHQFSVTIPQTRIFQQLKKLFVYDSLKKSSHDIIETYCQLNFSAGDLDYLYLIYITANNSFASLQWTPEHIRQYCQLFEENDTFRLLLNPIITLLPNLKEQKASLVKALMFFSKSFLFNLQHFIPETNLFVSPYYKGNQKLYTSLKLIVEEWMAKLPGKRDLNHKHFHLFCHYVEQSLRNIQPPLVVVFVASNFINAHLLTDSFPRYFSDKSIDFHSYYLLQDNVYQIPDLKPDLVITHSQLIPFVHHELTKGIAVAEISFDESILSIQELMYQVKEEKFQADLTKQLT

SEQ ID NO: 48 - protein, 762 aa, Streptococcus agalactiae
LRGEKMKKTRFPNKLNTLNTQRVLSKNSKRFTVTLVGVFLMIFALVTSMVGAKTVFGLVESSTPNAINPDSSSEYRWYGYESYVRGHPYYKQFRVAHDLRVNLEGSRSYQVYCFNLKKAFPLGSDSSVKKWYKKHDGISTKFEDYAMSPRITGDELNQKLRAVMYNGHPQNANGIMEGLEPLNAIRVTQEAVWYYSDNAPISNPDESFKRESESNLVSTSQLSLMRQALKQLIDPNLATKMPKQVPDDFQLSIFESEDKGDKYNKGYQNLLSGGLVPTKPPTPGDPPMPPNQPQTTSVLIRKYAIGDYSKLLEGATLQLTGDNVNSFQARVFSSNDIGERIELSDGTYTLTELNSPAGYSIAEPITFKVEAGKVYTIIDGKQIENPNKEIVEPYSVEAYNDFEEFSVLTTQNYAKFYYAKNKNGSSQVVYCFNADLKSPPDSEDGGKTMTPDFTTGEVKYTHIAGRDLFKYTVKPRDTDPDTFLKHIKKVIEKGYREKGQAIEYSGLTETQLRAATQLAIYYFTDSAELDKDKLKDYHGFGDMNDSTLAVAKILVEYAQDSNPPQLTDLDFFIPNNNKYQSLIGTQWHPEDLVDIIRMEDKKEVIPVTHNLTLRKTVTGLAGDRTKDFHFEIELKNNKQELLSQTVKTDKTNLEFKDGKATINLKHGESLTLQGLPEGYSYLVKETDSEGYKVKVNSQEVANATVSKTGITSDETLAFENNKEPVVPTGVDQKINGYLALIVIAGISLGIWGIHTIRIRKHD

SEQ ID NO: 49 - protein, 131 aa, Streptococcus agalactiae
MIIKRNDMAPSVKAGDAILFYRLSQTYKVEEAVVYEDSKTSITKVGRIIAQAGDEVDLTEQGELKINGHIQNEGLTFIKSREANYPYRIADNSYLILNDYYSQESENYLQDAIAKDAIKGTINTLIRLRNH

SEQ ID NO: 50 - protein, 340 aa, Streptococcus agalactiae
MKLRHLLLTGAALTSFAATTVHGETVVNGAKLTVTKNLDLVNSNALIPNTDFTFKIEPDTTVNEDGNKFKGVALNTPMTKVTYTNSDKGGSNTKTAEFDFSEVTFEKPGVYYYKVTEEKIDKVPGVSYDTTSYTVQVHVLWNEEQQKPVATYIVGYKEGSKVPIQFKNSLDSTTLTVKKKVSGTGGDRSKDFNFGLTLKANQYYKASEKVMIEKTTKGGQAPVQTEASIDQLYHFTLKDGESIKVTNLPVGVDYVVTEDDYKSEKYTTNVEVSPQDGAVKNIAGNSTEQETSTDKDMTITFTNKKDFEVPTGVAMTVAPYIALGIVAVGGALYFVKKKNA

SEQ ID NO: 51 - protein, 237 aa, Streptococcus agalactiae
MIVRLIKLLDKLINVIVLCFFFLCLLIAALGIYDALTVYQGANATNYQQYKKKGVQFDDLLAINSDVMAWLTVKGTHIDYPIVQGENNLEYINKSVEGEYSLSGSVFLDYRNKVTFEDKYSLIYAHHMAGNVMFGELPNFRKKSFFNKHKEFSIETKTKQKLKINIFACIQTDAFDSLLFNPIDVDISSKNEFLNHIKQKSVQYREILTTNESRFVALSTCEDMTTDGRIIVIGQIE

SEQ ID NO: 52 - protein, 215 aa, Streptococcus agalactiae
MKKSILRILAIGYLLMSFCLLDSVEAENLTASINIEVINQVDVATNKQSSDIDETFMFVIEALDKESPLPNSVTTSVKGNGKTSFEQLTFSEVGQYHYKIHQLLGKNSQYHYDETVYEVVIYVLYNEQSGALETNLVSNKLGETEKSELIFKQEYSEKTPEPHQPDTTEKEKPQKKRNGILPSTGEMVSYVSALGIVLVATITLYSIYKKLKTSK

SEQ ID NO: 53 - protein, 450 aa, Streptococcus agalactiae
MTRTNYQKKRMTCPVETEDITYRRKKIKGRRQAILAQFEPELVHHELIGDSCTCPDCHGTLTEIGSVVQRQELVFIPAQLKRINHVQHAYKCQTCSDNSLSDKIIKAPVPKAPLAHSLGSASIIAHTVHQKFTLKVPNYRQEEDWNKLGLSISRKEIANWHIKSSQYYFEPLYDLLRDILLSQEVIHADETSYRVLESDTQLTYYWTFLSGKHEKKGITLYHHDKRRSGLVTQEVLGDYSGYVHCDMHGAYRQLEHAKLVGCWAHVRRKFFEATPKQADKTSLGRKGLVYCDKLFALEAEWCELPPQERLVKRKEILTPLMTTFFDWCREQVVLSGSKLGLAIAYSLKHERTFRTVLEDGHIVLSNNMAERAIKSLVMGRKNWLFSQSFEGAKAAAIIMSLLETAKRHGLNSEKYISYLLDRLPNEETLAKREVLEAYLPWAKKVQTNCQ

SEQ ID NO: 54 - protein, 116 aa, Streptococcus agalactiae
MTIRLNDLGQVYLVCGKTDMRQGIDSLAYLVKSQHELDLFSGAVYLFCGGRRDRFKALYWDGQGFWLLYKRFENGKLAWPRNRDEVKCLTAVQVDWLMKGFFISPNIKISKSHDFY

SEQ ID NO: 55 - protein, 251 aa, Streptococcus agalactiae
MECYRDRQLLSTYHKQVTQKKPSEMEEVWQKAKAYNARLGIQPVPDAFSFRDGIHDKNYESLLQIENNDIMGYVEVPSIKVTLPIYHYTTDEVLTKGAGHLFGSALPVGGDGTHTVISAHRGLPSAEMFTNLNLVKKGDTFYFRVLNKVLAYKVDQILTVEPDQVTSLSGVMGKDYATLVTCTPYGVNTKRLLVRGHRIAYHYKKYQQAKKAMKLVDKSRMWAEVVCAAFGVVIAIILVFMYSRVSAKKSK

SEQ ID NO: 56 - protein, 511 aa, Streptococcus agalactiae
MPYVKKKKDSFLVETYLEQSIRDKSELVLLLFKSPTIIFSHVAKQTGLTAVQLKYYCKELDDFFGNNLDITIKKGKIICCFVKPVKEFYLHQLYDTSTILKLLVFFIKNGTSSQPLIKFSKKYFLSSSSAYRLRESLIKLLREFGLRVSKNTIVGEEYRIRYLIAMLYSKFGIVIYPLDHLDNQIIYRFLSQSATNLRTSPWLEEPFSFYNMLLALSWKRHQFAVSIPQTRIFRQLKKLFIYDCLTRSSRQVIENAFSLTFSQGDLEYLFLIYITTNNSFASLQWTPQHIETCCHIFEKNDTFRLLLEPILKRLPQLNHSKQDLIKALMYFSKSFLFNLQHFVIEIPSFSLPTYTGNSNLYKALKNIVNQWLAQLPGKRHLNEKHLQLFCSHIEQILKNKQPALTVVLISSNFINAKLLTDTIPRYFSDKGIHFYSFYLLRDDIYQIPSLKPDLVITHSRLIPFVKNDLVKGVTVAEFSFDNPDYSIASIQNLIYQLKDKKYQDFLNEQLQ

SEQ ID NO: 57 - protein, 744 aa, Streptococcus agalactiae
MQKRDKTNYGSANNKRRQTTIGLLKVFLTFVALIGIVGFSIRAFGAEEQSVPNKQSSVQDYPWYGYDSYSKGYPDYSPLKTYHNLKVNLDGSKEYQAYCFNLTKHFPSKSDSVRSQWYKKLEGTNENFIKLADKPRIEDGQLQQNILRILYNGYPNDRNGIMKGIDPLNAILVTQNAIWYYTDSSYISDTSKAFQQEETDLKLDSQQLQLMRNALKRLINPKEVESLPNQVPANYQLSIFQSSDKTFQNLLSAEYVPDTPPKPGEEPPAKTEKTSVIIRKYAEGDYSKLLEGATLKLAQIEGSGFQEKIFDSNKSGEKVELPNGTYVLSELKPPQGYGVATPITFKVAAEKVLIKNKEGQFVENQNKEIAEPYSVTAFNDFEEIGYLSDFNNYGKFYYAKNTNGTNQVVYCFNADLHSPPDSYDHGANIDPDVSESKEIKYTHVSGYDLYKYAATPRDKDADFFLKHIKKILDKGYKKKGDTYKTLTEAQFRAATQLAIYYYTDSADLTTLKTYNDNKGYHGFDKLDDATLAVVHELITYAEDVTLPMTQNLDFFVPNSSRYQALIGTQYHPNELIDVISMEDKQAPIIPITHKLTISKTVTGTIADKKKEFNFEIHLKSSDGQAISGTYPTNSGELTVTDGKATFTLKDGESLIVEGLPSGYSYEITETGASDYEVSVNGKNAPDGKATKASVKEDETVAFENRKDLVPPTGLTTDGAIYLWLLLLVPFGLLVWLFGRKGTKK

SEQ ID NO: 58 - protein, 173 aa, Streptococcus agalactiae
MTNYLNRLNENPLLKAFIRLVLKISIIGFLGYILFQYVFGVMIVNTNQMSPAVSAGDGVLYYRLTDRYHINDVVVYEVDDTLKVGRIAAQAGDEVNFTQEGGLLINGHPPEKEVPYLTYPHSSGPNFPYKVPTGTYFILNDYREERLDSRYYGALPINQIKGKISTLLRVRGI

SEQ ID NO: 59 - protein, 344 aa, Streptococcus agalactiae
MKKNKLLLATAILATALGTASLNQNVKAETAGVSENAKLIVKKTFDSYTDNEVLMPKADYTFKVEADSTASGKTKDGLEIKPGIVNGLTEQIISYTNTDKPDSKVKSTEFDFSKVVFPGIGVYRYTVSEKQGDVEGITYDTKKWTVDVYVGNKEGGGFEPKFIVSKEQGTDVKKPVNFNNSFATTSLKVKKNVSGNTGELQKEFDFTLTLNESTNFKKDQIVSLQKGNEKFEVKIGTPYKFKLKNGESIQLDKLPVGITYKVNEMEANKDGYKTTASLKEGDGQSKMYQLDMEQKTDESADEIVVTNKRDTQVPTGVVGTLAPFAVLSIVAIGGVIYITKRKKA

SEQ ID NO: 60 - protein, 239 aa, Streptococcus agalactiae
MTIVQVINKAIDTLILIFCLVVLFLAGFGLWDSYHLYQQADASNFKKFKTAQQQPKFEDLLALNEDVIGWLNIPGTHIDYPLVQGKTNLEYINKAVDGSVAMSGSLFLDTRNHNDFTDDYSLIYGHHMAGNAMFGEIPKFLKKDFFSKHNKAIIETKERKKLTVTIFACLKTDAFNQLVFNPNAITNQDQQRQLVDYISKRSKQFKPVKLKHHTKFVAFSTCENFSTDNRVIVVGTIQE

SEQ ID NO: 61 - protein, 183 aa, Streptococcus agalactiae
MILTMLAFNQTVLAKDSTVQTSISVENVLERAGDSTPFSIALESIDAMKTIEEITIAGSGKASFSPLTFTTVGQYTYRVYQKPSQNKDYQADTTVFDVLVYVTYDEDGTLVAKVISRRAGDEEKSAITFKPKWLVKPIPPRQPNIPKTPLPLAGEVKSLLGILSIVLLGLLVLLYVKKLKSRL

SEQ ID NO: 62 - protein, 401 aa, Streptococcus agalactiae
MVRFDLKHVQTLHSLSQLPISVMSQDKALIQVYGNDDYLLCYYQFLKHLAIPQAAQDVIFYEGLFEESFMIFPLCHYIIAIGPFYPYSLNKDYQEQLANNCLKHSSHRSKEELLSYMALVPHFPINNVRNLLIAIDAFFDTQFETTCQQTIHQLLQHSKQMTADPDIIHRLKHISKASSQLPPVLEHLNHIMDLVKLGNPQLLKQEINRIPLSSITSSSISALRAEKNLTVIYLTRLLEFSFVENTDVAKHYSLVKYYMALNEEASDLLKVLRIRCAAIIHFSESLTNKSISDKRQMYNSVLHYVDSHLYSKLKVSDIAKRLYVSESHLRSVFKKYSNVSLQHYILSTKIKEAQLLLKRGIPVGEVAKSLYFYDTTHFHKIFKKYTGISSKDYLAKYRDNI

SEQ ID NO: 63 - protein, 656 aa, Streptococcus agalactiae
MSSSDEETLKQYASKYTSNRRGDTSGNLKKQIAKVLTEGYPTNKSDWLNGLTENEKIEVTQDAIWYFTETTVPADRSYTNRNVNSQKMKEVYQKLIDTTDIDKYEDVQFDLFVPQDTNLQAVISVEPVIESLPWTSLKPIAQKDITAKKIWVDAPKEKPIIYFKLYRQLPGEKEVAVDDAELKQINSEGQQEISVTWTNQLVTDEKGMAYIYSVKEVDKNGELLEPKDYIKKEDGLTVTNTYVKPTSGHYDIEVTFGNGHIDITEDTTPDIVSGENQMKQIEGEDSKPIDEVTENNLIEFGKNTMPGEEDGTNSNKYEEVEDSRPVDTLSGLSSEQGQSGDMTIEEDSATHIKFSKRDIDGKELAGATMELRDSSGKTISTWISDGQVKDFYLMPGKYTFVETAAPDGYEVATAITFTVNEQGQVTVNGKATKGDAHIVMVDAYKPTKGSGQVIDIEEKLPDEQGHSGSTTEIEDSKSSDVIIGGQGEVVDTTEDTQSGMTGHSGSTTEIEDSKSSDVIIGGQGEVVDTTEDTQSGMTGHSGSTTKIEDSKSSDVIVGGQGQIVETTEDTQTGMHGDSGRKTEVEDTKLVQSFHFDNKEPESNSEIPKKDKSKSNTSLPATGEKQHNKFFWMVTSCSLISSVFVISLKSKKRLSSC

SEQ ID NO: 64 - protein, 511 aa, Streptococcus agalactiae; identical to SEQ ID NO: 56

SEQ ID NO: 65 - protein, 744 aa, Streptococcus agalactiae; identical to SEQ ID NO: 57

SEQ ID NO: 66 - protein, 173 aa, Streptococcus agalactiae; identical to SEQ ID NO: 58

SEQ ID NO: 67 - protein, 349 aa, Streptococcus agalactiae
MEREKMKKNKLLLATAILATALGTASLNQNVKAETAGVSENAKLIVKKTFDSYTDNEVLMPKADYTFKVEADSTASGKTKDGLEIKPGIVNGLTEQIISYTNTDKPDSKVKSTEFDFSKVVFPGIGVYRYTVSEKQGDVEGITYDTKKWTVDVYVGNKEGGGFEPKFIVSKEQGTDVKKPVNFNNSFATTSLKVKKNVSGNTGELQKEFDFTLTLNESTNFKKDQIVSLQKGNEKFEVKIGTPYKFKLKNGESIQLDKLPVGITYKVNEMEANKDGYKTTASLKEGDGQSKMYQLDMEQKTDESADEIVVTNKRDTQVPTGVVGTLAPFAVLSIVAIGGVIYITKRKKA

SEQ ID NO: 68 - protein, 241 aa, Streptococcus agalactiae
MVMTIVQVINKAIDTLILIFCLVVLFLAGFGLWDSYHLYQQADASNFKKFKTAQQQPKFEDLLALNEDVIGWLNIPGTHIDYPLVQGKTNLEYINKAVDGSVAMSGSLFLDTRNHNDFTDDYSLIYGHHMAGNAMFGEIPKFLKKDFFSKHNKAIIETKERKKLTVTIFACLKTDAFNQLVFNPNAITNQDQQRQLVDYISKRSKQFKPVKLKHHTKFVAFSTCENFSTDNRVIVVGTIQE

SEQ ID NO: 69 - protein, 189 aa, Streptococcus agalactiae
MLFSVVMILTMLAFNQTVLAKDSTVQTSISVENVLERAGDSTPFSIALESIDAMKTIEEITIAGSGKASFSPLTFTTVGQYTYRVYQKPSQNKDYQADTTVFDVLVYVTYDEDGTLVAKVISRRAGDEEKSAITFKPKWLVKPIPPRQPNIPKTPLPLAGEVKSLLGILSIVLLGLLVLLYVKKLKSRL

SEQ ID NO: 70 - protein, 285 aa, Streptococcus agalactiae
MALVPHFPINNVRNLLIAIDAFFDTQFETTCQQTIHQLLQHSKQMTADPDIIHRLKHISKASSQLPPVLEHLNHIMDLVKLGNPQLLKQEINRIPLSSITSSSISALRAEKNLTVIYLTRLLEFSFVENTDVAKHYSLVKYYMALNEEASDLLKVLRIRCAAIIHFSESLTNKSISDKRQMYNSVLHYVDSHLYSKLKVSDIAKRLYVSESHLRSVFKKYSNVSLQHYILSTKIKEAQLLLKRGIPVGEVAKSLYFYDTTHFHKIFKKYTGISSKDYLAKYRDNI

SEQ ID NO: 71 - protein, 733 aa, Streptococcus agalactiae
MTQKNSYKLSFLLSLTGFILGLLLVFIGLSGVSVGHAETRNGANKQGAFEIKKNKSQEEYNYEVYDNRNILQDGEHKLEIKRVDGTGKTYQGFCFQLTKNFPTAQGVSKKLYKKLSSSDEETLKQYASKYTSNRRGDTSGNLKKQIAKVLTEGYPTNKSDWLNGLTENEKIEVTQDAIWYFTETTVPADRSYTNRNVNSQKMKEVYQKLIDTTDIDKYEDVQFDLFVPQDTNLQAVISVEPVIESLPWTSLKPIAQKDITAKKIWVDAPKEKPIIYFKLYRQLPGEKEVAVDDAELKQINSEGQQEISVTWTNQLVTDEKGMAYIYSVKEVDKNGELLEPKDYIKKEDGLTVTNTYVKPTSGHYDIEVTFGNGHIDITEDTTPDIVSGENQMKQIEGEDSKPIDEVTENNLIEFGKNTMPGEEDGTNSNKYEEVEDSRPVDTLSGLSSEQGQSGDMTIEEDSATHIKFSKRDIDGKELAGATMELRDSSGKTISTWISDGQVKDFYLMPGKYTFVETAAPDGYEVATAITFTVNEQGQVTVNGKATKGDAHIVMVDAYKPTKGSGQVIDIEEKLPDEQGHSGSTTEIEDSKSSDVIIGGQGEVVDTTEDTQSGMTGHSGSTTKIEDSKSSDVIVGGQGQIVETTEDTQTGMHGDSGRKTEVEDTKLVQSFHFDNKEPESNSEIPKKDKSKSNTSLPATGEKQHNKFFWMVTSCSLISSVFVISLKSKKRLSSC

SEQ ID NO: 72 - protein, 217 aa, Streptococcus agalactiae
MPYVKKKKDSFLVETYLEQSIRDKSELVLLLFKSPTIIFSHVAKQTGLTAVQLKYYCKELDDFFGNNLDITIKKGKIICCFVKPVKEFYLHQLYDTSTILKLLVFFIKNGTTSQPLIKFSKKYFLSSSSAYRLRESLIKLLREFGLRVSKNTIVGEEYRIRYLIAMLYSKFGIVIYPLDHLDNQIIYRFLSQSATNLRTSPWLEEPFSFYNMLLALS

SEQ ID NO: 73 - protein, 524 aa, Streptococcus agalactiae
MQKRDKTNYGSANNKRRQTTIGLLKVFLTFVALIGIVGFSIRAFGAEEQSTETKKTSVIIRKYAEGDYSKLLEGATLKLAQIEGSGFQEQSFESSTSGQKLQLSDGTYILTETKSPQGYEIAEPITFKVTAGKVFIKGKDGQFVENQNKEVAEPYSVTAYNDFDDSGFINPKTFTPYGKFYYAKNANGTSQVVYCFNVDLHSPPDSLDKGETIDPDFNEGKEIKYTHILGADLFSYANNPRASTNDELLSQVKKVLEKGYRDDSTTYANLTSVEFRAATQLAIYYFTDSVDLDNLADYHGFGALTTEALNATKEIVAYAEDRANLPNISNLDFYVPNSNKYQSLIGTQYHPESLVDIIRMEDKQAPIIPITHKLTISKTVTGTIADKKKEFNFEIHLKSSDGQAISGTYPTNSGELTVTDGKATFTLKDGESLIVEGLPSGYSYEITETGASDYEVSVNGKNAPDGKATKASVKEDETITFENRKDLVPPTGLTTDGAIYLWLLLLVLLGLWVWLIGRKGLKND

SEQ ID NO: 74 - protein, 173 aa, Streptococcus agalactiae
MTNYLNRLNENPLFKAFIRLVLKISIIGFLGYILFQYIFGVMIINTNVMSPALSAGDGILYYRLTDRYHINDVVVYEVDNTLKVGRIVAQAGDEVSFTQEGGLLINGHPPEKEVPYLTYPHSSGPNFPYKVPTGTYFILNDYREERLDSRYYGALPINQIKGKISTLLRVRGI

SEQ ID NO: 75 - protein, 344 aa, Streptococcus agalactiae
MKKNKLLLATAILATALGTASLNQNVKAETAGVIDGSTLVVKKTFPSYTDDKVLMPKADYTFKVEADDNAKGKTKDGLDIKPGVIDGLENTKTIHYGNSDKTTAKEKSVNFDFANVKFPGVGVYRYTVSEVNGNKAGIAYDSQQWTVDVYVVNREDGGFEAKYIVSTEGGQSDKKPVLFKNFFDTTSLKVTKKVTGNTGEHQRSFSFTLLLTPNECFEKGQVVNILQGGETKKVVIGEEYSFTLKDKESVTLSQLPVGIEYKVTEEDVTKDGYKTSATLKDGDVTDGYNLGDSKTTDKSTDEIVVTNKRDTQVPTGVVGTLAPFAVLSIVAIGGVIYITKRKKA

SEQ ID NO: 76 - protein, 246 aa, Streptococcus agalactiae
MISQRMMMTIVQVINKAIDTLILIFCLVVLFLAGFGLWDSYHLYQQADASNFKKFKTAQQQPKFEDLLALNEDVIGWLNIPGTHMDYPLVQGKTNLEYINKAVDGSVAMSGSLFLDTRNHNDFTDDYSLIYGHHMAGNAMFGEIPKFLKKDFFNKHNKAIIETKERKKLTVTIFACLKTDAFDQLVFNPNAITNQDQQRQLVDYISKRSKQFKPVKLKHHTKFVAFSTCENFSTDNRVIVVGTIQE

SEQ ID NO: 77 - protein, 195 aa, Streptococcus agalactiae
MRKYWKMLFSVVMILTMLAFNQTVLAKDSTVQTSISVENVLERAGDSTSFSVALESIDAMKTIDEITIAGSGKASFSPLTFTTVGQYTYRVYQKPSQNKDYQADTTVFDVLVYVTYDEDGTLVAKVISRRAGDEEKSAITFKPKRLVKPIPPRQPDIPKTPLPLAGEVKSLLGILSIVLLGLLVLLYVKKLKSRL

SEQ ID NO: 78 - protein, 401 aa, Streptococcus agalactiae
MAIFDLKHVQTLHSLSQLPISVMSQDKALIQVYGNDDYLLCYYQFLKHLAIPQAAQDVIFYEGLFEESFMIFPLCHYIIAIGPFYPYSLNKDYQEQLANNCLKHSSHRSKEELLSYMALVPHFPINNVRNLLIAIDAFFDTQFETTCQQTIHQLLQHSKQMTADPDIIHRLKHISKASSQLPPVLEHLNHIMDLVKLGNPQLLKQEINRIPLSSITSSSISALRAEKNLTVIYLTRLLEFSFVENTDVAKHYSLVKYYMALNEEASDLLKVLRIRCAAIIHFSESLTNKSISDKRQMYNSVLHYVDSHLYSKLKVSDIAKRLYVSESHLRSVFKKYSNVSLQHYILSTKIKEAQLLLKRGIPVGEVAKSLYFYDTTHFHKIFKKYTGISSKDYLAKYRDNI

SEQ ID NO: 79 - protein, 696 aa, Streptococcus agalactiae
MTQKNSYKLSFLLSLTGFILGLLLVFIGLSGVSVGHAETRNGANKQGAFEIKKNKSQEEYNYEVYDNRNILQDGEHKLEIKRVDGTGKTYQGFCFQLTKNFPTAQGVSKKLYKKLSSSDEETLKQYASKYTSNRRGDTSGNLKKQIAKVLTEGYPTNKSDWLNGLTENEKIEVTQDAIWYFTETTVPADRSYTNRNVNSQKMKEVYQKLIDTTDIDKYEDVQFDLFVPQDTNLQAVISVEPVIESLPWTSLKPIAQKDITAKKIWVDAPKEKPIIYFKLYRQLPGEKEVAVDDAELKQINSEGQQEISVTWTNQLVTDEKGMAYIYSVKEVDKNGELLEPKDYIKKEDGLTVTNTYVKPTSGHYDIEVTFGNGHIDITEDTTPDIVSGENQMKQIEGEDSKPIDEVTENNLIEFGKNTMPGEEDGTNSNKYEEVEDSRPVDTLSGLSSEQGQSGDMTIEEDSATHIKFSKRDIDGKELAGATMELRDSSGKTISTWISDGQVKDFYLMPGKYTFVETAAPDGYEIATAITFTVNEQGQVTVNGKATKGDAHIVMVDAYKPTKGSGQVIDIEEKLPDEQGHSGSTTEIEDSKSSDVIIGGQGQIVETTEDTQTGMHGDSGCKTEVEDTKLVQSFHFDNKESESNSEIPKKDKPKSNTSLPATGEKQHNMFFWMVTSCSLISSVFVISLKTKKRLSSC

SEQ ID NO: 80 - protein, 283 aa, Streptococcus pneumoniae
MSRTKLRALLGYLLMLVACLIPIYCFGQMVLQSLGQVKGHATFVKSMTTEMYQEQQNHSLAYNQRLASQNRIVDPFLAEGYEVNYQVSDDPDAVYGYLSIPSLEIMEPVYLGADYHHLGMGLAHVDGTPLPLDGTGIRSVIAGHRAEPSHVFFRHLDQLKVGDALYYDNGQEIVEYQMMDTEIILPSEWEKLESVSSKNIMTLITCDPIPTFNKRLLVNFERVAVYQKSDPQTAAVARVAFTKEGQSVSRVATSQWLYRGLVVLAFLGILFVLWKLARLLRGK

SEQ ID NO: 81 - protein, 261 aa, Streptococcus pneumoniae
MSRYYYRIESNEVIKEFDETVSQMDKAELEERWRLAQAFNATLKPSEILDPFTEQEKKKGVSEYANMLKVHERIGYVEIPAIDQEIPMYVGTSEDILQKGAGLLEGASLPVGGENTHTVITAHRGLPTAELFSQLDKMKKGDIFYLHVLDQVLAYQVDQIVTVEPNDFEPVLIQHGEDYATLLTCTPYMINSHRLLVRGKRIPYTAPIAERNRAVRERGQFWLWLLLGAMAVILLLLYRVYRNRRIVKGLEKQLEGRHVKD

SEQ ID NO: 82 - protein, 279 aa, Streptococcus pneumoniae
MAVMAYPLVSRLYYRVESNQQIADFDKEKATLDEADIDERMKLAQAFNDSLNNVVSGDPWSEEMKKKGRAEYARMLEIHERMGHVEIPVIDVDLPVYAGTAEEVLQQGAGHLEGTSLPIGGNSTHAVITAHTGLPTAKMFTDLTKLKVGDKFYVHNIKEVMAYQVDQVKVIEPTNFDDLLIVPGHDYVTLLTCTPYMINTHRLLVRGHRIPYVAEVEEEFIAANKLSHLYRYLFYVAVGLIVILLWIIRRLRKKKKQPEKALKALKAARKEVKVEDGQQ

SEQ ID NO: 83 - protein, 43 aa, Streptococcus pneumoniae
MFLPFLSASLYLQTHHFIAFPNRQSYLLRETRKSHFFLIHHPF

SEQ ID NO: 84 - protein, 393 aa, Streptococcus pneumoniae
MISRIFFVMALCFSLVWGAHAVQAQEDHTLVLQLENYQEVVSQLPSRDGHRLQVWKLDDSYSYDDRVQIVRDLHSWDENKLSSFKKTSFEMTFLENQIEVSHIPNGLYYVRSIIQTDAVSYPAEFLFEMTDQTVEPLVIVAKKTDTMTTKVKLIKVDQDHNRLEGVGFKLVSVARDVSEKEVPLIGEYRYSSSGQVGRTLYTDKNGEIFVTNLPLGNYRFKEVEPLAGYAVTTLDTDVQLVDHQLVTITVVNQKLPRGNVDFMKVDGRTNTSLQGAMFKVMKEESGHYTPVLQNGKEVVVTSGKDGRFRVEGLEYGTYYLWELQAPTGYVQLTSPVSFTIGKDTRKELVTVVKNNKRPRIDVPDTGEETLYILMLVAILLFGSGYYLTKKPNN

SEQ ID NO: 85 - protein, 665 aa, Streptococcus pneumoniae
MKSINKFLTMLAALLLTASSLFSAATVFAAGTTTTSVTVHKLLATDGDMDKIANELETGNYAGNKVGVLPANAKEIAGVMFVWTNTNNEIIDENGQTLGVNIDPQTFKLSGAMPATAMKKLTEAEGAKFNTANLPAAKYKIYEIHSLSTYVGEDGATLTGSKAVPIEIELPLNDVVDAHVYPKNTEAKPKIDKDFKGKANPDTPRVDKDTPVNHQVGDVVEYEIVTKIPALANYATANWSDRMTEGLAFNKGTVKVTVDDVALEAGDYALTEVATGFDLKLTDAGLAKVNDQNAEKTVKITYSATLNDKAIVEVPESNDVTFNYGNNPDHGNTPKPNKPNENGDLTLTKTWVDATGAPIPAGAEATFDLVNAQTGKVVQTVTLTTDKNTVTVNGLDKNTEYKFVERSIKGYSADYQEITTAGEIAVKNWKDENPKPLDPTEPKVVTYGKKFVKVNDKDNRLAGAEFVIANADNAGQYLARKADKVSQEEKQLVVTTKDALDRAVAAYNALTAQQQTQQEKEKVDKAQAAYNAAVIAANNAFEWVADKDNENVVKLVSDAQGRFEITGLLAGTYYLEETKQPAGYALLTSRQKFEVTATSYSATGQGIEYTAGSGKDDATKVVNKKITIPQTGGIGTIIFAVAGAAIMGIAVYAYVKNNKDEDQLA

SEQ ID NO: 86 - protein, 893 aa, Streptococcus pneumoniae
MLNRETHMKKVRKIFQKAVAGLCCISQLTAFSSIVALAETPETSPAIGKVVIKETGEGGALLGDAVFELKNNTDGTTVSQRTEAQTGEAIFSNIKPGTYTLTEAQPPVGYKPSTKQWTVEVEKNGRTTVQGEQVENREEALSDQYPQTGTYPDVQTPYQIIKVDGSEKNGQHKALNPNPYERVIPEGTLSKRIYQVNNLDDNQYGIELTVSGKTVYEQKDKSVPLDVVILLDNSNSMSNIRNKNARRAERAGEATRSLIDKITSDSENRVALVTYASTIFDGTEFTVEKGVADKNGKRLNDSLFWNYDQTSFTTNTKDYSYLKLTNDKNDIVELKNKVPTEAEDHDGNRLMYQFGATFTQKALMKADEILTQQARQNSQKVIFHITDGVPTMSYPINFNHATFAPSYQNQLNAFFSKSPNKDGILLSDFITQATSGEHTIVRGDGQSYQMFTDKTVYEKGAPAAFPVKPEKYSEMKAAGYAVIGDPINGGYIWLNWRESILAYPFNSNTAKITNHGDPTRWYYNGNIAPDGYDVFTVGIGINGDPGTDEATATSFMQSISSKPENYTNVTDTTKILEQLNRYFHTIVTEKKSIENGTITDPMGELIDLQLGTDGRFDPADYTLTANDGSRLENGQAVGGPQNDGGLLKNAKVLYDTTEKRIRVTGLYLGTDEKVTLTYNVRLNDEFVSNKFYDTNGRTTLHPKEVEQNTVRDFPIPKIRDVRKYPEITISKEKKLGDIEFIKVNKNDKKPLRGAVFSLQKQHPDYPDIYGAIDQNGTYQNVRTGEDGKLTFKNLSDGKYRLFENSEPAGYKPVQNKPIVAFQIVNGEVRDVTSIVPQDIPAGYEFTNDKHYITNEPIPPKREYPRTGGIGMLPFYLIGCMMMGGVLLYTRKHP

SEQ ID NO: 87 - protein, 509 aa, Streptococcus pneumoniae
MLNKYIEKRITDKITILNILLDIRSIELDELSTLTSLQSKSLLSILQELQETFEEELTFNLDTQQVQLIEHHSHQTNYYFHQLYNQSTILKILRFFLLQGNQSFNEFTQKEYISIATGYRVRQKCGLLLRSVGLDLVKNQVVGPEYRIRFLIALLQFHFGIEIYDLNDGSMDWVTHMIVQSNSQLSHELLEITPDEYVHFSILVALTWKRREFPLEFPESKEFEKLKNLFMYPILMEHCQTYLEPHANMTFTQEELDYIFLVYCSANSSFSKDKWNQEKKTHTIQLILQHTRGKHLLSKFKNILGNDISNSLSFLTALTFLTRTFLFGLQNLVPYYNYYEHYGIESDKPLYHISKAIVQEWMTEQKIEGVIDQHRLYLFSLYLTETIFSSLPAIPIFIILNNQADVNLIKSIILRNFTDKVASVTGYNILISPPPSEEHLTEPLIIITTKEYLPYVKKQYPKGKHHFLTIALDLHVSQQRLIYQTIVDIRKEAFDKRVAMIAKKAHYLL

SEQ ID NO: 88 - DNA, 1533 bp, Streptococcus agalactiae
atgccttatgtcaaaaagaaaaaggatagtttcttagtagaaacatatcttgaacagtctattagagataaaagtgaattagtcttactgttatttaaatcgcctactatcattttttctcatgttgctaaacaaactggtctgacggctgtacaattaaaatattactgtaaagaacttgatgacttttttggaaataatttagacattaccattaaaaagggcaaaataatatgttgttttgtcaaacctgttaaggaattctaccttcatcaactctatgacacatcaacaatattaaaattattagttttctttattaaaaatggaacgtcatcacaacctctgattaaattttcaaaaaagtattttctatcaagctcctcagcttatcgactacgggaatcgctgatcaaattactacgggaatttggcttgagagtctcaaaaaatacaattgtcggagaggaatatcgtattcgctatcttattgccatgctatatagtaaatttggcattgtcatctatccgttagatcatctagacaatcaaattatttatcgcttcttatcacaaagtgcaaccaatttaagaacatcgccctggctagaggaacctttttctttttataatatgttacttgccttgtcatggaaacgtcaccaatttgcagttagcattcctcaaacacgtatttttcgacaattaaaaaagctttttatctatgattgtttaactcgaagcagtcgacaagtaatcgaaaatgctttttcgttaatgttctcacaaggagatctcgattatctttttttaatttatattaccaccaataattcctttgccagcctacaatggactccacagcatattgaaacttgctgccatatttttgaaaaaaatgacacatttcggttattgttagagcccattcttaaacgtttaccgcaattaaaccattctaaacaagaccttattaaagcccttatgtatttttcaaaatcttttctatttaacctccaacatttcgtcatcgagattccttctttttccttgccgacctatacaggcaactctaatctttacaaagctttaaaaaatattgtaaatcagtggcttgctcaattacccggaaagcgtcatcttaacgaaaagcatctccaacttttttgctctcatattgaacaaatcttaaaaaataaacaacctgctttaactgtcgttttaatatctagtaactttataaatgctaaactccttacagatactatcccacgatatttttctgataaaggaattcatttttattctttttacttattaagagatgatatctatcaaattccaagcttaaaaccagatttagttatcactcatagccgattaattccttttgttaagaatgatctggtcaaaggtgttactgttgctgaattttcttttgataaccctgactactctattgcttcaattcaaaacttgatatatcagctcaaagataaaaaatatcaagattttctaaacgagcaattacaa

SEQ ID NO: 89 - protein, 511 aa, Streptococcus agalactiae
MPYVKKKKDSFLVETYLEQSIRDKSELVLLLFKSPTIIFSHVAKQTGLTAVQLKYYCKELDDFFGNNLDITIKKGKIICCFVKPVKEFYLHQLYDTSTILKLLVFFIKNGTSSQPLIKFSKKYFLSSSSAYRLRESLIKLLREFGLRVSKNTIVGEEYRIRYLIAMLYSKFGIVIYPLDHLDNQIIYRFLSQSATNLRTSPWLEEPFSFYNMLLALSWKRHQFAVSIPQTRIFRQLKKLFIYDCLTRSSRQVIENAFSLMFSQGDLDYLFLIYITTNNSFASLQWTPQHIETCCHIFEKNDTFRLLLEPILKRLPQLNHSKQDLIKALMYFSKSFLFNLQHFVIEIPSFSLPTYTGNSNLYKALKNIVNQWLAQLPGKRHLNEKHLQLFCSHIEQILKNKQPALTVVLISSNFINAKLLTDTIPRYFSDKGIHFYSFYLLRDDIYQIPSLKPDLVITHSRLIPFVKNDLVKGVTVAEFSFDNPDYSIASIQNLIYQLKDKKYQDFLNEQLQ

SEQ ID NO: 90 - DNA, 1569 bp, Streptococcus agalactiae
ttgcaaaagagggataaaaccaattatggaagcgctaacaacaaacgacgacaaacgacgatcggattactgaaagtatttttgacgtttgtagctctgataggaatagtagggttttctatcagagcgttcggagctgaagaaaaatctactgaaactaaaaaaacgtcagtcattattagaaaatatgctgaaggtgactactctaaacttctagagggagcaactttgcgtttaacaggggaagatatcccagattttcaagaaaaagtcttccaaagtaatggaacaggagaaaagattgaattatcaaatgggacttataccttaacagaaacatcatctccagatggatataaaattacggagccgattaagtttagagtagtgaataaaaaagtatttatcgtccaaaaagatggttctcaagtggaaaacccaaacaaagaactaggttctccatatactatagaggcatacaatgattttgatgaatttggcttactgtcaacacaaaattatgcgaaattttattatggaaaaaactatgatggcagttcacaaattgtttattgcttcaatgccaacttgaaatctccacctgactcggaagatcatggtgctacaataaatcctgactttacgactggtgatattaggtacagtcatattgctggttcagatttgataaaatacgctaatacagctagggatgaagatcctcaattatttttaaaacacgtaaaaaaagtaattgaaaatgggtatcataaaaaaggtcaagctattccatataacggtctgactgaggcacagtttcgtgcggctactcaactggcaatttattattttacagatagtgttgacttaactaaggatagattgaaagacttccatggatttggagatatgaatgatcaaactttgggtgtagctaaaaaaattgtagaatacgctttgagtgatgaagattcaaaactaacaaatcttgatttcttcgtacctaataatagcaaataccaatctcttattgggacagaataccatccagatgatttggttgacgtgattcgtatggaagataaaaagcaagaagttattccagtaactcatagtttgacggtgcaaaaaacagtagtcggtgagttgggagataagactaaaggctttcaatttgaacttgagttgaaagataaaactggacagcctattgttaacactctaaaaactaataatcaagatttagtagctaaagatgggaaatattcatttaatctaaagcatggtgacaccataagaatagaaggattaccgacgggatattcttataccctgaaagagactgaagctaaggattatatagtaactgttgataacaaagttagtcaagaagctcaatcagcaagtgagaatgtcacagcagacaaagaagtcacttttgaaaaccgaaaagatcttgtcccaccaactggtttgacaacagatggggctatctatctttggttattactacttgttccatttgggttattggtttggctatttggtcgtaaagggttaaaaaatgac

SEQ ID NO: 91 - protein, 523 aa, Streptococcus agalactiae
MQKRDKTNYGSANNKRRQTTIGLLKVFLTFVALIGIVGFSIRAFGAEEKSTETKKTSVIIRKYAEGDYSKLLEGATLRLTGEDIPDFQEKVFQSNGTGEKIELSNGTYTLTETSSPDGYKITEPIKFRVVNKKVFIVQKDGSQVENPNKELGSPYTIEAYNDFDEFGLLSTQNYAKFYYGKNYDGSSQIVYCFNANLKSPPDSEDHGATINPDFTTGDIRYSHIAGSDLIKYANTARDEDPQLFLKHVKKVIENGYHKKGQAIPYNGLTEAQFRAATQLAIYYFTDSVDLTKDRLKDFHGFGDMNDQTLGVAKKIVEYALSDEDSKLTNLDFFVPNNSKYQSLIGTEYHPDDLVDVIRMEDKKQEVIPVTHSLTVQKTVVGELGDKTKGFQFELELKDKTGQPIVNTLKTNNQDLVAKDGKYSFNLKHGDTIRIEGLPTGYSYTLKETEAKDYIVTVDNKVSQEAQSASENVTADKEVTFENRKDLVPPTGLTTDGAIYLWLLLLVPFGLLVWLFGRKGLKND

SEQ ID NO: 92 - DNA, 519 bp, Streptococcus agalactiae
atgactaattacctaaatcgtttaaatgagaattcactatttaaagctttcatacggttagtacttaagatttctattattgggtttctaggttacattctatttcagtatgtttttggtgttatgattattaacactaatgatatgagtcctgctttaagtgcaggtgacggtgttttatattatcgtttgactgatcgctatcatattaatgatgtggtggtctatgaggttgataacactttgaaagttggtcgaattgtcgctcaagctggcgatgaggttagttttacgcaagaaggaggactgttgattaatgggcatccaccagaaaaagaggtcccttacctgacgtatcctcactcaagtggcccaaactttccctataaagttcctacgggtaagtatttcatattgaatgattatcgtgaagaacgtttggacagtcgttattatggggcgttacccgtcaatcaaataaaagggaaaatctcaactctattaagagtgagaggaatt

SEQ ID NO: 93 - protein, 173 aa, Streptococcus agalactiae
MTNYLNRLNENSLFKAFIRLVLKISIIGFLGYILFQYVFGVMIINTNDMSPALSAGDGVLYYRLTDRYHINDVVVYEVDNTLKVGRIVAQAGDEVSFTQEGGLLINGHPPEKEVPYLTYPHSSGPNFPYKVPTGKYFILNDYREERLDSRYYGALPVNQIKGKISTLLRVRGI

SEQ ID NO: 94 - DNA, 1056 bp, Streptococcus agalactiae
ttggagagagaaaaaatgaaaaaaaacaaattattacttgctactgcaatcttagcaactgctttaggaacagcttctttaaatcaaaacgtaaaagctgagacggcaggggttgtaacaggaaaatcactacaagttacaaagacaatgacttatgatgatgaagaggtgttaatgcccgaaaccgcctttacttttactatagagcctgatatgactgcaagtggaaaagaaggcagcctagatattaaaaatggaattgtagaaggcttagacaaacaagtaacagtaaaatataagaatacagataaaacatctcaaaaaactaaaatagcacaatttgatttttctaaggttaaatttccagctataggtgtttaccgctatatggtttcagagaaaaacgataaaaaagacggaattacgtacgatgataaaaagtggactgtagatgtttatgttgggaataaggccaataacgaagaaggtttcgaagttctatatattgtatcaaaagaaggtacttctagtactaaaaaaccaattgaatttacaaactctattaaaactacttccttaaaaattgaaaaacaaataactggcaatgcaggagatcgtaaaaaatcattcaacttcacattaacattacaaccaagtgaatattataaaactggatcagttgtgaaaatcgaacaggatggaagtaaaaaagatgtgacgataggaacgccttacaaatttactttgggacacggtaagagtgtcatgttatcgaaattaccaattggtatcaattactatcttagtgaagacgaagcgaataaagacggctacactacaacggcaacattaaaagaacaaggcaaagaaaagagttccgatttcactttgagtactcaaaaccagaaaacagacgaatctgctgacgaaatcgttgtcacaaataagcgtgacactcaagttccaactggtgttgtagggacccttgctccatttgcagttcttagcattgtggctattggtggagttatctatattacaaaacgtaaaaaagct

SEQ ID NO: 95 - protein, 352 aa, Streptococcus agalactiae
MEREKMKKNKLLLATAILATALGTASLNQNVKAETAGVVTGKSLQVTKTMTYDDEEVLMPETAFTFTIEPDMTASGKEGSLDIKNGIVEGLDKQVTVKYKNTDKTSQKTKIAQFDFSKVKFPAIGVYRYMVSEKNDKKDGITYDDKKWTVDVYVGNKANNEEGFEVLYIVSKEGTSSTKKPIEFTNSIKTTSLKIEKQITGNAGDRKKSFNFTLTLQPSEYYKTGSVVKIEQDGSKKDVTIGTPYKFTLGHGKSVMLSKLPIGINYYLSEDEANKDGYTTTATLKEQGKEKSSDFTLSTQNQKTDESADEIVVTNKRDTQVPTGVVGTLAPFAVLSIVAIGGVIYITKRKKA

SEQ ID NO: 96 - DNA, 738 bp, Streptococcus agalactiae
gtgattagtcaaagaatgatgatgacaattgtacaggttatcaataaagccattgatactctcattcttatcttttgtttagtcgtactatttttagctggttttggtttgtgggattcttatcatctctatcaacaagcagacgcttctaatttcaaaaaatttaaaacagctcaacaacagcctaaatttgaagacttgttagctttgaatgaggatgtcattggttggttaaatatcccagggactcatattgattatcctctagttcagggaaaaacgaatttagagtatattaataaagcagttgatggcagtgttgccatgtctggtagtttatttttagatacacggaatcataatgattttacggacgattactctctgatttatggccatcatatggcaggtaatgccatgtttggcgaaattccaaaatttttaaaaaaggattttttcaacaaacataataaagctatcattgaaacaaaagagagaaaaaaactaaccgtcactatttttgcttgtctcaagacagatgcctttgaccagttagtttttaatcctaatgctattaccaatcaagaccaacaaaagcagctcgttgattatatcagtaaaagatcaaaacaatttaaacctgttaaattgaagcatcatacaaagttcgttgctttttcaacgtgtgaaaatttttctactgacaatcgtgttatcgttgtcggtactattcaagaa

SEQ ID NO: 97 - protein, 246 aa, Streptococcus agalactiae
MISQRMMMTIVQVINKAIDTLILIFCLVVLFLAGFGLWDSYHLYQQADASNFKKFKTAQQQPKFEDLLALNEDVIGWLNIPGTHIDYPLVQGKTNLEYINKAVDGSVAMSGSLFLDTRNHNDFTDDYSLIYGHHMAGNAMFGEIPKFLKKDFFNKHNKAIIETKERKKLTVTIFACLKTDAFDQLVFNPNAITNQDQQKQLVDYISKRSKQFKPVKLKHHTKFVAFSTCENFSTDNRVIVVGTIQE

SEQ ID NO: 98 - DNA, 672 bp, Streptococcus agalactiae
ttgctttttcaacgtgtgaaaatttttctactgacaatcgtgttatcgttgtcggtactattcaagaataacgaaaggaggagacttttgagaaaatattggaaaatgttattttctgtcgtaatgatattaaccatgctggcctttaatcagactgttttagcaaaagacagcactgttcaaactagcattagtgtcgaaaatgtcttagagagagcaggcgatagtaccccattttcggttgcattagaatcaattgatgcgatgaaaacaatagacgaaataacaattgctggttctggaaaagcaagcttttcccctctgaccttcacaacagttgggcaatatacttatcgtgtttatcagaagccttcacaaaataaagattatcaagcagatactactgtatttgacgttcttgtctatgtgacctatgatgaagatgggactctagtcgcaaaagttatttctcgaagggctggagacgaagaaaaatcagcgattacttttaagcccaaacggttagtaaaaccaataccgcctagacaacctaacatccctaaaaccccattaccattagctggtgaagtaaaaagtttattgggtatcttaagtatcgtattactggggttactagttcttctttatgttaaaaaactgaagagtaggcta

SEQ ID NO: 99 - protein, 224 aa, Streptococcus agalactiae
MLFQRVKIFLLTIVLSLSVLFKNNERRRLLRKYWKMLFSVVMILTMLAFNQTVLAKDSTVQTSISVENVLERAGDSTPFSVALESIDAMKTIDEITIAGSGKASFSPLTFTTVGQYTYRVYQKPSQNKDYQADTTVFDVLVYVTYDEDGTLVAKVISRRAGDEEKSAITFKPKRLVKPIPPRQPNIPKTPLPLAGEVKSLLGILSIVLLGLLVLLYVKKLKSRL

SEQ ID NO: 100 - DNA, 1236 bp, Streptococcus agalactiae
atgatacaactaaggatgggggcaatctatcaaatggttatattcgatttaaaacatgtgcaaacattacacagcttgtctcaattacctatttcagtgatgtcacaagataaggcacttattcaagtatatggtaatgacgactatttattatgttactatcaatttttaaagcatctagctattcctcaagctgcacaagatgttattttttatgagggtttatttgaagagtcctttatgatttttcctctttgtcactacattattgccattggacctttctatccttattcacttaataaagactatcaggaacaattagctaataattttttaaaacattcttctcatcgtagcaaagaagagctcttgtcctatatggcacttgtcccacattttccaattaataatgtgcggaaccttttgatagctattgacgctttttttgacacacaatttgagacgacttgccaacaaacgattcatcaattgttgcagcattcaaaacagatgactgctgatcctgatatcattcatcgccttaagcatattagcaaagcatctagccaattaccgcctgttttagagcacctaaatcatattatggatctggtaaagctaggcaatccacaattgctcaagcaagaaatcaatcgcatccccttatcaagtatcacctcatcttctatttctgctctaagggcggaaaagaacctcactgttatctatttaactaggttactggaattcagttttgtagaaaatactgacgtagcaaagcattatagccttgtcaaatactacatggccttaaatgaagaagcgagtgacttgctcaaagttttgagaattcgctgtgcagctatcatccatttttccgaatcattaaccaataaaagtatttctgataaacgtcaaatgtacaatagtgtgcttcattatgtcgatagtcacctgtattccaaattaaaggtatctgatatcgctaagcgcctatatgtttccgaatctcacttacgttcagtctttaaaaaatactcaaatgtttccttacaacattatattctaagtacaaaaatcaaagaagctcaactactcttaaaacgaggaattcctgttggagaagtggctaaaagcttatatttttatgacactacccattttcataaaatctttaaaaaatacacgggtatttcttcaaaagactatcttgctaaataccgagataatatt

SEQ ID NO: 101 - protein, 412 aa, Streptococcus agalactiae
MIQLRMGAIYQMVIFDLKHVQTLHSLSQLPISVMSQDKALIQVYGNDDYLLCYYQFLKHLAIPQAAQDVIFYEGLFEESFMIFPLCHYIIAIGPFYPYSLNKDYQEQLANNFLKHSSHRSKEELLSYMALVPHFPINNVRNLLIAIDAFFDTQFETTCQQTIHQLLQHSKQMTADPDIIHRLKHISKASSQLPPVLEHLNHIMDLVKLGNPQLLKQEINRIPLSSITSSSISALRAEKNLTVIYLTRLLEFSFVENTDVAKHYSLVKYYMALNEEASDLLKVLRIRCAAIIHFSESLTNKSISDKRQMYNSVLHYVDSHLYSKLKVSDIAKRLYVSESHLRSVFKKYSNVSLQHYILSTKIKEAQLLLKRGIPVGEVAKSLYFYDTTHFHKIFKKYTGISSKDYLAKYRDNI

SEQ ID NO: 102 - DNA, 2088 bp, Streptococcus agalactiae
atgacacaaaaaaatagctataagttaagcttcctgttatccctaacaggatttattttaggtttattattggtttttataggattgtccggagtatcagtaggacatgcggaaacaagaaatggagcaaacaaacaaggagcttttgaaatcaagaaaaataaaagtcaagaagaatataattatgaagtttatgataacagaaacatacttcaggatggggaacataaacttgaaataaaaagagttgatgggacaggtaaaacttatcaaggtttttgctttcagttaacgaaaaattttcccactgctcaaggtgtaagtaaaaagctgtataaaaaattgagtagtagtgatgaagaaacactaaagcaatatgcctctaagtatacaagtaataggagaggagatactagtggtaatcttaaaaagcaaattgctaaggttctgacagaaggttacccaactaacaaaagtgattggttaaatggattgactgaaaacgaaaaaatagaagtaacccaggatgcaatttggtattttacagaaacgacagttccggctgatagaagttatacgaatcgcaacgtaaatagtcaaaaaatgaaagaagtgtatcaaaagctaattgatacaacagatatagataaatatgaagatgtacaatttgatttatttgtgccacaagatacaaacttacaggcagtaattagtgtagagcctgttatcgaaagccttccttggacatcgttgaagccaatagcccagaaggatatcactgccaaaaaaatctgggtagatgcacctaaagaaaaaccaattatttattttaagctatatagacagctgcctggagaaaaggaagtagcagtggatgacgctgagctaaaacagataaatagtgaaggtcaacaagaaatatcagtaacttggacaaatcaacttgttacagatgaaaaaggaatggcttacatttattctgtaaaagaagtagataaaaatggcgagttacttgagccaaaagattatatcaagaaggaagatggacttacagttactaatacttatgtaaagccaactagtgggcactatgatatagaagtgacatttggaaatggacatattgatattacagaagatactacaccagatattgtttcaggtgaaaaccaaatgaagcaaatagagggagaagatagtaagcctattgatgaagtaacggaaaataatttaattgaatttggtaaaaacacgatgccaggtgaagaagatggcacaaattctaataagtatgaagaagtcgaagactcacgcccagttgataccttgtcaggtttatcaagtgagcaaggtcagtccggtgatatgacaattgaagaagatagtgctacccatattaaattctcaaaacgtgatattgacggcaaagagttagctggtgcaactatggagttgcgtgattcatctggtaaaactattagtacatggatttcagatggacaagtgaaagatttctacctgatgccaggaaaatatacatttgtcgaaaccgcagcaccagacggttatgagatagcaactgctattacctttacagttaatgagcaaggtcaggttactgtaaatggcaaagcaactaaaggtgacgctcatattgtcatggttgatgcttacaagccaactaagggttcaggtcaggttattgatattgaagaaaagcttccagacgagcagggccattctggctcaactactgaaatagaagatagcaagtcttcagacgttatcattggtggtcaggggcagattgtcgagacaacagaggatacccaaactggcatgcacggggattctggttgtaaaacggaagtcgaagatactaaactagtacaatccttccactttgataacaaggaatcagaaagtaactctgagattcctaaaaaagataagccaaagagtaatactagtttaccagcaactggtgagaagcaacataatatgttcttttggatggttacttcttgctcacttattagtagtgtttttgtaatatcactaaaaactaaaaaacgcctatcatcatgt

SEQ ID NO: 103 - protein, 696 aa, Streptococcus agalactiae; identical to SEQ ID NO: 79

SEQ ID NO: 104 - DNA, 1320 bp, Streptococcus agalactiae
atgaccatccaaaaaaggatgatatcttgccaatttacacatccttctaaagaaacttatctttaccaactctatgcatcatctaatgtcttacaattactagcgtttttaataaaaaatggttcccactctcgtccccttacggattttgcaagaagtcattttttatcaaactcctcagcttatcggatgcgcgaagcattgattcctttattaagaaactttgaattaaaactctctaagaacaagattgtcggtgaggaatatcgtatccgttacctcatcgctctgctatatagtaagtttggcattaaagtttatgacttgacgcagcaagacaaaaacattattcatagctttttatcccatagttccacccaccttaaaacttctccttggttatcggaatcgttttctttctatgacattttattagctttatcgtggaagcggcatcaattttcggtaactattccccaaaccagaatttttcaacaattaaaaaaactttttgtctacgattctttgaaaaaaagtagccgtgatattatcgaaacttactgccaactaaacttttcagcaggagatttggactacctctatttaatttatatcaccgctaataattcttttgcgagcttacaatggacacctgagcatatcagacaatgttgtcaactttttgaagaaaatgatacttttcgcctgcttttaaatcctatcatcactcttttacctaacctaaaagagcaaaaggctagtttagtaaaagctcttatgtttttttcaaaatcattcttgtttaatctgcaacattttattcctgagaccaacttattcgtttctccgtactataaaggaaaccaaaaactctatacgtccttaaagttaattgtcgaagagtggatggccaaacttcctggtaagcgttacttgaaccataagcattttcatcttttttgccactatgtcgagcaaattctaagaaatatccaacctcctttagttgttgttttcgtagccagtaattttatcaatgctcatctcctaacagattctttcccaaggtatttctcggataaaagcattgattttcattcctattatctattgcaagataatgtttatcaaattcctgatttaaagccagatttggtcatcactcacagtcaactgattccttttgttcaccatgaacttacaaaaggaattgctgttgctgaaatatcttttgatgaatcgattctgtctatccaagaattgatgtatcaagttaaagaggaaaaattccaagctgatttaaccaaacaattaacataa

SEQ ID NO: 105 - protein, 439 aa, Streptococcus agalactiae
MTIQKRMISCQFTHPSKETYLYQLYASSNVLQLLAFLIKNGSHSRPLTDFARSHFLSNSSAYRMREALIPLLRNFELKLSKNKIVGEEYRIRYLIALLYSKFGIKVYDLTQQDKNIIHSFLSHSSTHLKTSPWLSESFSFYDILLALSWKRHQFSVTIPQTRIFQQLKKLFVYDSLKKSSRDIIETYCQLNFSAGDLDYLYLIYITANNSFASLQWTPEHIRQCCQLFEENDTFRLLLNPIITLLPNLKEQKASLVKALMFFSKSFLFNLQHFIPETNLFVSPYYKGNQKLYTSLKLIVEEWMAKLPGKRYLNHKHFHLFCHYVEQILRNIQPPLVVVFVASNFINAHLLTDSFPRYFSDKSIDFHSYYLLQDNVYQIPDLKPDLVITHSQLIPFVHHELTKGIAVAEISFDESILSIQELMYQVKEEKFQADLTKQLT

SEQ ID NO: 106 - DNA, 2097 bp, Streptococcus agalactiae
atggtaagctcatatatgtttgcgagaggagagaaaatgaataacaaaatgtttttgaacaaagaagccggttttttggtacacacaaaaagaaaaaggcgatttgctgtcactttagtgggagtcttttttctgcttttggcatgtgcgggtgctatcggttttggtcaagtagcctatgctgcggatgagaagactgtgccgaattttaaaagcccagatccagattatccctggtatggttatgattcgtatagaggaatatttgcaagatatcacaatttaaaagtaaatctaaaaggaagtaaggagtatcaagcgtattgttttaacctaacaaaatactttcctcgccccacttatagtactacaaataatttttacaagaaaattgatgggagtggatcagcgttcaaatcttatgcagcgaatcctagggttttagatgagaatttagataaattagaaaaaaatatactgaatgtaatttataatggatataaaagtaatgcaaatggttttatgaatggtatagaagatcttaatgctatactagtaactcaaaacgctatttggtactattcagatagtgctccattaaatgatgttaataaaatgtgggaaagagaggttcggaatggggagattagtgagtcacaagttactttaatgcgtgaggcattgaaaaaactaattgatcccaatttagaagctactgcagctaataaaatcccatcaggatatcgtttaaatatctttaagtctgaaaatgaagattaccaaaatcttttaagtgctgaatatgtacctgatgatccccctaaacctggtgatacgtcagaacataatcctaaaactcccgagttggatggcactccaattcccgaggacccaaaacgtccagatgagagttcagaacctgcgcttcccccattaatgccagagctagatggtgaagaagtcccagaagttccaagcgagagcttagaacctgcgcttcccccattgatgccagagctagatggtgaagaagtcccagaagttccaagcgagagcttagaacctgcgcttcccccattgatgccagagctagatggtgaagaagtcccagaagttccaagcgagagcttagaacctgcgcttcccccattaatgccagagctagatggtgaagaagtcccagaagttccaagcgagagcttagaacctgcgcttcccccattgatgccagagttagatggtgaagaagtccctgaaaaacctagtgttgacttacctattgaagttcctcgttatgagtttaacaataaagaccagtcacctctagcgggtgagtctggtgagacggagtatattaccgaagtctatggaaatcaacagaaccctgttgatattgataaaaaacttccgaatgaaacaggtttttcaggaaatatggttgagacagaagatacgaaagagccagaagtgttgatgggaggtcaaagtgagtctgttgaatttactaaagacactcaaacaggcatgagtggtcaaacaactcctcaggttgagacagaagatacgaaagagccagaagtgttgatgggaggtcaaagtgagtctgttgaatttactaaagacactcaaacaggcatgagtggtcaaacaactcctcaggttgagacagaagatacgaaagagccaggagtgttgatgggaggccaaagtgagtctgttgaatttactaaagacactcaaacaggcatgagtggtcaaacaactcctcaggttgagacagaagacacgaaagagccaggagtgttgatgggaggtcaaagtgagtctgttgaatttactaaagacactcaaacaggcatgagcggtttcagtgaaacagtgaccattgttgaagatacgcgtccgaagttagtgttccattttgacaataatgagcccaaagtggaagagaatcgggaaaagcctacaaaaaatataacacctatccttcctgcaacaggagatattgagaatgttttggcctttcttggaatccttattttgtcagtactttctatttttagccttttaaaaaacaaacaaaacaataaagtctga

SEQ ID NO: 107 - protein, 698 aa, Streptococcus agalactiae
MVSSYMFARGEKMNNKMFLNKEAGFLVHTKRKRRFAVTLVGVFFLLLACAGAIGFGQVAYAADEKTVPNFKSPDPDYPWYGYDSYRGIFARYHNLKVNLKGSKEYQAYCFNLTKYFPRPTYSTTNNFYKKIDGSGSAFKSYAANPRVLDENLDKLEKNILNVIYNGYKSNANGFMNGIEDLNAILVTQNAIWYYSDSAPLNDVNKMWEREVRNGEISESQVTLMREALKKLIDPNLEATAANKIPSGYRLNIFKSENEDYQNLLSAEYVPDDPPKPGDTSEHNPKTPELDGTPIPEDPKRPDESSEPALPPLMPELDGEEVPEVPSESLEPALPPLMPELDGEEVPEVPSESLEPALPPLMPELDGEEVPEVPSESLEPALPPLMPELDGEEVPEVPSESLEPALPPLMPELDGEEVPEKPSVDLPIEVPRYEFNNKDQSPLAGESGETEYITEVYGNQQNPVDIDKKLPNETGFSGNMVETEDTKEPEVLMGGQSESVEFTKDTQTGMSGQTTPQVETEDTKEPEVLMGGQSESVEFTKDTQTGMSGQTTPQVETEDTKEPGVLMGGQSESVEFTKDTQTGMSGQTTPQVETEDTKEPGVLMGGQSESVEFTKDTQTGMSGFSETVTIVEDTRPKLVFHFDNNEPKVEENREKPTKNITPILPATGDIENVLAFLGILILSVLSIFSLLKNKQNNKV

SEQ ID NO: 108 - DNA, 2271 bp, Streptococcus agalactiae
atgaataacaaaaaattgcaaaagaagcaagatgctcctcgggtatcaaacagaaagccaaaacaattaactgtcactttagtgggagtatttttaatgtttttgaccttggtaagttccatgagaggtgctcaaagcatatttggagaggaaaagagaattgaagaagtcagtgttcctaaaataaaaagtccagatgatgcctacccttggtatggctatgattcatatgactctagtcatccttactatgaacgttttaaagtagcacatgatttaagggttaatttaaatggaagtaagagctaccaagtatattgctttaatatcaattctcattatccgaatagaaaaaatgctttttctaaacaatggtttaagagagttgatgggacaggtgatgtgttcacaaattatgctcagacacctaagattcgtggagaatcattgaataataaacttttaagtattatgtacaacgcttatcctaaaaatgctaatggctatatggataagatagaaccattaaatgctattttagtaactcaacaagctgtttggtactattctgacagttcttatggtaatataaaaacgttatgggcatctgagcttaaagacggaaaaatagattttgaacaagtaaaattaatgcgtgaagcttactcaaaactaattagtgatgatttagaagaaacatctaaaaataagctacctcaaggatctaaactgaatatttttgttccgcaagataaatctgttcaaaatttattaagtgcagagtacgtgcctgaatcccctccggcaccaggtcagtctccagaaccgccagtgcaaacaaaaaaaacatcagtcattatcagaaaatatgcggaaggtgactactctaaacttctagagggagcaactttgcgtttaacaggggaagatatcctagattttcaagaaaaagtcttccaaagtaatggaacaggagaaaagattgaattatcaaatgggacttataccttaacagaaacatcatctccagatggatataaaattgcggagccgattaagtttagagtagtgaataaaaaagtatttatcgtccaaaaagatggttctcaagtggaaaatccaaacaaagaagtagcagagccatactcagtggaagcgtacagcgatatgcaagatagtaactatattaatccagaaacgttcactccttatgggaaattttattacgctaaaaataaggataaaagttcacaagttgtctactgttttaatgctgatttacactctccacctgaatcagaggatgggggaggaactatagatcctgatattagtacgatgaaagaagtcaagtacacacatacggcaggtagtgatttgtttaaatacgcgctaagaccgagagatacaaatccagaagacttcttaaagcacattaaaaaagtaattgaaaaaggctacaataaaaaaggtgatagctataatggattaacagaaacacagtttcgcgcggctactcagcttgctatctattactttacagacagcactgacttaaaaaccttaaaaacttataacaatgggaaaggttaccatggatttgaatctatggatgaaaaaaccctagctgtaacaaaagaattaattaattacgctcaagataatagtgcccctcaactaacaaatcttgatttcttcgtacctaataatagcaaataccaatctcttattgggacagaataccatccagatgatttggttgacgtgattcgtatggaagataaaaagcaagaagttattccagtaactcacagtttgacagtgaaaaaaacagtagtcggtgagttgggagataaaactaaaggcttccaatttgaacttgagttgaaagataaaactggacagcctattgttaacactctaaaaactaataatcaagatttagtagctaaagatgggaaatattcatttaatctaaagcatggtgacaccataagaatagaaggattaccgacgggatattcttatactctgaaagagactgaagctaaggattatatagtaaccgttgataacaaagttagtcaagaagctcaatcagcaagtgagaatgtcacagcagacaaagaagtcacttttgaaaaccgtaaagatcttgtcccaccaactggttttattactgatggtggaacctatctgtggttattattgcttgtcccatttggtttgttagtgtggttctttggtcgtaaaggactaaaaaatgactaa

SEQ ID NO: 109 - protein, 756 aa, Streptococcus agalactiae
MNNKKLQKKQDAPRVSNRKPKQLTVTLVGVFLMFLTLVSSMRGAQSIFGEEKRIEEVSVPKIKSPDDAYPWYGYDSYDSSHPYYERFKVAHDLRVNLNGSKSYQVYCFNINSHYPNRKNAFSKQWFKRVDGTGDVFTNYAQTPKIRGESLNNKLLSIMYNAYPKNANGYMDKIEPLNAILVTQQAVWYYSDSSYGNIKTLWASELKDGKIDFEQVKLMREAYSKLISDDLEETSKNKLPQGSKLNIFVPQDKSVQNLLSAEYVPESPPAPGQSPEPPVQTKKTSVIIRKYAEGDYSKLLEGATLRLTGEDILDFQEKVFQSNGTGEKIELSNGTYTLTETSSPDGYKIAEPIKFRVVNKKVFIVQKDGSQVENPNKEVAEPYSVEAYSDMQDSNYINPETFTPYGKFYYAKNKDKSSQVVYCFNADLHSPPESEDGGGTIDPDISTMKEVKYTHTAGSDLFKYALRPRDTNPEDFLKHIKKVIEKGYNKKGDSYNGLTETQFRAATQLAIYYFTDSTDLKTLKTYNNGKGYHGFESMDEKTLAVTKELINYAQDNSAPQLTNLDFFVPNNSKYQSLIGTEYHPDDLVDVIRMEDKKQEVIPVTHSLTVKKTVVGELGDKTKGFQFELELKDKTGQPIVNTLKTNNQDLVAKDGKYSFNLKHGDTIRIEGLPTGYSYTLKETEAKDYIVTVDNKVSQEAQSASENVTADKEVTFENRKDLVPPTGFITDGGTYLWLLLLVPFGLLVWFFGRKGLKND

SEQ ID NO: 110 - DNA, 522 bp, Streptococcus agalactiae
atgactaattacctaaatcgcttaaatgagaatccactatttaaagctttcatacggttagtacttaagatttctattattggatttctaggttacattctatttcagtatgtttttggcgtcatgattgttaacacaaatcagatgagtcctgctgtaagtgctggtgatggagtcttatattatcgtttgactgatcgctatcatattaatgatgtggtggtctatgaggttgataacactttgaaagttggtcgaattgccgctcaagctggcgatgaggttagttttacgcaagaaggaggactgttgattaatgggcatccaccagaaaaagaggtcccttacctgacgtatcctcactcaagtggtccaaactttccctataaagttcctacgggtacgtatttcatattgaatgattatcgtgaagaacgtttggacagtcgttattatggggcgttacccatcaatcaaatcaaagggaaaatctcaactctattaagagtgagaggaatttaa

SEQ ID NO: 111 - protein, 173 aa, Streptococcus agalactiae
MTNYLNRLNENPLFKAFIRLVLKISIIGFLGYILFQYVFGVMIVNTNQMSPAVSAGDGVLYYRLTDRYHINDVVVYEVDNTLKVGRIAAQAGDEVSFTQEGGLLINGHPPEKEVPYLTYPHSSGPNFPYKVPTGTYFILNDYREERLDSRYYGALPINQIKGKISTLLRVRGI

SEQ ID NO: 112 - DNA, 1029 bp, Streptococcus agalactiae
atgaaaaaaaataaattattacttgctactgcaatcttagcaactgctttaggaacagcttctttaaatcaaaacgtaaaagctgagacggcaggggttgttagcagtggtcaattaacaataaaaaaatcaattacaaattttaatgatgatacacttttgatgcctaagacagactatacttttagcgttaatccggatagtgcggctacaggtactgaaagtaatttaccaattaaaccaggtattgctgttaacaatcaagatattaaggtttcttattctaatactgataagacatcaggtaaagaaaaacaagttgttgttgactttatgaaagttacttttcctagcgttggtatttaccgttatgttgttaccgagaataaagggacagcagaaggagttacatatgatgatacaaaatggttagttgacgtctatgttggtaataatgaaaagggaggtcttgaaccaaagtatattgtatctaaaaaaggagattctgctactaaagaaccaatccagtttaataattcattcgaaacaacgtcattaaaaattgaaaaggaagttactggtaatacaggagatcataaaaaagcatttacctttacattaacattgcaaccaaatgaatactatgaggcaagttcggttgtgaaaattgaagagaacggacaaacgaaagatgtgaaaattggggaggcatataagtttactttgaacgatagtcagagtgtgatattgtctaaattaccagttggtattaattataaagttgaagaagcagaagctaatcaaggtggatatactacaacagcaactttaaaagatggagaaaagttatctacttataacttaggtcaggaacataaaacagacaagactgctgatgaaatcgttgtcacaaataaccgtgacactcaagttccaactggtgttgtaggcacccttgctccatttgcagttcttagcattgtggctattggtggagttatctatattacaaaacgtaaaaaagcttaa

SEQ ID NO: 113 - protein, 342 aa, Streptococcus agalactiae
MKKNKLLLATAILATALGTASLNQNVKAETAGVVSSGQLTIKKSITNFNDDTLLMPKTDYTFSVNPDSAATGTESNLPIKPGIAVNNQDIKVSYSNTDKTSGKEKQVVVDFMKVTFPSVGIYRYVVTENKGTAEGVTYDDTKWLVDVYVGNNEKGGLEPKYIVSKKGDSATKEPIQFNNSFETTSLKIEKEVTGNTGDHKKAFTFTLTLQPNEYYEASSVVKIEENGQTKDVKIGEAYKFTLNDSQSVILSKLPVGINYKVEEAEANQGGYTTTATLKDGEKLSTYNLGQEHKTDKTADEIVVTNNRDTQVPTGVVGTLAPFAVLSIVAIGGVIYITKRKKA

SEQ ID NO: 114 - DNA, 726 bp, Streptococcus agalactiae
atgatgatgacaattgtacaggttatcaataaagccattgatactctcattcttatcttttgtttagtcgtactatttttagctggttttggtttgtgggattcttatcatctctatcaacaagcagacgcttctaatttcaaaaaatttaaaacagctcaacaacagcctaaatttgaagacttgttagctttgaatgaggatgtcattggttggttaaatatcccggggactcatattgattatcctctagttcagggaaaaacgaatttagagtatattaataaagcagttgatggcagtgttgccatgtctggtagtttatttttagatacacggaatcataatgattttacggacgattactctctgatttatggccatcatatggcaggtaatgccatgtttggcgaaattccaaaatttttaaaaaaggattttttcaacaaacataataaagctatcattgaaacaaaagagagaaaaaaactaaccgtcactatttttgcttgtctcaagacagatgcctttgaccagttagtttttaatcctaatgctattaccaatcaagaccaacaaaggcagctcgttgattatatcagtaaaagatcaaaacaatttaaacctgttaaattgaagcatcatacaaagttcgttgctttttcaacgtgtgaaaatttttctactgacaatcgtgttatcgttgtcggtactattcaagaataa

SEQ ID NO: 115 - protein, 241 aa, Streptococcus agalactiae
MMMTIVQVINKAIDTLILIFCLVVLFLAGFGLWDSYHLYQQADASNFKKFKTAQQQPKFEDLLALNEDVIGWLNIPGTHIDYPLVQGKTNLEYINKAVDGSVAMSGSLFLDTRNHNDFTDDYSLIYGHHMAGNAMFGEIPKFLKKDFFNKHNKAIIETKERKKLTVTIFACLKTDAFDQLVFNPNAITNQDQQRQLVDYISKRSKQFKPVKLKHHTKFVAFSTCENFSTDNRVIVVGTIQE

SEQ ID NO: 116 - DNA, 560 bp, Streptococcus agalactiae
atgttattttctgtcgtaatgatattaaccatgctggcctttaatcagactgttttagcaaaagacagcactgttcaaactagcattagtgtcgaaaatgtcttagagagagcaggcgatagtaccccattttcgattgcattagaatcaattgatgcgatgaaaacaatagaagaaataacaattgctggttctggaaaagcaagcttttcccctctgaccttcacaacagttgggcaatatacttatcgtgtttatcagaagccttcacaaaataaagattatcaagcagatactactgtatttgacgttcttgtctatgtgacctatgatgaagatgggactctagtcgcaaaagttatttctcgaagggctggagacgaagaaaaatcagcgattacttttaagcccaaacggttagtaaaaccaataccgcctagacaacctaacatccctaaaaccccattaccattagctggtgaagtaaaaagtttattgggtatcttaagtatcgtattactggggttactagttcttctttatgttaaaaaactgaagag

SEQ ID NO: 117 - protein, 189 aa, Streptococcus agalactiae
MLFSVVMILTMLAFNQTVLAKDSTVQTSISVENVLERAGDSTPFSIALESIDAMKTIEEITIAGSGKASFSPLTFTTVGQYTYRVYQKPSQNKDYQADTTVFDVLVYVTYDEDGTLVAKVISRRAGDEEKSAITFKPKRLVKPIPPRQPNIPKTPLPLAGEVKSLLGILSIVLLGLLVLLYVKKLKSKL

SEQ ID NO: 118 - DNA, 1206 bp, Streptococcus agalactiae
atggttatattcgatttaaaacatgtgcaaacattacacagcttgtctcaattacctatttcagtgatgtcacaagataaggcacttattcaagtatatggtaatgacgactatttattatgttactatcaatttttaaagcatctagctattcctcaagctgcacaagatgttattttttatgagggtttatttgaagagtcctttatgatttttcctctttgtcactacattattgccattggacctttctacccttattcacttaataaagactatcaggaacaattagctaataattttttaaaacattcttctcatcgtagcaaagaagagctcttatcctatatggcacttgtcccacattttccaattaataatgtgcggaaccttttgatagctattgacgctttttttgacacacaatttgagacgacttgccaacaaacaattcatcaattgttgcagcattcaaaacagatgactgctgatcctgatatcattcatcgccttaagcatattagcaaagcatctagccaactaccgcctgttttagagcacctaaatcatattatggatctggtaaagctaggcaatccacaattgctcaagcaagaaatcaatcgcatccccttatcaagtatcacctcatcttctatttctgctctaagggcggaaaagaacctcactgttatctatttaactaggttactggaattcagttttgtagaaaatactgacgtagcaaagcattatagccttgtcaaatactacatggccttaaatgaagaagcgagtgacttgctcaaagttttgagaattcgctgtgcagccatcatccatttttccgaatcattaaccaataaaagtatttctgataaacgtcaaatgtacaatagtgtgcttcattatgtcgatagtcacctgtattccaaattaaaggtatctgatatcgctaagcgcctatatgtttccgaatctcacttacgttcagtctttaaaaaatactcaaatgtttccttacaacattatattctaagtacaaaaatcaaagaagctcaactactcttaaaacgaggaattcctgttggagaagtggctaaaagcttatatttttatgacactacccattttcataaaatctttaaaaaatacacgggtatttcttcaaaagactatcttgctaaataccgagataatatttaa

SEQ ID NO: 119 - protein, 401 aa, Streptococcus agalactiae
MVIFDLKHVQTLHSLSQLPISVMSQDKALIQVYGNDDYLLCYYQFLKHLAIPQAAQDVIFYEGLFEESFMIFPLCHYIIAIGPFYPYSLNKDYQEQLANNFLKHSSHRSKEELLSYMALVPHFPINNVRNLLIAIDAFFDTQFETTCQQTIHQLLQHSKQMTADPDIIHRLKHISKASSQLPPVLEHLNHIMDLVKLGNPQLLKQEINRIPLSSITSSSISALRAEKNLTVIYLTRLLEFSFVENTDVAKHYSLVKYYMALNEEASDLLKVLRIRCAAIIHFSESLTNKSISDKRQMYNSVLHYVDSHLYSKLKVSDIAKRLYVSESHLRSVFKKYSNVSLQHYILSTKIKEAQLLLKRGIPVGEVAKSLYFYDTTHFHKIFKKYTGISSKDYLAKYRDNI

SEQ ID NO: 120 - DNA, 3486 bp, Streptococcus agalactiae
atgacacaaaaaaatagctataagttaagcttcctgttatccctaacaggatttattttaggtttattattggtttttataggattgtccggagtatcagtaggacatgcggaaacaagaaatggagcaaacaaacaaggatcttttgaaatcaagaaagtcgaccaaaacaataagcctttaccgggagcaactttttcactgacatcaaaggatggcaagggaacatctgttcaaacgttcacttcaaatgataaaggtattgtagatgctcaaaatctccaaccagggacttataccttaaaagaagaaacagcaccagatggttatgataaaaccagccggacttggacagtgactgtttatgagaacggctataccaagttggttgaaaatccctataatggggaaatcatcagtaaagcagggtcaaaagatgttagtagttctttacagttggaaaatcccaaaatgtcagttgtttctaaatatgggaaaacagaggttagtagtggcgcagcggatttctaccgcaaccatgccgcctattttaaaatgtcttttgagttgaaacaaaaggataaatctgaaacaatcaacccaggtgatacctttgtgttacagctggatagacgtctcaatcctaaaggtatcagtcaagatatccctaaaatcatttacgacagtgcaaatagtccgcttgcgattggaaaataccatgctgagaaccatcaacttatctatactttcacagattatattgcgggtttagataaagtccagttgtctgcagaattgagcttattcctagagaataaggaagtgttggaaaatactagtatctcaaattttaagagtaccataggtgggcaggagatcacctataaaggaacggttaatgttctttatggaaatgagagcactaaagaaagcaattatattactaatggattgagcaatgtgggtgggagtattgaaagctacaacaccgaaacgggagaatttgtctggtatgtttatgtcaatccaaaccgtaccaatattccttatgcgaccatgaatttatggggatttggaagggctcgttcaaatacaagcgacttagaaaacgacgctaatacaagtagtgctgagcttggagagattcaggtctatgaagtacctgaaggagaaaaattaccatcaagttatggggttgatgttacaaaacttactttaagaacggatatcacagcaggcctaggaaatggttttcaaatgaccaaacgtcagcgaattgactttggaaataatatccaaaataaagcatttatcatcaaagtaacagggaaaacagaccaatctggtaagccattggttgttcaatccaatttggcaagttttcgtggtgcttctgaatatgctgcttttactccagttggaggaaatgtctacttccaaaacgaaattgccttgtctccttctaagggtagtggttctgggaaaagtgaatttactaagccctctattacagtagcaaatctaaaacgagtggctcagcttcgctttaagaaaatgtcaactgacaatgtgccattgccagaagcggcttttgagctgcgttcatcaaatggtaatagtcagaaattagaagccagttcaaacacacaaggagaggttcactttaaggacctgacctcgggcacatatgacctgtatgaaacaaaagcgccaaaaggttatcagcaggtgacagagaaattggcgaccgttactgttgatactaccaaacctgctgaggaaatggtcacttggggaagcccacattcgtctgtaaaagtagaagctaacaaagaagtcacgattgtcaaccataaagaaacccttacgttttcagggaagaaaatttgggagaatgacagaccagatcaacgcccagcaaagattcaagtgcaactgttgcaaaatggtcaaaagatgcctaaccagattcaagaagtaacgaaggataacgattggtcttatcacttcaaagacttgcctaagtacgatgccaagaatcaggagtataagtactcagttgaagaagtaaatgttccagacggctacaaggtgtcgtatttaggaaatgatatatttaacaccagagaaacagaatttgtgtttgaacagaataactttaaccttgaatttggaaatgctgaaataaaaggtcaatctgggtcaaaaatcattgatgaagacacgctaacgtctttcaaaggtaagaaaatttggaaaaatgatacggcagaaaatcgtccccaagccattcaagtgcagctttatgctgatggagtggctgtggaaggtcaaaccaaatttatttctggctcaggtaatgagtggtcatttgagtttaaaaacttgaagaagtataatggaacaggtaatgacatcatttactcagttaaagaagtaactgttccaacaggttatgatgtgacttactcagctaatgatattattaataccaaacgtgaggttattacacaacaaggaccgaaactagagattgaagaaacgcttccgctagaatcaggtgcttcaggcggtaccactactgtcgaagactcacgcccagttgataccttatcaggtttatcaagtgagcaaggtcagtccggtgatatgacaattgaagaagatagtgctacccatattaaattctcaaaacgtgatattgacggcaaagagttagctggtgcaactatggagttgcgtgattcatctggtaaaactattagtacatggatttcagatggacaagtgaaagatttctacctgatgccaggaaaatatacatttgtcgaaaccgcagcaccagacggttatgagatagcaactgctattacctttacagttaatgagcaaggtcaggttactgtaaatggcaaagcaactaaaggtgacactcatattgtcatggttgatgcttacaagccaactaagggttcaggtcaggttattgatattgaagaaaagcttccagacgagcaaggtcattctggttcaactactgaaatagaagacagtaaatcttcagaccttatcattggcggtcaaggtgaagttgttgacacaacagaagacacacaaagtggtatgacgggccattctggctcaactactgaaatagaagatagcaagtcttcagacgttatcattggtggtcaggggcaggttgtcgagacaacagaggatacccaaactggcatgtacggggattctggttgtaaaacggaagtcgaagatactaaactagtacaatccttccactttgataacaaggaaccagaaagtaactctgagattcctaaaaaagataagccaaagagtaatactagtttaccagcaactggtgagaagcaacataatatgttcttttggatggttacttcttgctcacttattagtagtgtttttgtaatatcactaaaatccaaaaaacgcctatcatcatgttaa

SEQ ID NO: 121 - protein, 1161 aa, Streptococcus agalactiae
MTQKNSYKLSFLLSLTGFILGLLLVFIGLSGVSVGHAETRNGANKQGSFEIKKVDQNNKPLPGATFSLTSKDGKGTSVQTFTSNDKGIVDAQNLQPGTYTLKEETAPDGYDKTSRTWTVTVYENGYTKLVENPYNGEIISKAGSKDVSSSLQLENPKMSVVSKYGKTEVSSGAADFYRNHAAYFKMSFELKQKDKSETINPGDTFVLQLDRRLNPKGISQDIPKIIYDSANSPLAIGKYHAENHQLIYTFTDYIAGLDKVQLSAELSLFLENKEVLENTSISNFKSTIGGQEITYKGTVNVLYGNESTKESNYITNGLSNVGGSIESYNTETGEFVWYVYVNPNRTNIPYATMNLWGFGRARSNTSDLENDANTSSAELGEIQVYEVPEGEKLPSSYGVDVTKLTLRTDITAGLGNGFQMTKRQRIDFGNNIQNKAFIIKVTGKTDQSGKPLVVQSNLASFRGASEYAAFTPVGGNVYFQNEIALSPSKGSGSGKSEFTKPSITVANLKRVAQLRFKKMSTDNVPLPEAAFELRSSNGNSQKLEASSNTQGEVHFKDLTSGTYDLYETKAPKGYQQVTEKLATVTVDTTKPAEEMVTWGSPHSSVKVEANKEVTIVNHKETLTFSGKKIWENDRPDQRPAKIQVQLLQNGQKMPNQIQEVTKDNDWSYHFKDLPKYDAKNQEYKYSVEEVNVPDGYKVSYLGNDIFNTRETEFVFEQNNFNLEFGNAEIKGQSGSKIIDEDTLTSFKGKKIWKNDTAENRPQAIQVQLYADGVAVEGQTKFISGSGNEWSFEFKNLKKYNGTGNDIIYSVKEVTVPTGYDVTYSANDIINTKREVITQQGPKLEIEETLPLESGASGGTTTVEDSRPVDTLSGLSSEQGQSGDMTIEEDSATHIKFSKRDIDGKELAGATMELRDSSGKTISTWISDGQVKDFYLMPGKYTFVETAAPDGYEIATAITFTVNEQGQVTVNGKATKGDTHIVMVDAYKPTKGSGQVIDIEEKLPDEQGHSGSTTEIEDSKSSDLIIGGQGEVVDTTEDTQSGMTGHSGSTTEIEDSKSSDVIIGGQGQVVETTEDTQTGMYGDSGCKTEVEDTKLVQSFHFDNKEPESNSEIPKKDKPKSNTSLPATGEKQHNMFFWMVTSCSLISSVFVISLKSKKRLSSC

SEQ ID NO: 122 - protein, 5 aa, Artificial
  Sortase substrate motif
  misc_feature (3)..(3): X = any amino acid residue
LPXTG

SEQ ID NO: 123 - protein, 5 aa, Artificial
  sortase substrate motif
FPKTG

SEQ ID NO: 124 - protein, 5 aa, Artificial
  sortase substrate motif
IPKTG

SEQ ID NO: 125 - protein, 2118 aa, Streptococcus agalactiae
TTAAGCTTCCTTTGATTGGCGTCTTTTCATGATAACTACTGCTCCAAGCATAATGCTTAAACCAATAATTGTGAAAAGAATTGTACCAATACCACCTGTTTGTGGGATTGTTACCTTTTTATTTTCTACACGTGTCGCATCTTTTTGGTTGCTGTTAGCAACGTAGTCAATGTTACCACCTGTTATGTATGACCCTTGATTAACTACAAACTTAATATTACCTGCCAACTTAGCAAATCCTGCTGGAGCAAGTGTTTCTTCAAGGTTGTAAGTACCGTCTGCAAGACCTGTAACTTCAAATTGACCTTGATCGTTTGAAGTGTAGGTAATGGCTCTAGCCTTATCTGTTATCCACTCATAAGCTGTACGAGCCTCAATGAAGGCTGCATCGTAATCTGCTTGTTTAGTTTTGATAAGTTCTTTTGCAGTAATTCCTTTTTCACCTTTTTGGTCTGTTGCAGACAACTTGTTATAAGCAGCGATAGCTTCATCTAAAGCTATTTTCTTAGCAGCTAAAGTTTTTTGACCTTCTGATTGATCTGCTTTAAGAGCAAGGTATTTACCTGCTGAGTTTTTCACAACGAATTGTGCACCAGCCAAACGGTCACCTTGTTCATTAGTTTTGACAAATTTCTTACCATGAGTTTCAACTTTTGGTTCAGTTGGGTTCAATGGTGTTGGGTTATCAGAATCTTTGGTATTGGTAATGGTTACTTTACCATTTTCTAGATTTATTGCACTTCCGTAACCAGAAACACGTTCTGAGATCATGTATGATTTGTTTTCTAGACCAGTGAATTTACCCGAGAAGTTACCAGATACTTCAAATTTGATACCATTTCCAAGGTCGATTGTACCTTTAGATGTTTTTGTCAATGATACTGAAGCAACAGTTTTATCTTTATCTTTCAATGTGTAAACAACGTTTACACCATCAGGTGCAATTCCGTCAGACCAAGTTTTAGCAACTGTTACTTCACCCTTTGAAGGTGTAACAGGAAGTTCAGTCAAGTCTTTACCTGGTTTGTTACCATACGACAATTTGATATCATTGGATTCTGGATTATCAATAATTGCTTGACCATTAACAGTAGCACTATAAGTCAATGTAAATTCAATATCAGCTGTTTTAGCTGCTTTTTCCAATTTGCCCAATCCATCAGCTGTGAATTTTAATGTGAAACCACGGGCATCAATGCTAAGTTCATAGTCTGTATCCTTAGCAAAAGTTTCTGTAGTTCCTGAAGCTTTAAGGCTAACAGTTGAACCCATTGTCAAACCATTTGACATTATATCTGTCCAAACCAAGTTTTCGTATTTAGAACCTTTGTGAATTTTTGTTTTAACTTCATAAGGAACAACTTTACCGATTTCAGCAGTAGCAGTTGCTTTGTCACGTGCATAATTACCATAATTTGCGCCAGCTGTCAAAAGTCTATTAACATCTGTCAATGCTGTCAAATCGTTTGTTTTAGCAAAGTTTTTATCAATTTCTGGTTTTTCTTCAGTGTTCTTTGGATAAACATGGGCATCAGCAACAACACCATCTTCATTTACCAATGGAAGAGTGATGTTAACTGGAACCGCTTTTGAAGCAGCCAGGAGGGAACCATTATTGTTGTAAGTAGATTTTGATTTAACTTCAACAATTTTAAACTCGCCTTTCAATCCTTTGGTGTTGAAAACAAGTCCAGTATCTCCCTCTGGTGTCAATCCAGACACGGCCTCATCAATATTTACTGTTATTTCAGGAGTACCATCTTTATTAATTAAGGCTGGTGTTAATTTGTTACCTTCTTTTGCCTTAACATATTGCACTTTACCACTTTTATCTTCTTTCAAAGCTAAAGCAAAGAACGCACCTTCGATTTCTTTAGATCCCTCGCCAAAGTAACCAGCAAGGTCAGAAATAGCTCCACCTTTGTAGTCTTTTCCGTTAAGACCTGTAGTTCCTGGGAAGTTACTTTTGTTAAGATTTGATTCGGTTTGCAAAATCTTGTGCAAAGTCACTGTATTAGTTGTTGCTTCATCCGCAAACGCTGGTGCAACTGAGAGCAATGACGTTAAAGTCAGTAACAATGCCGAGAACATTGCAAAATATTTGTTGATTCTTTTCAT

SEQ ID NO: 126 - protein, 705 aa, Streptococcus agalactiae
MKRINKYFAMFSALLLTLTSLLSVAPAFADEATTNTVTLHKILQTESNLNKSNFPGTTGLNGKDYKGGAISDLAGYFGEGSKEIEGAFFALALKEDKSGKVQYVKAKEGNKLTPALINKDGTPEITVNIDEAVSGLTPEGDTGLVFNTKGLKGEFKIVEVKSKSTYNNNGSLLAASKAVPVNITLPLVNEDGVVADAHVYPKNTEEKPEIDKNFAKTNDLTALTDVNRLLTAGANYGNYARDKATATAEIGKVVPYEVKTKIHKGSKYENLVWTDIMSNGLTMGSTVSLKASGTTETFAKDTDYELSIDARGFTLKFTADGLGKLEKAAKTADIEFTLTYSATVNGQAIIDNPESNDIKLSYGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEWITDKARAITYTSNDQGQFEVTGLADGTYNLEETLAPAGFAKLAGNIKFVVNQGSYITGGNIDYVANSNQKDATRVENKKVTIPQTGGIGTILFTIIGLSIMLGAVVIMKRRQSKEA

SEQ ID NO: 127 - DNA, 2025 bp, Streptococcus agalactiae
atgaaaaaaatcaacaaatgtcttacaatgttctcgacactgctattgatcttaacgtcactattctcagttgcaccagcgtttgcggacgacgcaacaactgatactgtgaccttgcacaagattgtcatgccacaagctgcatttgataactttactgaaggtacaaaaggtaagaatgatagcgattatgttggtaaacaaattaatgaccttaaatcttattttggctcaaccgatgctaaagaaatcaagggtgctttctttgttttcaaaaatgaaactggtacaaaattcattactgaaaatggtaaggaagtcgatactttggaagctaaagatgctgaaggtggtgctgttctttcagggttaacaaaagacaatggttttgtttttaacactgctaagttaaaaggaatttaccaaatcgttgaattgaaagaaaaatcaaactacgataacaacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtgaagattttcctgttttaaactacaaactcgtaacagatgaccaaggtttccgtcttgccttgaatgcaacaggtcttgcagcagtagcagcagctgcaaaagacaaagatgttgaaatcaagatcacttactcagctacggtgaacggctccactactgttgaaattccagaaaccaatgatgttaaattggactatggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatggcttggaagaaactcaagcaccagcaggttatgcgacattgtcaggtgatgtaaactttgaagtaactgccacatcatatagcaaaggggctacaactgacatcgcatatgataaaggctctgtaaaaaaagatgcccaacaagttcaaaacaaaaaagtaaccatcccacaaacaggtggtattggtacaattcttttcacaattattggtttaagcattatgcttggagcagtagttatcatgaaaaaacgtcaatcagaggaagcttaa

SEQ ID NO: 128 - protein, 674 aa, Streptococcus agalactiae
MKKINKCLTMFSTLLLILTSLFSVAPAFADDATTDTVTLHKIVMPQAAFDNFTEGTKGKNDSDYVGKQINDLKSYFGSTDAKEIKGAFFVFKNETGTKFITENGKEVDTLEAKDAEGGAVLSGLTKDNGFVFNTAKLKGIYQIVELKEKSNYDNNGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGEDFPVLNYKLVTDDQGFRLALNATGLAAVAAAAKDKDVEIKITYSATVNGSTTVEIPETNDVKLDYGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYGLEETQAPAGYATLSGDVNFEVTATSYSKGATTDIAYDKGSVKKDAQQVQNKKVTIPQTGGIGTILFTIIGLSIMLGAVVIMKKRQSEEA

SEQ ID NO: 129 - protein, 5 aa, Artificial
  sortase substrate motif
IPQTG

SEQ ID NO: 130 - protein, 5 aa, Artificial
  sortase substrate motif
LPKTG

SEQ ID NO: 131 - protein, 5 aa, Artificial
  sortase substrate motif
LPSTG

SEQ ID NO: 132 - protein, 5 aa, Artificial
  sortase substrate motif
LPFTG

SEQ ID NO: 133 - protein, 5 aa, Artificial
  sortase substrate motif
  misc_feature (3)..(3): X = any amino acid residue
IPXTG

SEQ ID NO: 134 - protein, 5 aa, Artificial
  sortase substrate motif
  misc_feature (3)..(3): X = any amino acid residue
LPXSG

SEQ ID NO: 135 - protein, 5 aa, Artificial
  sortase substrate motif
  misc_feature (3)..(3): X = any amino acid residue
VVXTG

SEQ ID NO: 136 - protein, 5 aa, Artificial
  sortase substrate motif
  misc_feature (3)..(3): X = any amino acid residue
EVXTG

SEQ ID NO: 137 - protein, 5 aa, Artificial
  sortase substrate motif
  misc_feature (3)..(3): X = any amino acid residue
VPXTG

SEQ ID NO: 138 - protein, 5 aa, Artificial
  sortase substrate motif
  misc_feature (3)..(3): X = any amino acid residue
QVXTG

SEQ ID NO: 139 - protein, 5 aa, Artificial
  sortase substrate motif
  misc_feature (3)..(3): X = any amino acid residue
LPXAG

SEQ ID NO: 140 - protein, 5 aa, Artificial
  sortase substrate motif
QVPTG

SEQ ID NO: 141 - protein, 5 aa, Artificial
  sortase substrate motif
  misc_feature (3)..(3): X = any amino acid residue
FPXTG

SEQ ID NO: 142 - protein, 5 aa, Artificial
  sortase substrate motif
NPQTN

SEQ ID NO: 143 - protein, 6 aa, Artificial
  substrate sortase motif
  misc_feature (1)..(3): X = any amino acid residue
XPXTGG

SEQ ID NO: 144 - protein, 6 aa, Artificial
  sortase substrate motif
  misc_feature (1)..(6): X = any amino acid residue
LPXTAX

SEQ ID NO: 145 - protein, 6 aa, Artificial
  sortase substrate motif
  misc_feature (1)..(6): X = any amino acid residue
LAXTGX

SEQ ID NO: 146 - protein, 15 aa, Artificial
  pilin motif
  misc_feature (1)..(15): X = any amino acid residue
YPKNXXXXXXXXXXK

SEQ ID NO: 147 - protein, 14 aa, Artificial
  pilin motif
  misc_feature (1)..(14): X = any amino acid residue
YPKNXXXXXXXXXK

SEQ ID NO: 148 - protein, 11 aa, Artificial
  pilin motif
  misc_feature (1)..(11): X = any amino acid residue
YPKXXXXXXXK

SEQ ID NO: 149 - protein, 15 aa, Artificial
  pilin motif
  misc_feature (1)..(15): X = any amino acid residue
YPKXXXXXXXXXXXK

SEQ ID NO: 150 - protein, 13 aa, Artificial
  pilin motif
  misc_feature (1)..(13): X = any amino acid residue
PKNXXXXXXXXXK

SEQ ID NO: 151 - protein, 10 aa, Artificial
  pilin motif
  misc_feature (1)..(10): X = any amino acid residue
WXXXVXVYPK

SEQ ID NO: 152 - protein, 12 aa, Artificial
  E box motif
  misc_feature (1)..(12): X = any amino acid residue
YXLXETXAPXGY

SEQ ID NO: 153 - protein, 12 aa, Artificial
  E box motif
  misc_feature (1)..(12): X = any amino acid residue
YXLXEXXXXXGY

SEQ ID NO: 154 - protein, 12 aa, Artificial
  E box motif
  misc_feature (1)..(12): X = any amino acid residue
YXLXEXXXPXGY

SEQ ID NO: 155 - protein, 12 aa, Artificial
  E box motif
YKLKETKAPEGY

SEQ ID NO: 156 - protein, 12 aa, Artificial
  E box motif
YVLKEIETQSGY

SEQ ID NO: 157 - protein, 12 aa, Artificial
  E box motif
YKLYEISSPDGY

SEQ ID NO: 158 - protein, 13 aa, Artificial
  pilin motif
  misc_feature (1)..(13): X = any amino acid residue
YPKNXXXXXXXXK

SEQ ID NO: 159 - protein, 11 aa, artificial
  pilin motif
  misc_feature (1)..(11): X = any amino acid residue
PKXXXXXXXXK

SEQ ID NO: 160 - protein, 13 aa, Artificial
  pilin motif
  misc_feature (1)..(13): X = any amino acid residue
YPKXXXXXXXXXK

SEQ ID NO: 161 - protein, 12 aa, Artificial
  pilin motif
  misc_feature (1)..(12): X = any amino acid residue
PKNXXXXXXXXK

SEQ ID NO: 162 - protein, 13 aa, Artificial
  pilin motif
  misc_feature (1)..(13): X = any amino acid residue
PKXXXXXXXXXXK

SEQ ID NO: 163 - protein, 11 aa, Artificial
  E box motif
  misc_feature (1)..(11): X = any amino acid residue
YXLXETXAPXG

SEQ ID NO: 164 - protein, 12 aa, Artificial
  E box motif
  misc_feature (1)..(12): X = any amino acid residue
YXXXEXXAXXGY

SEQ ID NO: 165 - protein, 12 aa, Artificial
  E box motif
  misc_feature (1)..(12): X = any amino acid residue
YXLXEXXXPXDY

SEQ ID NO: 166 - protein, 5 aa, Artificial
  sortase substrate motif
LPSTG

SEQ ID NO: 167 - protein, 5 aa, Artificial
  sortase substrate motif
  misc_feature (2)..(2): X = P or V
VXPTG

SEQ ID NO: 168 - protein, 5 aa, Artificial
  sortase substrate motif
NPKTN

SEQ ID NO: 169 - protein, 5 aa, Artificial
  sortase substrate motif
NPQTG

SEQ ID NO: 170 - protein, 5 aa, Artificial
  sortase substrate motif
NPKTG

SEQ ID NO: 171 - protein, 420 aa, Streptococcus pneumoniae
MEHINHTTLLIGIKDKNITLNKAIQHDTHIEVFATLDYHPPKCKHCKGKQIKYDFQKPSKIPFIEIGGFPSLIHLKKRRFQCKSCRKVTVAETTLVQKNCQISEMVRQKIAQLLLNREALTHIASKLAISTSTSTVYRKLKQFHFQEDYTTLPEILSWDEFSYQKGKLAFIAQDFNTKKIMTILDNRRQTTIRNHFFKYSKEARKKVKVVTVDMSGSYIPLIKKLFPNAKIVLDRFHIVQHMSRALNQTRINIMKQFDDKSLEYRALKYYWKFILKDSRKLSLKPFYARTFRETLTPRECLKKIFTLVPELKDYYDLYQLLLFHLQEKNTDQFWGLIQDTLPHLNRTFKTTLSTFICYKNYITNAIELPYSNAKLEATNKLIKDIKRNAFGFRNFENFKKRIFIALNIKKERTKFVLSRA

SEQ ID NO: 172 - protein, 509 aa, Streptococcus pneumoniae; identical to SEQ ID NO: 87

SEQ ID NO: 173 - protein, 890 aa, Streptococcus pneumoniae
MLNRETHMKKVRKIFQKAVAGLCCISQLTAFSSIVALAETPETSPAIGKVVIKETGEGGALLGDAVFELKNNTDGTTVSQRTEAQTGEAIFSNIKPGTYTLTEAQPPVGYKPSTKQWTVEVEKNGRTTVQGEQVENREEALSDQYPQTGTYPDVQTPYQIIKVDGSEKNGQHKALNPNPYERVIPEGTLSKRIYQVNNLDDNQYGIELTVSGKTTVETKEASTPLDVVILLDNSNSMSNIRHNHAHRAEKAGEATRALVDKITSNPDNRVALVTYGSTIFDGSEATVEKGVADANGKILNDSALWTFDRTTFTAKTYNYSFLNLTSDPTDIQTIKDRIPSDAEELNKDKLMYQFGATFTQKALMTADDILTKQARPNSKKVIFHITDGVPTMSYPINFKYTGTTQSYRTQLNNFKAKTPNSSGILLEDFVTWSADGEHKIVRGDGESYQMFTKKPVTDQYGVHQILSITSMEQRAKLVSAGYRFYGTDLYLYWRDSILAYPFNSSTDWITNHGDPTTWYYNGNMAQDGYDVFTVGVGVNGDPGTDEATATRFMQSISSSPDNYTNVADPSQILQELNRYFYTIVNEKKSIENGTITDPMGELIDFQLGADGRFDPADYTLTANDGSSLVNNVPTGGPQNDGGLLKNAKVFYDTTEKRIRVTGLYLGTGEKVTLTYNVRLNDQFVSNKFYDTNGRTTLHPKEVEKNTVRDFPIPKIRDVRKYPEITIPKEKKLGEIEFIKINKNDKKPLRDAVFSLQKQHPDYPDIYGAIDQNGTYQNVRTGEDGKLTFKNLSDGKYRLFENSEPAGYKPVQNKPIVAFQIVNGEVRDVTSIVPQDIPAGYEFTNDKHYITNEPIPPKREYPRTGGIGMLPFYLIGCMMMGGVLLYTRKHP

SEQ ID NO: 174 - protein, 644 aa, Streptococcus pneumoniae
MKSINKFLTMLAALLLTASSLFSAATVFAADNVSTAPDAVTKTLTIHKLLLSEDDLKTWDTNGPKGYDGTQSSLKDLTGVVAEEIPNVYFELQKYNLTDGKEKENLKDDSKWTTVHGGLTTKDGLKIETSTLKGVYRIREDRTKTTYVGPNGQVLTGSKAVPALVTLPLVNNNGTVIDAHVFPKNSYNKPVVDKRIADTLNYNDQNGLSIGTKIPYVVNTTIPSNATFATSFWSDEMTEGLTYNEDVTITLNNVAMDQADYEVTKGNNGFNLKLTEAGLAKINGKDADQKIQITYSATLNSLAVADIPESNDITYHYGNHQDHGNTPKPTKPNNGQITVTKTWDSQPAPEGVKATVQLVNAKTGEKVGAPVELSENNWTYTWSGLDNSIEYKVEEEYNGYSAEYTVESKGKLGVKNWKDNNPAPINPEEPRVKTYGKKFVKVDQKDTRLENAQFVVKKADSNKYIAFKSTAQQAADEKAAATAKQKLDAAVAAYTNAADKQAAQALVDQAQQEYNVAYKEAKFGYVEVAGKDEAMVLTSNTDGQFQISGLAAGTYKLEEIKAPEGFAKIDDVEFVVGAGSWNQGEFNYLKDVQKNDATKVVNKKITIPQTGGIGTIIFAVAGAAIMGIAVYAYVKNNKDEDQLA

SEQ ID NO: 175 - protein, 401 aa, Streptococcus pneumoniae
MTMQKMQKMISRIFFVMALCFSLVWGAHAVQAQEDHTLVLQLENYQEVVSQLPSRDGHRLQVWKLDDSYSYDDRVQIVRDLHSWDENKLSSFKKTSFEMTFLENQIEVSHIPNGLYYVRSIIQTDAVSYPAEFLFEMTDQTVEPLVIVAKKTDTMTTKVKLIKVDQDHNRLEGVGFKLVSVARDGSEKEVPLIGEYRYSSSGQVGRTLYTDKNGEIFVTNLPLGNYRFKEVEPLAGYAVTTLDTDVQLVDHQLVTITVVNQKLPRGNVDFMKVDGRTNTSLQGAMFKVMKEESGHYTPVLQNGKEVVVTSGKDGRFRVEGLEYGTYYLWELQAPTGYVQLTSPVSFTIGKDTRKELVTVVKNNKRPRIDVPDTGEETLYILMLVAILLFGSGYYLTKKPNN

SEQ ID NO: 176 - protein, 304 aa, Streptococcus pneumoniae
MLIKMVKTKKQKRNNLLLGVVFFIGMAVMAYPLVSRLYYRVESNQQIADFDKEKATLDEADIDERMKLAQAFNDSLNNVVSGDPWSEEMKKKGRAEYARMLEIHERMGHVEIPVIDVDLPVYAGTAEEVLQQGAGHLEGTSLPIGGNSTHAVITAHTGLPTAKMFTDLTKLKVGDKFYVHNIKEVMAYQVDQVKVIEPTNFDDLLIVPGHDYVTLLTCTPYMINTHRLLVRGHRIPYVAEVEEEFIAANKLSHLYRYLFYVAVGLIVILLWIIRRLRKKKKQPEKALKALKAARKEVKVEDGQQ

SEQ ID NO: 177 - protein, 261 aa, Streptococcus pneumoniae
VSRYYYRIESNEVIKEFDETVSQMDKAELEERWRLAQAFNATLKPSEILDPFTEQEKKKGVSEYANMLKVHERIGYVEIPAIDQEIPMYVGTSEEILQKGAGLLEGASLPVGGENTHTVVTAHRGLPTAELFSQLDKMKKGDVFYLHVLDQVLAYQVDQILTVEPNDFEPVLIQHGEDYATLLTCTPYMINSHRLLVRGKRIPYTAPIAERNRAVRERGQFWLWLLLAALVMILVLSYGVYRHRRIVKGLEKQLEEHHVKG

SEQ ID NO: 178 - protein, 283 aa, Streptococcus pneumoniae
MSKAKLQKLLGYLLMLVALVIPVYCFGQMVLQSLGQVKGHEIFSESVTADSYQEQLQRSLDYNQRLDSQNRIVDPFLAEGYEVNYQVSDDPDAVYGYLSIPSLEIMEPVYLGADYHHLAMGLAHVDGTPLPVEGKGIRSVIAGHRAEPSHVFFRHLDQLKVGDALYYDNGQEIVEYQMMDTEIILPSEWEKLESVSSKNIMTLITCDPIPTFNKRLLVNFERVAVYQKSDPQTAAVARVAFTKEGQSVSRVATSQWLYRGLVVLAFLGILFVLWKLARLLRGK

SEQ ID NO: 179 - DNA, 869 bp, Streptococcus agalactiae
gctacaacagttcacggggagactgttgtaaacggagccaaactaacagttacaaaaaaccttgatttagttaatagcaatgcattaattccaaatacagattttacatttaaaatcgaacctgatactactgtcaacgaagacggaaataagtttaaaggtgtagctttgaacacaccgatgactaaagtcacttacaccaattcagataaaggtggatcaaatacgaaaactgcagaatttgatttttcagaagttacttttgaaaaaccaggtgtttattattacaaagtaactgaggagaagatagataaagttcctggtgtttcttatgatacaacatcttacactgttcaagttcatgtcttgtggaatgaagagcaacaaaaaccagtagctacttatattgttggttataaagaaggtagtaaggtgccaattcagttcaaaaatagcttagattctactacattaacggtgaagaaaaaagtttcaggtaccggtggagatcgctctaaagattttaattttggtctgactttaaaagcaaatcagtattataaggcgtcagaaaaagtcatgattgagaagacaactaaaggtggtcaagctcctgttcaaacagaggctagtatagatcaactctatcattttaccttgaaagatggtgaatcaatcaaagtcacaaatcttccagtaggtgtggattatgttgtcactgaagacgattacaaatcagaaaaatatacaaccaacgtggaagttagtcctcaagatggagctgtaaaaaatatcgcaggtaattcaactgaacaagagacatctactgataaagatatgaccattacttttacaaataaaaaagattt

SEQ ID NO: 180 - protein, 5 aa, Artificial
  sortase substrate motif
LPATG

SEQ ID NO: 181 - protein, 5 aa, Artificial
  sortase substrate motif
LPSSG

SEQ ID NO: 182 - protein, 5 aa, Artificial
  sortase substrate motif
VVPTG

SEQ ID NO: 183 - protein, 5 aa, Artificial
  sortase substrate motif
EVPTG

SEQ ID NO: 184 - protein, 5 aa, Artificial
  sortase substrate motif
VPPTG

SEQ ID NO: 185 - protein, 5 aa, Artificial
  sortase substrate motif
LPLAG

SEQ ID NO: 186 - protein, 5 aa, Artificial
  sortase substrate motif
  misc_feature (3)..(3): X = any amino acid residue
YPXTG

SEQ ID NO: 187 - protein, 509 aa, Streptococcus pneumoniae; identical to SEQ ID NO: 87

SEQ ID NO: 188 - protein, 883 aa, Streptococcus pneumoniae
MKKVRKIFQKAVAGLCCISQLTAFSSIVALAETPETSPAIGKVVIKETGEGGALLGDAVFELKNNTDGTTVSQRTEAQTGEAIFSNIKPGTYTLTEAQPPVGYKPSTKQWTVEVEKNGRTTVQGEQVENREEALSDQYPQTGTYPDVQTPYQIIKVDGSEKNGQHKALNPNPYERVIPEGTLSKRIYQVNNLDDNQYGIELTVSGKTTVETKEASTPLDVVILLDNSNSMSNIRHNHAHRAEKAGEATRALVDKITSNPDNRVALVTYGSTIFDGSEATVEKGVADANGKILNDSALWTFDRTTFTAKTYNYSFLNLTSDPTDIQTIKDRIPSDAEELNKDKLMYQFGATFTQKALMTADDILTKQARPNSKKVIFHITDGVPTMSYPINFKYTGTTQSYRTQLNNFKAKTPNSSGILLEDFVTWSADGEHKIVRGDGESYQMFTKKPVTDQYGVHQILSITSMEQRAKLVSAGYRFYGTDLYLYWRDSILAYPFNSSTDWITNHGDPTTWYYNGNMAQDGYDVFTVGVGVNGDPGTDEATATRFMQSISSSPDNYTNVADPSQILQELNRYFYTIVNEKKSIENGTITDPMGELIDFQLGADGRFDPADYTLTANDGSSLVNNVPTGGPQNDGGLLKNAKVFYDTTEKRIRVTGLYLGTGEKVTLTYNVRLNDQFVSNKFYDTNGRTTLHPKEVEKNTVRDFPIPKIRDVRKYPEITIPKEKKLGEIEFIKINKNDKKPLRDAVFSLQKQHPDYPDIYGAIDQNGTYQNVRTGEDGKLTFKNLSDGKYRLFENSEPAGYKPVQNKPIVAFQIVNGEVRDVTSIVPQDIPAGYEFTNDKHYITNEPIPPKREYPRTGGIGMLPFYLIGCMMMGGVLLYTRKNP

SEQ ID NO: 189 - protein, 644 aa, Streptococcus pneumoniae
  misc_feature (267)..(267): Xaa can be any naturally occurring amino acid
MKSINKFLTMLAALLLTASSLFSAATVFAADNVSTAPDAVTKTLTIHKLLLSEDDLKTWDTNGPKGYDGTQSSLKDLTGVVAEEIPNVYFELQKYNLTDGKEKENLKDDSKWTTVHGGLTTKDGLKIETSTLKGVYRIREDRTKTTYVGPNGQVLTGSKAVPALVTLPLVNNNGTVIDAHVFPKNSYNKPVVDKRIADTLNYNDQNGLSIGTKIPYVVNTTIPSNATFATSFWSDEMTEGLTYNEDVTITLNNVAMDQADYEVTKGXNGFNLKLTEAGLAKINGKDADQKIQITYSATLNSLAVADIPESNDITYHYGNHQDHGNTPKPTKPNNGQITVTKTWDSQPAPEGVKATVQLVNAKTGEKVGAPVELSENNWTYTWSGLDNSIEYKVEEEYNGYSAEYTVESKGKLGVKNWKDNNPAPINPEEPRVKTYGKKFVKVDQKDTRLENAQFVVKKADSNKYIAFKSTAQQAADEKAAATAKQKLDAAVAAYTNAADKQAAQALVDQAQQEYNVAYKEAKFGYVEVAGKDEAMVLTSNTDGQFQISGLAAGTYKLEEIKAPEGFAKIDDVEFVVGAGSWNQGEFNYLKDVQKNDATKVVNKKITIPQTGGIGTIIFAVAGAAIMGIAVYAYVKNNKDEDQLA

SEQ ID NO: 190 - protein, 401 aa, Streptococcus pneumoniae; identical to SEQ ID NO: 175

SEQ ID NO: 191 - protein, 304 aa, Streptococcus pneumoniae; identical to SEQ ID NO: 176

SEQ ID NO: 192 - protein, 297 aa, Streptococcus pneumoniae
MDNSRRSRKKGTKKKKHPLILLLIFLVGFAVAIYPLVSRYYYRIESNEVIKEFDETVSQMDKAELEERWRLAQAFNATLKPSEILDPFTEQEKKKGVSEYANMLKVHERIGYVEIPAIDQEIPMYVGTSEEILQKGAGLLEGASLPVGGENTHTVVTAHRGLPTAELFSQLDKMKKGDVFYLHVLDQVLAYQVDQILTVEPNDFEPVLIQHGEDYATLLTCTPYMINSHRLLVRGKRIPYTAPIAERNRAVRERGQFWLWLLLAALVMILVLSYGVYRHRRIVKGLEKQLEEHHVKG

SEQ ID NO: 193 - protein, 283 aa, Streptococcus pneumoniae
MSKAKLQKLLGYLLMLVALVIPVYCFGQMVLQSLGQVKGHEIFSESVTADSYQEQLQRSLDYNQRLDSQNRIVDPFLAEGYEVNYQVSDDPDAVYGYLSIPSLEIMEPVYLGADYHHLAMGLAHVDGTPLPVEGKGIRSVIAGHRAEPSHVFFRHLDQLKVGDALYYDNGQEIVEYQMMDTEIILPSEWEKLESVSSKNIMTLITCDPIPTFNKRLLVNFERVAVYQKSDPQTAAVARVAFTKEGQSVSRVATSQWLYRGLVVLAFMGILFVLWKLARLLRGK

SEQ ID NO: 194 - protein, 509 aa, Streptococcus pneumoniae; identical to SEQ ID NO: 87

SEQ ID NO: 195 - protein, 883 aa, Streptococcus pneumoniae
MKKVRKIFQKAVAGLCCISQLTAFSSIVALAETPETSPAIGKVVIKETGEGGALLGDAVFELKNNTDGTTVSQRTEAQTGEAIFSNIKPGTYTLTEAQPPVGYKPSTKQWTVEVEKNGRTTVQGEQVENREEALSDQYPQTGTYPDVQTPYQIIKVDGSEKNGQHKALNPNPYERVIPEGTLSKRIYQVNNLDDNQYGIELTVSGKTTVETKEASTPLDVVILLDNSNSMSNIRHNHAHRAEKAGEATRALVDKITSNPDNRVALVTYGSTIFDGSEATVEKGVADANGKILNDSALWTFDRTTFTAKTYNYSFLNLTSDPTDIQTIKDRIPSDAEELNKDKLMYQFGATFTQKALMTADDILTKQARPNSKKVIFHITDGVPTMSYPINFKYTGTTQSYRTQLNNFKAKTPNSSGILLEDFVTWSADGEHKIVRGDGESYQMFTKKPVTDQYGVHQILSITSMEQRAKLVSAGYRFYGTDLYLYWRDSILAYPFNSSTDWITNHGDPTTWYYNGNMAQDGYDVFTVGVGVNGDPGTDEATATRFMQSISSSPDNYTNVADPSQILQELNRYFYTIVNEKKSIENGTITDPMGELIDFQLGADGRFDPADYTLTANDGSSLVNNVPTGGPQNDGGLLKNAKVFYDTTEKRIRVTGLYLGTGEKVTLTYNVRLNDQFVSNKFYDTNGRTTLHPKEVEKNTVRDFPIPKIRDVRKYPEITIPKEKKLGEIEFIKINKNDKKPLRDAVFSLQKQHPDYPDIYGAIDQNGTYQNVRTGEDGKLTFKNLSDGKYRLFENSEPAGYKPVQNKPIVAFQIVNGEVRDVTSIVPQDIPAGYEFTNDKHYITNEPIPPKREYPRTGGIGMLPFYLIGCMMMGGVLLYTRKHP

SEQ ID NO: 196 - protein, 644 aa, Streptococcus pneumoniae; identical to SEQ ID NO: 174

SEQ ID NO: 197 - protein, 401 aa, Streptococcus pneumoniae; identical to SEQ ID NO: 175

SEQ ID NO: 198 - protein, 304 aa, Streptococcus pneumoniae; identical to SEQ ID NO: 176

SEQ ID NO: 199 - protein, 297 aa, Streptococcus pneumoniae; identical to SEQ ID NO: 192

SEQ ID NO: 200 - protein, 283 aa, Streptococcus pneumoniae; identical to SEQ ID NO: 178

SEQ ID NO: 201 - protein, 509 aa, Streptococcus pneumoniae; identical to SEQ ID NO: 87

SEQ ID NO: 202 - protein, 883 aa, Streptococcus pneumoniae; identical to SEQ ID NO: 195

SEQ ID NO: 203 - protein, 644 aa, Streptococcus pneumoniae; identical to SEQ ID NO: 174

SEQ ID NO: 204 - protein, 401 aa, Streptococcus pneumoniae; identical to SEQ ID NO: 175

SEQ ID NO: 205 - protein, 304 aa, Streptococcus pneumoniae; identical to SEQ ID NO: 176

SEQ ID NO: 206 - protein, 297 aa, Streptococcus pneumoniae; identical to SEQ ID NO: 192

SEQ ID NO: 207 - protein, 283 aa, Streptococcus pneumoniae; identical to SEQ ID NO: 178

SEQ ID NO: 208 - protein, 509 aa, Streptococcus pneumoniae; identical to SEQ ID NO: 87

SEQ ID NO: 209 - protein, 886 aa, Streptococcus pneumoniae
MKKVRKIFQKAVAGLCCISQLTAFSSIVALAETPETSPAIGKVVIKETGEGGALLGDAVFELKNNTNGTTVSQRTEAQTGEAIFSNIKPGTYTLTEAQPPVGYKPSTKQRTVEVEKNGRTTVQGEQVENREEALSDQYPQTGTYPDVQTPYQIIKVDGSEKNGQHKALNPNPYERVIPEGTLSKRIYQVNNLDDNQYGIELTVSGKTVYERKDKSVPLDVVILLDNSNSMSNIRNKNARRAERAGEATRSLIDKITSDPENRVALVTYASTIFDGTEFTVEKGVADKNGKRLNDSLFWNYDQTSFTTNTKDYSYLKLTNDKNDIVELKNKVPTEAEDHDGNRLMYQFGATFTQKALMKADEILTQQARQNSQKVIFHITDGVPTMSYPINFNHATFAPSYQNQLNAFFSKSPNKDGILLSDFITQATSGEHTIVRGDGQSYQMFTDKTVYEKGAPAAFPVKPEKYSEMKAVGYAVIGDPINGGYIWLNWRESILAYPFNSNTAKITNHGDPTRWYYNGNIAPDGYDVFTVGIGINGDPGTDEATATSFMQSISSKPENYTNVTDTTKILEQLNRYFHTIVTEKKSIENGTITDPMGELIDLQLGTDGRFDPADYTLTANDGSRLENGQAVGGPQNDGGLLKNAKVFYDTTEKRIRVTGLYLGTGEKVTLTYNVRLNDQFVSNKFYDTNGRTTLHPKEVEKNTVRDFPIPKIRDVRKYPAITIAKEKKLGEIEFIKINKNDKKPLRDAVFSLQKQHPDYPDIYGAIDQNGTYQNVRTGEDGKLTFKNLSDGKYRLFENSEPAGYKPVQNKPIVAFQIVNGEVRDVTSIVPQDIPAGYEFTNDKHYITNEPIPPKREYPRTGGIGMLLFYLIGCMMMGGVLLYTRKHP

SEQ ID NO: 210 - protein, 665 aa, Streptococcus pneumoniae
MKSINKFLTMLAALLLTASSLFSAATVFAAGTTTTSVTVHKLLATDGDMDKIANELETGNYAGNKVGVLPANAKEIAGVMFVWTNTNNEIIDENGQTLGVNIDPQTFKLSGAMPATAMKKLTEAEGAKFNTANLPAAKYKIYEIHSLSTYVGEDGATLTGSKAVPIEIELPLNDVVDAHVYPKNTEAKPKIDKDFKGKANPDTPRVDKDTPVNHQVGDVVEYEIVTKIPALANYATANWSDRMTEGLAFNKGTVKVTVDDVALEAGDYALTEVATGFDLKLTDAGLAKVNDQNAEKTVKITYSATLNDKAIVEVPESNDVTFNYGNNPDHGNTPKPNKPNENGDLTLTKTWVDATGAPIPAGAEATFDLVNAQTGKVVQTVTLTTDKNTVTVNGLDKNTEYKFVERSIKGYSADYQEITTAGEIAVKNWKDENPKPLDPTEPKVVTYGKKFVKVNDKDNRLAGAEFVIANADNAGQYLARKADKVSQEEKQLVVTTKDALDRAVAAYNALTAQQQTQQEKEKVDKAQAAYNAAVIAANNAFEWVADKDNENVVKLVSDAQGRFEITGLLAGTYYLEETKQPAGYALLTSRQKFEVTATSYSATGQGIEYTAGSGKDDATKVVNKKITIPQTGGIGTIIFAVAGAVIMGIAVYAYVKNNKDEDQLA

SEQ ID NO: 211 - protein, 413 aa, Streptococcus pneumoniae
MTMQKMQKMQKMQKMQKMQKMISRIFFVMALCFSLVWGAHAVQAQEDHTLVLQLENYQEVVSQLPSRDGHRLQVWKLDDSYSYDNRVQIVRDLHSWDENKLSSFKKTSFEMTFLENQIEVSHIPNGLYYVRSIIQTDAVSYPAEFLFEMTDQTVEPLVIVAKKADTVTTKVKLIKVDQDHNRLEGVGFKLVSVARDGSEKEVPLIGEYRYSSSGQVGRTLYTDKNGEIVVTNLPLGTYRFKEVEPLAGYTVTTMDTDVQLVDHQLVTITVVNQKLPRGNVDFMKVDGRTNTSLQGAMFKVMKEENGHYTPVLQNGKEVVVASGKDGRFRVEGLEYGTYYLWELQAPTGYVQLTSPVSFTIGKDTRKELVTVVKNNKRPRIDVPDTGEETLYILMLVAILLFGSGYYLTKKTNN

SEQ ID NO: 212 - protein, 302 aa, Streptococcus pneumoniae
MLIKMAKTKKQKRNNLLLGVVFFIGIAVMAYPLVSRLYYRVESNQQIADFDKEKATLDEADIDERMKLAQAFNDSLNNVVSGDPWSEEMKKKGRAEYARMLEIHERMGHVEIPAIDVDLPVYAGTAEEVLQQGAGHLEGTSLPIGGNSTHAVITAHTGLPTAKMFTDLTKLKVGDKFYVHNIKEVMAYQVDQVKVIEPTNFDDLLIVPGHDYVTLLTCTPYMINTHRLLVRGHRIPYVAEVEEEFIAANKLSHLYRYLFYVAVGLIVILLWIIRRLRKKKRQSERALKALKEATKEVKVEDE

SEQ ID NO: 213 - protein, 297 aa, Streptococcus pneumoniae
MSKSRYSRKKSVKKKKNPFILLLIFLVGLAVAMYPLVSRYYYRIESNEVIKEFDETVSQMDKAELEERWRLAQAFNATLKPSEILDPFTEQEKKKGVSEYANMLKVHERIGYVEIPAIDQEIPMYVGTSEEILQKGAGLLEGASLPVGGENTHTVVTAHRGLPTAELFSQLDKMKKGDIFYLHVLDQVLAYQVDQIVTVEPNDFEPVLIQHGEDYATLLTCTPYMINSHRLLVRGKRIPYTAPIAERNRAVRERGQFWLWLLLGAMAVILLLLYRVYRNRRIVKGLEKQLEGRHVKD

SEQ ID NO: 214 - protein, 283 aa, Streptococcus pneumoniae; identical to SEQ ID NO: 80

SEQ ID NO: 215 - protein, 509 aa, Streptococcus pneumoniae; identical to SEQ ID NO: 87

SEQ ID NO: 216 - protein, 883 aa, Streptococcus pneumoniae; identical to SEQ ID NO: 195

SEQ ID NO: 217 - protein, 644 aa, Streptococcus pneumoniae; identical to SEQ ID NO: 174

SEQ ID NO: 218 - protein, 401 aa, Streptococcus pneumoniae; identical to SEQ ID NO: 175

SEQ ID NO: 219 - protein, 304 aa, Streptococcus pneumoniae; identical to SEQ ID NO: 176

SEQ ID NO: 220 - protein, 297 aa, Streptococcus pneumoniae; identical to SEQ ID NO: 192

SEQ ID NO: 221 - protein, 283 aa, Streptococcus pneumoniae; identical to SEQ ID NO: 178

SEQ ID NO: 222 - protein, 509 aa, Streptococcus pneumoniae; identical to SEQ ID NO: 87

SEQ ID NO: 223 - protein, 886 aa, Streptococcus pneumoniae
MKKVRKIFQKAVAGLCCISQLTAFSSIVALAETPETSPAIGKVVIKETGEGGALLGDAVFELKNNTDGTTVSQRTEAQTGEAIFSNIKPGTYTLTEAQPPVGYKPSTKQWTVEVEKNGRTTVQGEQVENREEALSDQYPQTGTYPDVQTPYQIIKVDGSEKNGQHKALNPNPYERVIPEGTLSKRIYQVNNLDDNQYGIELTVSGKTVYERKDKSVPLDVVILLDNSNSMSNIRNKNARRAERAGEATRSLIDKITSDPENRVALVTYASTIFDGTEFTVEKGVADKNGKRLNDSLFWNYDQTSFTTNTKDYSYLKLTNDKNDIVELKNKVPTEAEDHDGNRLMYQFGATFTQKALMKADEILTQQARQNSQKVIFHITDGVPTMSYPINFNHATFAPSYQNQLNAFFSKSPNKDGILLSDFITQATSGEHTIVRGDGQSYQMFTDKTVYEKGAPAAFPVKPEKYSEMKAVGYAVIGDPINGGYIWLNWRESILAYPFNSNTAKITNHGAPTRWYYNGNIAPDGYDVFTVGIGINGDPGTDEATATSFMQSISSKPENYTNVTDTTKILEQLNRYFHTIVTEKKSIENGTITDPMGELIDLQLGTDGRFDPADYTLTANDGSRLENGQAVGGPQNDGGLLKNAKVFYDTTEKRIRVTGLYLGTGEKVTLTYNVRLNDQFVSNKFYDTNGRTTLHPKEVEKNTVRDFPIPKIRDVRKYPAITIAKEKKLGEIEFIKINKNDKKPLRDAVFSLQKQHPDYPDIYGAIDQNGTYQNVRTGEDGKLTFKNLSDGKYRLFENSEPAGYKPVQNKPIVAFQIVNGEVRDVTSIVPQDIPAGYEFTNDKHYITNEPIPPKREYPRTGGIGMLPFYLIGCMMMGGVLLYTRKHP

SEQ ID NO: 224 - protein, 665 aa, Streptococcus pneumoniae; identical to SEQ ID NO: 210

SEQ ID NO: 225 - protein, 401 aa, Streptococcus pneumoniae
MTMQKMQKMISRIFFVMALCFSLVWGAHAVQAQEDHTLVLQLENYQEVVSQLPSRDGHRLQVWKLDDSYSYDNRVQIVRDLHSWDENKLSSFKKTSFEMTFLENQIEVSHIPNGLYYVRSIIQTDAVSYPAEFLFEMTDQTVEPLVIVAKKADTVTTKVKLIKVDQDHNRLEGVGFKLVSVARDGSEKEVPLIGEYRYSSSGQVGRTLYTDKNGEIVVTNLPLGTYRFKEVEPLAGYTVTTMDTDVQLVDHQLVTITVVNQKLPRGNVDFMKVDGRTNTSLQGAMFKVMKEENGHYTPVLQNGKEVVVASGKDGRFRVEGLEYGTYYLWELQAPTGYVQLTSPVSFTIGKDTRKELVTVVKNNKRPRIDVPDTGEETLYILMLVAILLFGSGYYLTKKTNN

SEQ ID NO: 226 - protein, 302 aa, Streptococcus pneumoniae
MLIKMAKTKKQKRNNLLLGVVFFIGMAVMAYPLVSRLYYRVESNQQIADFDKEKATLDEADIDERMKLAQAFNDSLNNVVSGDPWSEEMKKKGRAEYARMLEIHERMGHVEIPAIDVDLPVYAGTAEEVLQQGAGHLEGTSLPIGGNSTHAVITAHTGLPTAKMFTDLTKLKVGDKFYVHNIKEVMAYQVDQVKVIEPTNFDDLLIVPGHDYVTLLTCTPYMINTHRLLVRGHRIPYVAEVEEEFIAANKLSHLYRYLFYVAVGLIVILLWIIRRLRKKKRQSERALKALKEATKEVKVEDE

SEQ ID NO: 227 - protein, 297 aa, Streptococcus pneumoniae
MSKSRYSRKKSVKKKKNPFILLLIFLVGLAVAMYPLVSRYYYRIESNEVIKEFDETVSQMDKAELEERWRLAQAFNATLKPSEILDPFTDQEKKQGVSEYANMLKVHERIGYVEIPAIEQEIPMYVGTSEDILQKGAGLLEGASLPVGGENTHTVITAHRGLPTAELFSQLDKMKKGDIFYLHVLDQVLAYQVDQIVTVEPNDFEPVLIQHGQDYATLLTCTPYMINSHRLLVRGKRIPYTAPIAERNRAVRERGQFWLWLLLGAMAVILLLLYRVYRNRRIVKGLEKQLEGRHVKD

SEQ ID NO: 228 - protein, 283 aa, Streptococcus pneumoniae; identical to SEQ ID NO: 80

SEQ ID NO: 229 - protein, 509 aa, Streptococcus pneumoniae; identical to SEQ ID NO: 87

SEQ ID NO: 230 - protein, 886 aa, Streptococcus pneumoniae
MKKVRKIFQKAVAGLCCISQLTAFSSIVALAETPETSPAIGKVVIKETGEGGALLGDAVFELKNNTDGTTVSQRTEAQTGEAIFSNIKPGTYTLTEAQPPVGYKPSTKQWTVEVEKNGRTTVQGEQVENREEALSDQYPQTGTYPDVQTPYQIIKVDGSEKNGQHKALNPNPYERVIPEGTLSKRIYQVNNLDDNQYGIELTVSGKTVYEQKDKSVPLDVVILLDNSNSMSNIRNKNARRAERAGEATRSLIDKITSDPENRVALVTYASTIFDGTEFTVEKGVADKNGKRLNDSLFWNYDQTSFTTNTKDYSYLKLTNDKNDIVELKNKVPTEAEDHDGNRLMYQFGATFTQKALMKADEILTQQARQNSQKVIFHITDGVPTMSYPINFNHATFAPSYQNQLNAFFSKSPNKDGILLSDFITQATSGEHTIVRGDGQSYQMFTDKTVYEKGAPAAFPVKPEKYSEMKAAGYAVIGDPINGGYIWLNWRESILAYPFNSNTAKITNHGDPTRWYYNGNIAPDGYDVFTVGIGINGDPGTDEATATSFMQSISSKPENYTNVTDTTKILEQLNRYFHTIVTEKKSIENGTITDPMGELIDLQLGTDGRFDPADYTLTANDGSRLENGQAVGGPQNDGGLLKNAKVLYDTTEKRIRVTGLYLGTDEKVTLTYNVRLNDEFVSNKFYDTNGRTTLHPKEVEQNTVRDFPIPKIRDVRKYPEITISKEKKLGDIEFIKVNKNDKKPLRDAVFSLQKQHPDYPDIYGAIDQNGTYQNVRTGEDGKLTFKNLSDGKYRLFENSEPAGYKPVQNKPIVAFQIVNGEVRDVTSIVPQDIPAGYEFTNDKHYITNEPIPPKREYPRTGGIGMLPFYLIGCMMMGGVLLYTRKHP

SEQ ID NO: 231 - protein, 654 aa, Streptococcus pneumoniae
MKSINKFLTILAALLLTVSSLFSAATVFAAEQKTKTLTVHKLLMTDQELDAWNSDAITTAGYDGSQNFEQFKQLQGVPQGVTEISGVAFELQSYTGPQGKEQENLTNDAVWTAVNKGVTTETGVKFDTEVLQGTYRLVEVRKESTYVGPNGKVLTGMKAVPALITLPLVNQNGVVENAHVYPKNSEDKPTATKTFDTAAGFVDPGEKGLAIGTKVPYIVTTTIPKNSTLATAFWSDEMTEGLDYNGDVVVNYNGQPLDNSHYTLEAGHNGFILKLNEKGLEAINGKDAEATITLKYTATLNALAVADVPEANDVTFHYGNNPGHGNTPKPNKPKNGELTITKTWADAKDAPIAGVEVTFDLVNAQTGEVVKVPGHETGIVLNQTNNWTFTATGLDNNTEYKFVERTIKGYSADYQTITETGKIAVKNWKDENPEPINPEEPRVKTYGKKFVKVDQKDERLKEAQFVVKNEQGKYLALKSAAQQAVNEKAAAEAKQALDAAIAAYTNAADKNAAQAVVDAAQKTYNDNYRAARFGYVEVERKEDALVLTSNTDGQFQISGLAAGSYTLEETKAPEGFAKLGDVKFEVGAGSWNQGDFNYLKDVQKNDATKVVNKKITIPQTGGIGTIIFAVAGAVIMGIAVYAYVKNNKDEDQLA

SEQ ID NO: 232 - protein, 401 aa, Streptococcus pneumoniae; identical to SEQ ID NO: 225

SEQ ID NO: 233 - protein, 304 aa, Streptococcus pneumoniae
MLIKMVKTKKQKRNNLLLGVVFFIGMAVMAYPLVSRLYYRVESNQQIADFDKEKATLDEADIDERMKLAQAFNDSLNNVVSGDPWSEEMKKKGRAEYARMLEIHERMGHVEIPVIDVDLPVYAGTAEEVLQQGAGQLEGTSLPIGGNSTHAVITAHTGLPTAKMFTDLTKLKVGDKFYVHNIKEVMAYQVDQVKVIEPTNFDDLLIVPGHDYVTLLTCTPYMINTHRLLVRGHRIPYVAEVEEEFIAANKLSHLYRYLFYVAVGLIVILLWIIRRLRKKKKQPEKALKALKAARKEVKVEDGQQ

SEQ ID NO: 234 - protein, 297 aa, Streptococcus pneumoniae
MDNSRRSRKKGTKKKKHPLILLLIFLVGFAVAIYPLVSRYYYRIESNEVIKEFDETVSQMDKAELEERWRLAQAFNATLKPSEILDPFTEQEKKKGVSEYANMLKVHERIGYVEIPAIDQEIPMYVGTSEEILQKGAGLLEGASLPVGGENTHTVVTAHRGLPTAELFSQLDKMKKGDVFYLHVLDQVLAYQVDQILTVEPNDFEPVLIQHGKDYATLLTCTPYMINSHRLLVRGKRIPYTAPIAERNRAVRERGQFWLWLLLAALVMILVLSYGVYRHRRIVKGLEKQLEEHHVKG

SEQ ID NO: 235 - protein, 283 aa, Streptococcus pneumoniae; identical to SEQ ID NO: 178

SEQ ID NO: 236 - protein, 509 aa, Streptococcus pneumoniae; identical to SEQ ID NO: 87

SEQ ID NO: 237 - protein, 883 aa, Streptococcus pneumoniae; identical to SEQ ID NO: 188

SEQ ID NO: 238 - protein, 644 aa, Streptococcus pneumoniae
MKSINKFLTMLAALLLTASSLFSAATVFAADNVSTAPDAVTKTLTIHKLLLSEDDLKTWDTNGPKGYDGTQSSLKDLTGVVAEEIPNVYFELQKYNLTDGKEKENLKDDSKWTTVHGGLTTKDGLKIETSTLKGVYRIREDRTKTTYVGPNGQVLTGSKAVPALVTLPLVNNNGTVIDAHVFPKNSYNKPVVDKRIADTLNYNDQNGLSIGTKIPYVVNTTIPSNATFATSFWSDEMTEGLTYNEDVTITLNNVAMDQADYEVTKGINGFNLKLTEAGLAKINGKDADQKIQITYSATLNSLAVADIPESNDITYHYGNHQDHGNTPKPTKPNNGQITVTKTWDSQPAPEGVKATVQLVNAKTGEKVGAPVELSENNWTYTWSGLDNSIEYKVEEEYNGYSAEYTVESKGKLGVKNWKDNNPAPINLEEPRVKTYGKKFVKVDQKDTRLENAQFVVKKADSNKYIAFKSTAQQAADEKAAATAKQKLDAAVAAYTNAADKQAAQALVDQAQQEYNVAYKEAKFGYVEVAGKDEAMVLTSNTDGQFQISGLAAGTYKLEEIKAPEGFAKIDDVEFVVGAGSWNQGEFNYLKDVQKNDATKVVNKKITIPQTGGIGTIIFAVAGAVIMGIAVYAYVKNNKDEDQLA

SEQ ID NO: 239 - protein, 401 aa, Streptococcus pneumoniae
MTMQKMQKMISRIFFVMALCFSLVWGAHAVQAQEDHTLVLQLENYQEVVSQLPSRDGHRLQVWKLDDSYSYDNRVQIVRDLHSWDENKLSSFKKTSFEMTFLENQIEVSHIPNGLYYVRSIIQTDAVSYPAEFLFEMTDQTVEPLVIVAKKADTVTTKVKLIKVDQDHNRLEGVGFKLVSVARDGSEKEVPLIGEYRYSSSGQVGRTLYTDKNGEIVVTNLPLGTYRFKEVEPLAGYAVTTMDTDVQLVDHQLVTITVVNQKLPRGNVDFMKVDGRTNTSLQGAMFKVMKEENGHYTPVLQNGKEVVVASGKDGRFRVEGLEYGTYYLWELQAPTGYVQLTSPVSFTIGKDTRKELVTVVKNNKRPRIDVPDTGEETLYILMLVAILLFGSGYYLTKKTNN

SEQ ID NO: 240 - protein, 302 aa, Streptococcus pneumoniae; identical to SEQ ID NO: 212

SEQ ID NO: 241 - protein, 297 aa, Streptococcus pneumoniae; identical to SEQ ID NO: 213

SEQ ID NO: 242 - protein, 133 aa, Streptococcus pneumoniae
VFFRHLDQLKVGDALYYDNGQEIVEYQMMDTEIILPSEWEKLESVSSKNIMTLITCDPIPTFNKRLLVNFERVAVYQKSDPQTAAVARVAFTKEGQSVSRVATSQWLYRGLVVLAFLGILFVLWKLARLLRGK

SEQ ID NO: 243 - protein, 511 aa, Streptococcus agalactiae
MPYVKKKKDSFLVETYLEQSIRDKSELVLLLFKSPTIIFSHVAKQTGLTAVQLKYYCKELDDFFGNNLDITIKKGKIICCFVKPVKEFYLHQLYDTSTILKLLVFFIKNGTSSQPLIKFSKKYFLSSSSAYRLRESLIKLLREFGLRVSKNTIVGEEYRIRYLIAMLYSKFGIVIYPLDHLDNQIIYRFLSQSATNLRTSPWLEEPFSFYNMLLALSWKRHQFAVSIPQTRIFRQLKKLFIYDCLTRSSRQVIENAFSLTFSQGDLDYLFLIYITTNNSFASLQWTPQHIETCCHIFEKNDTFRLLLEPILKRLPQLNHSKQDLIKALMYFSKSFLFNLQHFVIEIPSFSLPTYTGNSNLYKALKNIVNQWLAQLPGKRHLNEKHLQLFCSHIEQILKNKQPALTVVLISSNFINAKLLTDTIPRYFSDKGIHFYSFYLLRDDIYQIPSLKPDLVITHSRLIPFVKNDLVKGVTVAEFSFDNPDYSIASIQNLIYQLKDKKYQDFLNEQLQ

SEQ ID NO: 244 - protein, 744 aa, Streptococcus agalactiae
MQKRDKTNYGSANNKRRQTTIGLLKVFLTFVALIGIVGFSIRAFGAEEQSVPNRQSSIQDYPWYGYDSYPKGYPDYSPLKTYHNLKVNLEGSKDYQAYCFNLTKHFPSKSDSVRSQWYKKLEGTNENFIKLADKPRIEDGQLQQNILRILYNGYPNNRNGIMKGIDPLNAILVTQNAIWYYTDSAQINPDESFKTEARSNGINDQQLGLMRKALKELIDPNLGSKYSNKTPSGYRLNVFESHDKTFQNLLSAEYVPDTPPKPGEEPPAKTEKTSVIIRKYAEGDYSKLLEGATLKLSQIEGSGFQEKDFQSNSLGETVELPNGTYTLTETSSPDGYKIAEPIKFRVENKKVFIVQKDGSQVENPNKEVAEPYSVEAYNDFMDEEVLSGFTPYGKFYYAKNKDKSSQVVYCFNADLHSPPDSYDSGETINPDTSTMKEVKYTHTAGSDLFKYALRPRDTNPEDFLKHIKKVIEKGYKKKGDSYNGLTETQFRAATQLAIYYFTDSADLKTLKTYNNGKGYHGFESMDEKTLAVTKELITYAQNGSAPQLTNLDFFVPNNSKYQSLIGTEYHPDDLVDVIRMEDKKQEVIPVTHSLTVKKTVVGELGDKTKGFQFELELKDKTGQPIVNTLKTNNQDLVAKDGKYSFNLKHGDTIRIEGLPTGYSYTLKETEAKDYIVTVDNKVSQEAQSVGKDITEDKKVTFENRKDLVPPTGLTTDGAIYLWLLLLVPLGLLVWLFGRKGLKND

SEQ ID NO: 245 - protein, 173 aa, Streptococcus agalactiae
MTNYLNRLNENSLFKAFIRLVLKISIIGFLGYILFQYVFGVMIINTNDMSPALSAGDGVLYYRLADRSHINDVVVYEVDNTLKVGRIAAQAGDEVNFTQEGGLLINGHPPEKEVPYLTYPHSSGPNFPYKVPTGTYFILNDYREERLDSRYYGALPINQIKGKISTLLRVRGI

SEQ ID NO: 246 - protein, 344 aa, Streptococcus agalactiae
MKKNKLLLATAILATALGMASMSQNIKAETAGVIDGSTLVVKKTFPSYTDDNVLMPKADYSFKVEADDNAKGKTKDGLDIKPGVIDGLENTKTIRYSNSDKITAKEKSVNFEFANVKFPGVGVYRYTVAEVNGNKAGITYDSQQWTVDVYVVNKEGGGFEVKYIVSTEVGQSEKKPVLFKNSFDTTSLKIEKQVTGNTGEHQRLFSFTLLLTPNECFEKGQVVNILQGGETKKVVIGEEYSFTLKDKESVTLSQLPVGIEYKLTEEDVTKDGYKTSATLKDGEQSSTYELGKDHKTDKSADEIVVTNKRDTQVPTGVVGTLAPFAVLSIVAIGGVIYITKRKKA

SEQ ID NO: 247 - protein, 241 aa, Streptococcus agalactiae
MMMTIVQVINKAIDTLILIFCLVVLFLAGFGLWDSYHLYQQADASNFKKFKTAQQQPKFEDLLALNEDVIGWLNIPGTHIDYPLVQGKTNLEYINKAVDGSVAMSGSLFLDTRNHNDFTDDYSLIYGHHMAGNAMFGEIPKFLKKNFFNKHNKAIIETKERKKLTVTIFACLKTDAFDQLVFNPNAITNQDQQRQLVDYISKRSKQFKPVKLKHHTKFVAFSTCENFSTDNRVIVVGTIQE

SEQ ID NO: 248 - protein, 189 aa, Streptococcus agalactiae
MLFSVVMMLTMLAFNQTVLAKDSTVQTSISVENVLERAGDSTPFSIALESIDAMKTIEEITIAGSGKASFSPLTFTTVGQYTYRVYQKPSQNKDYQADTTVFDVLVYVTYDEDGTLVAKVISRRAGDEEKSAITFKPKRLVKPIPPRQPDIPKTPLPLAGEVKSLLGILSIVLLGLLVLLYVKKLKSRL

SEQ ID NO: 249 - protein, 401 aa, Streptococcus agalactiae; identical to SEQ ID NO: 119

SEQ ID NO: 250 - protein, 1160 aa, Streptococcus agalactiae
MTQKNSYKLSFLLSLTGFILGLLLVFIGLSGVSVGHAETRNGANKQGYFEIKKVDQNNKPLSGATFSLTPKDGKGKPVQTFTSSEEGIIDAQNLQPGTYTLKEETAPDGYDKTSRTWTVTVYENGYTKLVENPYNGEIISKAGSKDVSSSLQLENPKMSVVSKYGEQEKTSNSADFYRNHAAYFKMSFELKQKDKSETINPGDTFVLQLDRRLNPKGISQDIPKIIYDSENSPLAIGKYDAKTHQLTYTFTNYIAGLDKVQLSAELSLFLENKEVLENTNISDFKSTIGGQEITYKGTVNVLYGNESTKESNYITNGLSNVGGSIESYNTETGEFVWYVYVNPNRTNIPYAVLNLWGFAKRTAQGENDNSSVSSAQLTGYDIYEVPHNYRLPTSYGVDISRLNLRKDLEAKLPQGSTQGANKRLRIDFGENLQGKAFVVKVTGKADQSGKELIVQSHLSSFNNWGSYKTLRPNSHVSFTNEIALSPSKGSGSGTSEFTKPAITVANLKRVAQLRFKKVSTDNVPLPEAAFELRSSNGNSQKLEASSNTQGEIHFKDLTSGTYDLYETKAPKGYQQVTEKLATVTVDTTKPAEQMVKWEKPHSFVKVEANKEVTIVNHKETLTFSGKKIWENDRPDQRPAKIQVQLLQNGQKMPNQIQEVTKDNDWSYHFKDLPKYDAKNQEYKYSVEEVKVPDGYKVSYLGNDIFNTRETEFVFEQNNFNLEFGNAEIKGQSGSKIIDEDTLTSFKGKKIWKNDTAENRPQAIQVQLYADGVAVEGQTKFISGSGNEWSFEFKNLKKYNGTGNDIIYSVKEVTVPTGYDVTYSANDIINTKREVITQQGPNLEIEETLPLESGASGGTTTVEDSRSVDTLSGLSSEQGQSGDMTIEEDSATHIKFSKRDIDGKELAGATMELRDSSGKTISTWISDGQVKDFYLMPGKYTFVETAAPDGYEIATAITFTVNEQGQVTVNGKATKGDAHIVMVDAYKPTKGSGQVIDIEEKLPDEQGHSGSTTEIEDSKPSDVIIGGQGEVVDTTEDTQSGMTGHSGSTTEIEDSKSSDVIIGGQGQVVETTEDTQTGMHGDSGCKTEVEDTKLVQFFHFDNKEPESNSEIPKKDKPKSNTSLPATGEKQHNKFFWMVTSCSLISSVFVISLKSKKRLLSC

SEQ ID NO: 251 - DNA, 1650 bp, Streptococcus agalactiae
atgagagagaaaatattaatagcagcaaaaaaactaatgctagcttgtttagctatcttagctgtagtagggcttggaatgacaagagtatcagctttatcaaaagatgataaggcggagttgaagataacaaatatcgaaggtaaaccgaccgtgacactgtataaaattggtgatggaaaatacagtgagcgaggggattcttttattggatttgagttaaagcaaggtgtggagctaaataaggcaaaacctacatctcaagaaataaataaaatcgctaatggtattaataaaggtagtgttaaggctgaagtagttaatataaaagaacatgctagtacaacttatagttatacaacaactggtgcaggtatttacttggctatattgactggagctactgatggacgtgcctataatcctatcttactgacagcttcttacaatgaggaaaatccacttaagggagggcagattgacgcaactagtcattatctttttggagaagaagcagttgctaaatctagccaaccaacaattagcaagtcaattacaaaatccacaaaagatggtgataaagatacagcatctgtaggtgaaaaagttgattacaaattaactgttcagttaccaagttattcgaaagatgctatcaataaaacggtgtttatcactgacaaattgtctcagggacttactttccttccaaaaagtttaaagattatctggaatggtcaaacgttaacaaaggtgaatgaagaatttaaagctggagataaggtaattgctcaacttaaggttgaaaataatggatttaatctgaactttaattatgataaccttgataatcatgccccagaagttaactatagtgctctactaaatgaaaacgcagttgttggtaaaggtggtaatgacaataatgtagactattactattcaaataatccgaataaaggagagacccataaaacaactgagaagcctaaagagggtgaaggtactggtatcactaaaaagacggataaaaaaaccgtctacacctatcgtgtagcctttaagaaaacaggcaaagatcatgccccactagctggtgctgttttcggtatctattcagataaggaagcgaaacaattagtcgatattgttgtgacaaatgcacagggttatgcagcatcaagcgaagttgggaaagggacttattacattaaagaaattaaatcccctaagggttactctttaaatacaaatatttatgaagtggaaacttcatgggaaaaagctacaacgacttctacaactaatcgtttagagacaatttatacaacagatgataatcaaaagtctccaggaactaatacagttggttggttggaagatggtgtcttttacaaagaaaatccaggtggtgatgctaaacttgcctatatcaaacaatcaacagaggagacttctacaactatagaagtcaaagaaaatcaagctgaaggttcaggtacggtattattagaaactgaaattcctaacaccaaattaggtgaattaccttcgacaggtagcattggtacttacctctttaaagctattggttcggctgctatgatcggtgcaattggtatttatattgttaaacgtcgtaaagcttaa

SEQ ID NO: 252 - protein, 549 aa, Streptococcus agalactiae
MREKILIAAKKLMLACLAILAVVGLGMTRVSALSKDDKAELKITNIEGKPTVTLYKIGDGKYSERGDSFIGFELKQGVELNKAKPTSQEINKIANGINKGSVKAEVVNIKEHASTTYSYTTTGAGIYLAILTGATDGRAYNPILLTASYNEENPLKGGQIDATSHYLFGEEAVAKSSQPTISKSITKSTKDGDKDTASVGEKVDYKLTVQLPSYSKDAINKTVFITDKLSQGLTFLPKSLKIIWNGQTLTKVNEEFKAGDKVIAQLKVENNGFNLNFNYDNLDNHAPEVNYSALLNENAVVGKGGNDNNVDYYYSNNPNKGETHKTTEKPKEGEGTGITKKTDKKTVYTYRVAFKKTGKDHAPLAGAVFGIYSDKEAKQLVDIVVTNAQGYAASSEVGKGTYYIKEIKSPKGYSLNTNIYEVETSWEKATTTSTTNRLETIYTTDDNQKSPGTNTVGWLEDGVFYKENPGGDAKLAYIKQSTEETSTTIEVKENQAEGSGTVLLETEIPNTKLGELPSTGSIGTYLFKAIGSAAMIGAIGIYIVKRRKA

SEQ ID NO: 253 - DNA, 1059 bp, Streptococcus agalactiae
ttggagagagaaaaaatgaaaaaaaacaaattattacttgctactgcaatcttagcaactgctttaggaacagcttctttaaatcaaaacgtaaaagctgagacggcaggggttgtaacaggaaaatcactacaagttacaaagacaatgacttatgatgatgaagaggtgttaatgcccgaaaccgcctttacttttactatagagcctgatatgactgcaagtggaaaagaaggcagcctagatattaaaaatggaattgtagaaggcttagacaaacaagtaacagtaaaatataagaatacagataaaacatctcaaaaaactaaaatagcacaatttgatttttctaaggttaaatttccagctataggtgtttaccgctatatggtttcagagaaaaacgataaaaaagacggaattacgtacgatgataaaaagtggactgtagatgtttatgttgggaataaggccaataacgaagaaggtttcgaagttctatatattgtatcaaaagaaggtacttctagtactaaaaaaccaattgaatttacaaactctattaaaactacttccttaaaaattgaaaaacaaataactggcaatgcaggagatcgtaaaaaatcattcaacttcacattaacattacaaccaagtgaatattataaaactggatcagttgtgaaaatcgaacaggatggaagtaaaaaagatgtgacgataggaacgccttacaaatttactttgggacacggtaagagtgtcatgttatcgaaattaccaattggtatcaattactatcttagtgaagacgaagcgaataaagacggctacactacaacggcaacattaaaagaacaaggcaaagaaaagagttccgatttcactttgagtactcaaaaccagaaaacagacgaatctgctgacgaaatcgttgtcacaaataagcgtgacactcaagttccaactggtgttgtagggacccttgctccatttgcagttcttagcattgtggctattggtggagttatctatattacaaaacgtaaaaaagcttaa

SEQ ID NO: 254 - protein, 352 aa, Streptococcus agalactiae; identical to SEQ ID NO: 95

SEQ ID NO: 255 - DNA, 1029 bp, Streptococcus agalactiae
  misc_feature (918)..(918): n is a, c, g, or t
  misc_feature (921)..(921): n is a, c, g, or t
  misc_feature (929)..(929): n is a, c, g, or t
  misc_feature (939)..(939): n is a, c, g, or t
  misc_feature (945)..(945): n is a, c, g, or t
  misc_feature (957)..(957): n is a, c, g, or t
  misc_feature (967)..(967): n is a, c, g, or t
  misc_feature (977)..(977): n is a, c, g, or t
  misc_feature (983)..(983): n is a, c, g, or t
  misc_feature (989)..(989): n is a, c, g, or t
  misc_feature (996)..(996): n is a, c, g, or t
  misc_feature (999)..(999): n is a, c, g, or t
  misc_feature (1002)..(1002): n is a, c, g, or t
  misc_feature (1006)..(1006): n is a, c, g, or t
  misc_feature (1017)..(1017): n is a, c, g, or t
  misc_feature (1025)..(1025): n is a, c, g, or t
atgaaaaaaaataaattattacttgctactgcaatcttagcaactgctttaggaacagcttctttaaatcaaaacgtaaaagctgagacggcaggggttgttagcagtggtcaattaacaataaaaaaatcaattacaaattttaatgatgatacacttttgatgcctaagacagactatacttttagcgttaatccggatagtgcggctacaggtactgaaagtaatttaccaattaaaccaggtattgctgttaacaatcaagatattaaggtttcttattctaatactgataagacatcaggtaaagaaaaacaagttgttgttgactttatgaaagttacttttcctagcgttggtatttaccgttatgttgttaccgagaataaagggacagcagaaggagttacatatgatgatacaaaatggttagttgacgtctatgttggtaataatgaaaagggaggtcttgaaccaaagtatattgtatctaaaaaaggagattctgctactaaagaaccaatccagtttaataattcattcgaaacaacgtcattaaaaattgaaaagaaagttactggtaatacaggagatcataaaaaagcatttaactttacattaacattgcaaccaaatgaatactatgaggcaagttcggttgtgaaaattgaagagaacggacaaacgaaagatgtgaaaattggggaggcatataagtttactttgaacgatagtcagagtgtgatattgtctaaattaccagttggtattaattataaagttgaagaagcagaagctaatcaaggtggatatactacaacagcaactttaaaagatggagaaaagttatctacttataacttaggtcaggaacataaaacagacaagactgctgatgaaatcgttgtcacaaataancgngacactcnagttccaacnggtgtngtaggcaccccncctccattcncagttcttancattgnggctantggtggngtnatntatnttacaaaacgnaaaaaagnataa

SEQ ID NO: 256 - protein, 342 aa, Streptococcus agalactiae
  misc_feature (1)..(342): X = any amino acid residue
MKKNKLLLATAILATALGTASLNQNVKAETAGVVSSGQLTIKKSITNFNDDTLLMPKTDYTFSVNPDSAATGTESNLPIKPGIAVNNQDIKVSYSNTDKTSGKEKQVVVDFMKVTFPSVGIYRYVVTENKGTAEGVTYDDTKWLVDVYVGNNEKGGLEPKYIVSKKGDSATKEPIQFNNSFETTSLKIEKKVTGNTGDHKKAFNFTLTLQPNEYYEASSVVKIEENGQTKDVKIGEAYKFTLNDSQSVILSKLPVGINYKVEEAEANQGGYTTTATLKDGEKLSTYNLGQEHKTDKTADEIVVTNXRDTXVPTGVVGTPPPFXVLXIXAXGGVXYXTKRKKX

SEQ ID NO: 257 - DNA, 803 bp, Streptococcus agalactiae
agcagtggtcaattaacaataaaaaaatcaattacaaattttaatgatgatacacttttgatgcctaagacagactatacttttagcgttaatccggatagtgcggctacaggtactgaaagtaatttaccaattaaaccaggtattgctgttaacaatcaagatattaaggtttcttattctaatactgataagacatcaggtaaagaaaaacaagttgttgttgactttatgaaagttacttttcctagcgttggtatttaccgttatgttgttaccgagaataaagggacagcagaaggagttacatatgatgatacaaaatggttagttgacgtctatgttggtaataatgaaaagggaggtcttgaaccaaagtatattgtatctaaaaaaggagattctgctactaaagaaccaatccagtttaataattcattcgaaacaacgtcattaaaaattgaaaaggaagttactggtaatacaggagatcataaaaaagcatttaactttacattaacattgcaaccaaatgaatactatgaggcaagttcggttgtgaaaattgaagagaacggacaaacgaaagatgtgaaaattggggaggcatataagtttactttgaacgatagtcagagtgtgatattgtctaaattaccagttggtattaattataaagttgaagaagcagaagctaatcaaggtggatatactacaacagcaactttaaaagatggagaaaagttatctacttataacttaggtcaggaacataaaacagacaagactgctgatgaaatcgt

SEQ ID NO: 258 - protein, 268 aa, Streptococcus agalactiae
SSGQLTIKKSITNFNDDTLLMPKTDYTFSVNPDSAATGTESNLPIKPGIAVNNQDIKVSYSNTDKTSGKEKQVVVDFMKVTFPSVGIYRYVVTENKGTAEGVTYDDTKWLVDVYVGNNEKGGLEPKYIVSKKGDSATKEPIQFNNSFETTSLKIEKEVTGNTGDHKKAFNFTLTLQPNEYYEASSVVKIEENGQTKDVKIGEAYKFTLNDSQSVILSKLPVGINYKVEEAEANQGGYTTTATLKDGEKLSTYNLGQEHKTDKTADEIV

SEQ ID NO: 259 - DNA, 803 bp, Streptococcus agalactiae; identical to SEQ ID NO: 257

SEQ ID NO: 260 - protein, 268 aa, Streptococcus agalactiae; identical to SEQ ID NO: 258

SEQ ID NO: 261 - DNA, 843 bp, Streptococcus agalactiae
gagacggcaggggttgttagcagtggtcaattaacaataaaaaaatcaattacaaattttaatgatgatacacttttgatgcctaagacagactatacttttagcgttaatccggatagtgcggctacaggtactgaaagtaatttaccaattaaaccaggtattgctgttaacaatcaagatattaaggtttcttattctaatactgataagacatcaggtaaagaaaaacaagttgttgttgactttatgaaagttacttttcctagcgttggtatttaccgttatgttgttaccgagaataaagggacagcagaaggagttacatatgatgatacaaaatggttagttgacgtctatgttggtaataatgaaaagggaggtcttgaaccaaagtatattgtatctaaaaaaggagattctgctactaaagaaccaatccagtttaataattcattcgaaacaacgtcattaaaaattgaaaaggaagttactggtaatacaggagatcataaaaaagcatttaactttacattaacattgcaaccaaatgaatactatgaggcaagttcggttgtgaaaattgaagagaacggacaaacgaaagatgtgaaaattggggaggcatataagtttactttgaacgatagtcagagtgtgatattgtctaaattaccagttggtattaattataaagttgaagaagcagaagctaatcaaggtggatatactacaacagcaactttaaaagatggagaaaagttatctacttataacttaggtcaggaacataaaacagacaagactgctgatgaaatcgttgtcacaaataaccgtgacact

SEQ ID NO: 262 - protein, 281 aa, Streptococcus agalactiae
ETAGVVSSGQLTIKKSITNFNDDTLLMPKTDYTFSVNPDSAATGTESNLPIKPGIAVNNQDIKVSYSNTDKTSGKEKQVVVDFMKVTFPSVGIYRYVVTENKGTAEGVTYDDTKWLVDVYVGNNEKGGLEPKYIVSKKGDSATKEPIQFNNSFETTSLKIEKEVTGNTGDHKKAFNFTLTLQPNEYYEASSVVKIEENGQTKDVKIGEAYKFTLNDSQSVILSKLPVGINYKVEEAEANQGGYTTTATLKDGEKLSTYNLGQEHKTDKTADEIVVTNNRDT

SEQ ID NO: 263 - DNA, 900 bp, Streptococcus agalactiae
gagacggcaggagtgtccgaaaatgcaaaattaatagtaaaaaagacatttgactcttatacagacaatgaagttttaatgccaaaagctgattatacttttaaagtagaggcagatagtacagctagtggcaaaacgaaagacggtttagagattaagccaggtattgttaatggtttaacagaacagattatcagctatactaatactgataaaccagatagtaaagttaaaagtacagagtttgatttttcaaaagtagtattccctggtattggtgtttaccgctatactgtttcagaaaaacaaggtgatgttgaaggaattacctacgatactaagaagtggacagtagatgtttatgttggaaacaaagaaggtggtggttttgaacctaagtttattgtatctaaggaacaaggaacagacgtcaaaaaaccagttaattttaacaactcgtttgcaactacttcgttaaaagttaagaagaatgtatcggggaatactggagaattgcaaaaagaatttgactttacattgacgcttaatgaaagcacgaattttaaaaaagatcaaattgtttctttacaaaaaggaaacgagaaatttgaagttaagattggtactccctacaagtttaaactcaaaaatggggaatctattcaactagacaagttaccagttggtattacttataaagtcaatgaaatggaagctaataaagatgggtataaaacaacagcatccttgaaagagggagatggtcaatctaaaatgtatcaattggatatggaacaaaaaacagacgaatctgctgacgaaatcgttgtcacaaataagcgtgacactcaagttccaactggtgttgtaggcacccttgctccatttgcagttcttagc

SEQ ID NO: 264 - protein, 300 aa, Streptococcus agalactiae
ETAGVSENAKLIVKKTFDSYTDNEVLMPKADYTFKVEADSTASGKTKDGLEIKPGIVNGLTEQIISYTNTDKPDSKVKSTEFDFSKVVFPGIGVYRYTVSEKQGDVEGITYDTKKWTVDVYVGNKEGGGFEPKFIVSKEQGTDVKKPVNFNNSFATTSLKVKKNVSGNTGELQKEFDFTLTLNESTNFKKDQIVSLQKGNEKFEVKIGTPYKFKLKNGESIQLDKLPVGITYKVNEMEANKDGYKTTASLKEGDGQSKMYQLDMEQKTDESADEIVVTNKRDTQVPTGVVGTLAPFAVLS

SEQ ID NO: 265 - DNA, 864 bp, Streptococcus agalactiae
gagacggcaggggttgtaacaggaaaatcactacaagttacaaagacaatgacttatgatgatgaagaggtgttaatgcccgaaaccgcctttacttttactatagagcctgatatgactgcaagtggaaaagaaggcgacctagatattaaaaatggaattgtagaaggcttagacaaacaagtaacagtaaaatataagaatacagataaaacatctcaaaaaactaaaatagcacaatttgatttttctaaggttaaatttccagctataggtgtttaccgctatatggtttcagagaaaaacgataaaaaagacggaattaggtacgatgataaaaagtggactgtagatgtttatgttgggaataaggccaataacgaagaaggtttcgaagttctatatattgtatcaaaagaaggtacttctagtactaaaaaaccaattgaatttacaaactctattaaaactacttccttaaaaattgaaaaacaaataactggcaatgcaggagatcgtaaaaaatcattcaacttcacattaacattacaaccaagtgaatattataaaaccggatcagttgtgaaaatcgaacaggatggaagtaaaaaagatgtgacgataggaacgccttacaaatttactttgggacacggtaagagtgtcatgttatcgaaattaccaattggtatcaattactatcttagtgaagacgaagcgaataaagacggttacactacaacggcaacattaaaagaacaaggcaaagaaaagagttccgatttcactttgagtactcaaaaccagaaaacagacgaatctgctgacgaaatcgttgtcacaaataagcgtgacactctcgag

SEQ ID NO: 266 - protein, 288 aa, Streptococcus agalactiae
ETAGVVTGKSLQVTKTMTYDDEEVLMPETAFTFTIEPDMTASGKEGDLDIKNGIVEGLDKQVTVKYKNTDKTSQKTKIAQFDFSKVKFPAIGVYRYMVSEKNDKKDGIRYDDKKWTVDVYVGNKANNEEGFEVLYIVSKEGTSSTKKPIEFTNSIKTTSLKIEKQITGNAGDRKKSFNFTLTLQPSEYYKTGSVVKIEQDGSKKDVTIGTPYKFTLGHGKSVMLSKLPIGINYYLSEDEANKDGYTTTATLKEQGKEKSSDFTLSTQNQKTDESADEIVVTNKRDTLE

SEQ ID NO: 267 - DNA, 1446 bp, Streptococcus agalactiae
aaagatgatactgcacaactaaagataacaaatattgaaggtgggccaacagtaacactttataaaataggagaaggtgtttacaacactaatggtgattcttttattaactttaaatatgctgagggggtttctttaactgaaacaggacctacatcacaagaaattactactattgcaaatggtattaatacgggtaaaataaagccttttagtactgaaaacgttagtatttctaatggaacagcaacttataatgcgagaggtgcatctgtttatattgcattattaacaggtgcgacagatggccgtacctacaatcctattttattagctgcatcttataatggtgagggaaatttagttactaaaaatattgattccaaatctaattatttatatggacaaacaagtgttgcaaaatcatcattaccatctattacaaagaaagtaaccgggacaatagatgacgtgaataaaaagactacctcgttaggaagtgtattgtcttattcgctgacatttgaattaccaagttataccaaagaagcagtcaataaaacagtatatgtttctgataatatgtcggaaggtcttacttttaactttaatagtcttacagtagaatggaaaggtaagatggctaatattactgaagatggttcagtaatggtagaaaatacaaaaatcggaatagctaaggaggttaataacggttttaatttaagttttatttatgatagtttagaatctatatcaccaaatataagttataaagctgttgtaaacaataaagctattgttggtgaagagggtaatcctaataaagctgaattcttctattcaaataatccaacaaaaggtaatacatacgataatttagataagaagcctgataaagggaatggtattacatccaaagaagattctaaaattgtttatacttatcaaatagcgtttagaaaagttgatagtgttagtaagaccccacttattggtgcaatttttggagtttatgatactagtaataaattaattgatattgttacaaccaataaaaatggatatgctatttcaacacaagtatcttcaggaaaatataaaattaaggaattaaaagctcctaaaggttattcattgaatacagaaacttatgaaattacggcaaattgggtaactgctacagtcaagacaagtgctaattcaaaaagtactacttatacatctgataaaaataaggcgacagataattcagagcaagtaggatggttaaaaaatggtatattctattctatagatagtagacctacaggaaatgatgttaaagaggcttatattgaatctactaaggctttaactgatggaacaactttctcaaaatcgaatgaaggttcaggtacagtattattagaaactgacatccctaacaccaagctaggtgaactc

SEQ ID NO: 268 - protein, 482 aa, Streptococcus agalactiae
KDDTAQLKITNIEGGPTVTLYKIGEGVYNTNGDSFINFKYAEGVSLTETGPTSQEITTIANGINTGKIKPFSTENVSISNGTATYNARGASVYIALLTGATDGRTYNPILLAASYNGEGNLVTKNIDSKSNYLYGQTSVAKSSLPSITKKVTGTIDDVNKKTTSLGSVLSYSLTFELPSYTKEAVNKTVYVSDNMSEGLTFNFNSLTVEWKGKMANITEDGSVMVENTKIGIAKEVNNGFNLSFIYDSLESISPNISYKAVVNNKAIVGEEGNPNKAEFFYSNNPTKGNTYDNLDKKPDKGNGITSKEDSKIVYTYQIAFRKVDSVSKTPLIGAIFGVYDTSNKLIDIVTTNKNGYAISTQVSSGKYKIKELKAPKGYSLNTETYEITANWVTATVKTSANSKSTTYTSDKNKATDNSEQVGWLKNGIFYSIDSRPTGNDVKEAYIESTKALTDGTTFSKSNEGSGTVLLETDIPNTKLGEL

SEQ ID NO: 269 - DNA, 799 bp, Streptococcus agalactiae
gaatggaaaggtaagatggctaatattactgaagatggttcagtaatggtagaaaatacaaaaatcggaatagctaaggaggttaataacggttttaatttaagttttatttatgatagtttagaatctatatcaccaaatataagttataaagctgttgtaaacaataaagctattgttggtgaagagggtaatcctaataaagctgaattcttctattcaaataatccaacaaaaggtaatacatacgataatttagataagaagcctgataaagggaatggtattacatccaaagaagattctaaaattgtttatacttatcaaatagcgtttagaaaagttgatagtgttagtaagaccccacttattggtgcaatttttggagtttatgatactagtaataaattaattgatattgttacaaccaataaaaatggatatgctatttcaacacaagtatcttcaggaaaatataaaattaaggaattaaaagctcctaaaggttattcattgaatacagaaacttatgaaattacggcaaattgggtaactgctacagtcaagacaagtgctaattcaaaaagtactacttatacatctgataaaaataaggcgacagataattcagagcaagtaggatggttaaaaaatggtatattctattctatagatagtagacctacaggaaatgatgttaaagaggcttatattgaatctactaaggctttaactgatggaacaactttctcaaaatcgaatgaaggttcaggtacagtattattagaaactgacatcc

SEQ ID NO: 270 - protein, 266 aa, Streptococcus agalactiae
EWKGKMANITEDGSVMVENTKIGIAKEVNNGFNLSFIYDSLESISPNISYKAVVNNKAIVGEEGNPNKAEFFYSNNPTKGNTYDNLDKKPDKGNGITSKEDSKIVYTYQIAFRKVDSVSKTPLIGAIFGVYDTSNKLIDIVTTNKNGYAISTQVSSGKYKIKELKAPKGYSLNTETYEITANWVTATVKTSANSKSTTYTSDKNKATDNSEQVGWLKNGIFYSIDSRPTGNDVKEAYIESTKALTDGTTFSKSNEGSGTVLLETDI

SEQ ID NO: 271 - DNA, 643 bp, Streptococcus agalactiae
  misc_feature (165)..(165): n is a, c, g, or t
  misc_feature (250)..(250): n is a, c, g, or t
  misc_feature (360)..(360): n is a, c, g, or t
  misc_feature (369)..(369): n is a, c, g, or t
  misc_feature (498)..(498): n is a, c, g, or t
  misc_feature (549)..(549): n is a, c, g, or t
  misc_feature (559)..(559): n is a, c, g, or t
gtaacagtaaaatataagaatacagataaaacatctcaaaaaactaaaatagcacaatttgatttttctaaggttaaatttccagctataggtgtttaccgctatatggtttcagagaaaaacgataaaaaagacggaattacgtacgatgataaaaagtggacngtagatgtttatgttgggaataaggccaataacgaagaaggtttcgaagttctatatattgtatcaaaagaaggtacttctagtnctaaaaaaccaattgaatttacaaactctattaaaactacttccttaaaaattgaaaaacaaataactggcaatgcaggagatcgtaaaaaatcattcaacttcacattnacattacanccaagtgaatattataaaactggatcagttgtgaaaatcgaacaggatggaagtaaaaaagatgtgacgataggaacgccttacaaatttactttgggacacggtaagagtgtcatgttatcgaaattnccaattggtatcaattactatcttagtgaagacgaagcgaataaagacggntacactacancggcaacattaaaagaacaaggcaaagaaaagagttccgatttcactttgagtactcaaaaccagaaaacagacgaatctgctg

SEQ ID NO: 272 - protein, 214 aa, Streptococcus agalactiae
  misc_feature (84)..(84): Xaa can be any naturally occurring amino acid
  misc_feature (120)..(120): Xaa can be any naturally occurring amino acid
  misc_feature (123)..(123): Xaa can be any naturally occurring amino acid
  misc_feature (166)..(166): Xaa can be any naturally occurring amino acid
  misc_feature (187)..(187): Xaa can be any naturally occurring amino acid
VTVKYKNTDKTSQKTKIAQFDFSKVKFPAIGVYRYMVSEKNDKKDGITYDDKKWTVDVYVGNKANNEEGFEVLYIVSKEGTSSXKKPIEFTNSIKTTSLKIEKQITGNAGDRKKSFNFTXTLXPSEYYKTGSVVKIEQDGSKKDVTIGTPYKFTLGHGKSVMLSKXPIGINYYLSEDEANKDGYTTXATLKEQGKEKSSDFTLSTQNQKTDESA

SEQ ID NO: 273 - DNA, 380 bp, Streptococcus agalactiae
ttgatagaccgccttcattatcatttctagaatttttctttaggtttgtaaagactacaaaataaaatgatgaaaacaactatcttgtggatacactaaaaagacacgctaattagcaaactctctcttcatcatctctcaccattattatactactatttatatgacaaataaaggtgattttgttaaaatataactttgaaaatccacatatatttttaatcttccgtctgaaaaaataaataaaaatagtaaaaataaacacgaatttaaaataagcaaattttttaagaaaatctgtgctaaactttaatagttttgtgcttaataataatcagcacttacaaagaacaaagggaaaagcgaggagagaactttta

SEQ ID NO: 274 - DNA, 24 bp, Streptococcus agalactiae
actttctaatgagttgtttaggcg

SEQ ID NO: 275 - DNA, 24 bp, S. agalactiae
ctggtcgataactccttcaatctt

SEQ ID NO: 276 - DNA, 24 bp, S. agalactiae
gaatgcgatattcaggaccaacta

SEQ ID NO: 277 - DNA, 24 bp, S. agalactiae
tgtatacaagtgtgtcattgccag

SEQ ID NO: 278 - DNA, 23 bp, S. agalactiae
gcggtctttagtcttcaaaaaca

SEQ ID NO: 279 - DNA, 25 bp, S. agalactiae
ttgcttaagtaagagagaaaggagc

SEQ ID NO: 280 - DNA, 24 bp, S. agalactiae
ggcaatgttgactttatgaaggtg

SEQ ID NO: 281 - DNA, 24 bp, S. agalactiae
tgagattttctcgtttctcttagc

SEQ ID NO: 282 - DNA, 24 bp, S. agalactiae
ccgacgaactttgatgatttattg

SEQ ID NO: 283 - DNA, 23 bp, S. agalactiae
aatgactttgagcctgtcttgat

SEQ ID NO: 284 - DNA, 23 bp, S. agalactiae
gccatttggatcagctaaaagtt

SEQ ID NO: 285 - DNA, 24 bp, S. agalactiae
agcgacaagccactgtatcatatt

SEQ ID NO: 286 - DNA, 23 bp, S. agalactiae
gtacgacaaaagtgtggcttgtt

SEQ ID NO: 287 - DNA, 24 bp, S. agalactiae
atctcactgagttaatccgttcac

SEQ ID NO: 288 - DNA, 24 bp, S. agalactiae
catcttcacctgttctcacatttt

SEQ ID NO: 289 - DNA, 24 bp, S. agalactiae
caagagaaaaacacagagccataa

SEQ ID NO: 290 - DNA, 24 bp, S. agalactiae
caggagtatagtgtccgctttctt

SEQ ID NO: 291 - DNA, 25 bp, S. agalactiae
tatcagcatccctttatcttcaaac

SEQ ID NO: 292 - DNA, 25 bp, S. agalactiae
aatagacgatgggtattgatcatgt

SEQ ID NO: 293 - DNA, 24 bp, S. agalactiae
accaacagacgatgactgttaatc

SEQ ID NO: 294 - DNA, 24 bp, S. agalactiae
ttctacaatttcctggccattatc

SEQ ID NO: 295 - DNA, 24 bp, S. agalactiae
tttttcaacccactacagttgaca

SEQ ID NO: 296 - DNA, 13039 bp, S. agalactiae
taacacggattggaaataacatcaatcaaattgcgcgtgctatcaaccaaagccatctaatttctcaggctcagtatcactttcatcgagaagcacgttaagcccaacagcagggggggttgctctgattcggttaagtaataagcaaaatcctcaccaattttcccagtaataagaggcgttgttgaggtatagggattacctgtgccatagtcgatgatggtcacaaaatgaccattccccataaaagggccaaccaaaacttcacctgtggtttggatgtacccctccgttttttgatgtcaacaccagtattttggatgtaccccttaacatgccctttggtatctgcaacagagataatatgaccaaaggaagaatcaccgatgactttaaccgtaatcttgctatcgcctttttgattagccgctaatatttgattagcaatcagggtgcgaccaagagcaactgttgaagacgacaaggtatgatgtttttcctgagccaatttaacagtctcggtgctatcgaggacataagacctgaaggcaccagaggcagaaattgatttaataattttatccataacctatgttatagcacaaagagagagtttgtatggactggattagctgaaaattttagactaaaaagtagtgccagtggattttgaaaggtaacaaaagagtcttccgtttaaacgagaaggctgtttttagtcgtttcagatgaaggcaaaaggacgatgaaataattccgtaccttcatggattgctatgttactggcatgaggtctcacgatatttagtaagatattcgtttgaagatattcccacgtattttttaaaggttttaagaaaatgtgtggtgtcgtaaaaatgtaataatttcgctacttccccaatcggtacccctctttgcagtagtaattgtccctccttaatttttgcctttagaatataactttgcaaggaaatgtcagagtattttttaaaaactgagcgtaagtgggaatctgagatatataggtagttggcaatatcagatactttgagtttggagtagaggtggttgtccacataatggagaatactattgtacatttgctgcttgtcagagatgctcttattggttaaggattctgaaaaatcaataagagctgcacagcgaattcttgaaacatcaataagatcaggagcctcttcgtttaaagccatatagtgctttaccagcgcataacttttagccacatcagtattttcctcgaaacttaattctagtaattttgttaagtaaacaacagttaagttcttttcagctcttagggcagggattgaagatgaggtaacactggatgatgggaggcgattaatttcttgctttaacagttgagtgttacccagcttaacgagatcaataatgtgattgagatggtttaaaacagtgggtaactgaaaagagtttttcttagtatgttttaggtgaagaacaatatcaggatccgcaacaatctgttctgactcttctaataaatgattgatggcttgttggcaactagcctcaaactgtgtttggaaaaaggcatcgatagacacaagaagactacgtatactggtagtaggaaaacaagggacaagctttatataggataagatttcttttttactgattttgttaaaatattacgatgagaaaattgttctagaaagcgactggataactgttcttgcctattgatatcagggctatagggataaaatggtccaatagcaataagatattgacagacaggaaaaattaagaatgattcttcaaaaagaccctcataaacagtgatatcttggttataagggatagctaaatgttttaaaaactgatagtaaggcaacagatagtcttcgttaccatataactgaacgagttccttgtctcgtgacatgactgaaataggtagttgagatatggtatgcaatgtttgaacatgtttaaaatcgaatgtaaccatttgatagaccgccttcattatcatttctagaatttttctttaggtttgtaaagactacaaaataaaatgatgaaaacaactatcttgtggatacactaaaaagacacgctaattagcaaactctctcttcatcatctctcaccattattatactactatttatatgacaaataaaggtgattttgttaaaaatataactttgaaaatccacatatatttttaatcttccgtctgaaaaaataaataaaaatagtaaaaataaacacgaatttaaaataagcaaattttttaagaaaatctgtgctaaactttaatagttttgtgcttaataataatcagcacttacaaagaacaaagggaaaagcgaggagagaacttttaatgaaattatcgaagaagttattgttttcggctgctgttttaacaatggtggcggggtcaactgttgaaccagtagctcagtttgcgactggaatgagtattgtaagagctgcagaagtgtcacaagaacgcccagcgaaaacaacagtaaatatctataaattacaagctgatagttataaatcggaaattacttctaatggtggtatcgagaataaagacggcgaagtaatatctaactatgctaaacttggtgacaatgtaaaaggtttgcaaggtgtacagtttaaacgttataaagtcaagacggatatttctgttgatgaattgaaaaaattgacaacagttgaagcagcagatgcaaaagttggaacgattcttgaagaaggtgtcagtctacctcaaaaaactaatgctcaaggtttggtcgtcgatgctctggattcaaaaagtaatgtgagatacttgtatgtagaagatttaaagaattcaccttcaaacattaccaaagcttatgctgtaccgtttgtgttggaattaccagttgctaactctacaggtacaggtttcctttctgaaattaatatttaccctaaaaacgttgtaactgatgaaccaaaaacagataaagatgttaaaaaattaggtcaggacgatgcaggttatacgattggtgaagaattcaaatggttcttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactaggtggtgctgagtttgatttgttggcttctgatgggacagcagtaaaatggacagatgctcttattaaagcgaatactaataaaaactatattgctggagaagctgttactgggcaaccaatcaaattgaaatcacatacagacggtacgtttgagattaaaggtttggcttatgcagttgatgcgaatgcagagggtacagcagtaacttacaaattaaaagaaacaaaagcaccagaaggttatgtaatccctgataaagaaatcgagtttacagtatcacaaacatcttataatacaaaaccaactgacatcacggttgatagtgctgatgcaacacctgatacaattaaaaacaacaaacgtccttcaatccctaatactggtggtattggtacggctatctttgtcgctatcggtgctgcggtgatggcttttgctgttaaggggatgaagcgtcgtacaaaagataactaaataaaaggctacttcttaagtaaccatgtttaagaaaagagaaatagccttatttctctttttgtcgtttttaaaataaaggaacatcatgaaacaaacattaaaacttatgttttcttttctgttgatgttagggactatgtttggaattagccaaactgttttagcgcaagaaactcatcagttgacgattgttcatcttgaagcaagggatattgatcgtccaaatccacagttggagattgcccctaaagaagggactccaattgaaggagtactctatcagttgtaccaattaaaatcaactgaagatggcgatttgttggcacattggaattccctaactatcacagaattgaaaaaacaggcgcagcaggtttttgaagccactactaatcaacaaggaaaggctacatttaaccaactaccagatggaatttattatggtctggcggttaaagccggtgaaaaaaatcgtaatgtctcagctttcttggttgacttgtctgaggataaagtgatttatcctaaaatcatctggtccacaggtgagttggacttgcttaaagttggtgtggatggtgataccaaaaaaccactagcaggcgttgtctttgaactttatgaaaagaatggtaggactcctattcgtgtgaaaaatggggtgcattctcaagatattgacgctgcaaaacatttagaaacagattcatcagggcatatcagaatttccgggctcatccatggggactatgtcttaaaagaaatcgagacacagtcaggatatcagatcggacaggcagagactgctgtgactattgaaaaatcaaaaacagtaacagtaacgattgaaaataaaaaagttccgacacctaaagtgccatctcgaggaggtcttattcccaaaacaggtgagcaacaggcaatggcacttgtaattattggtggtattttaattgctttagccttacgattactatcaaaacatcggaaacatcaaaataaggattagcatgggacaaaaatcaaaaatatctctagctacgaatattcgtatatggatttttcgtttaattttcttagcgggtttccttgttttggcatttcccatcgttagtcaggtcatgtactttcaagcctctcacgccaatattaatgcttttaaagaagctgttaccaagattgaccgggtggagattaatcggcgtttagaacttgcttatgcttataacgccagtatagcaggtgccaaaactaatggcgaatatccagcgcttaaagacccctactctgctgaacaaaagcaggcaggggtcgttgagtacgcccgcatgcttgaagtcaaagaacaaataggtcatgtgattattccaagaattaatcaggatatccctatttacgctggctctgctgaagaaaatcttcagaggggcgttggacatttagaggggaccagtcttccagtcggtggtgagtcaactcatgccgttctaactgcccatcgagggctaccaacggccaagctatttaccaatttagacaaggtaacagtaggtgaccgtttttacattgaacacatcggcggaaagattgcttatcaggtagaccaaatcaaagttatcgcccctgatcagttagaggatttgtacgtgattcaaggagaagatcacgtcaccctattaacttgcacaccttatatgataaatagtcatcgcctcctcgttcgaggcaagcgaattccttatgtggaaaaaacagtgcagaaagattcaaagaccttcaggcaacaacaatacctaacctatgctatgtgggtagtcgttggacttatcttgctgtcgcttctcatttggtttaaaaagacgaaacagaaaaagcggagaaagaatgaaaaagcggctagtcaaaatagtcacaataattcgaaataataaaatcagaaccctcatttttgtgatgggaagtctgattctcttatttccgattgtgagccaggtaagttactaccttgcttcgcatcaaaatattaatcaatttaagcgggaagtcgctaagattgatactaatacggttgaacgacgcatcgctttagctaatgcttacaatgagacgttatcaaggaatcccttgcttatagacccttttaccagtaagcaaaaagaaggtttgagagagtatgctcgtatgcttgaagttcatgagcaaataggtcatgtggcaatcccaagtattggggttgatattccaatttatgctggaacatccgaaactgtgcttcagaaaggtagtgggcatttggagggaaccagtcttccagtgggaggtttgtcaacccattcagtactaactgcccaccgtggcttgccaacagctaggctatttaccgacttaaataaagttaaaaaaggccagattttctatgtgacgaacatcaaggaaacacttgcctacaaagtcgtgtctatcaaagttgtggatccaacagctttaagtgaggttaagattgtcaatggtaaggattatataaccttgctgacttgcacaccttacatgatcaatagtcatcgtctcttggtaaaaggagagcgtattccttatgattctaccgaggcggaaaagcacaaagaacaaaccgtacaagattatcgtttgtcactagtgttgaagatactactagtattattaattggactcttcatcgtgataatgatgagaagatggatgcaacatcgtcaataacgatgttgtgaatggcttacttacttatcaaataggtgactaatgatgattgtgaataatggttatctagaagggagaaaaatgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaattacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattgtaaggtgtcgttgaaattattaaataatagaaaatgactagttttggcctttccctattgtcagtcagattagttattatcaagcttctcatgccaatattaatgcctttaaaagaacagttacaaccattgaccgtacggagattcaacgacggttaggtctggctaaagcctacaatgctagtatttctggaacaagtagtcagtcgactcaatctgtgctgagagattcttattctgaggagcaaaaaaggcagggtggactgaatacgctaggatgttagaagtcagagagcaggttgaccatgtgatgattccaaaaatcaatcaggatttaccaatctacgctggttcagaagaggacaatctgcaacggggagttggtcatctagaagggataagtttgccgattggaggggcttctacacatgcggtcttgagcggtcaaagaggtatgccagctgctcggttgtttgcggatttggataagatgaaaaaaggtgattatttttatgttaccaatctgaaagaaaccttggcttatcaagtggatcgtatcatggtgattgaacctagccaattggatgccgtgagcattgaagaggataaagattatgttacccttctgacctgtacaccttatatgggctctttgtcaactgtaatgggtgacttatcattaacaacgagagagaatcagcttggttctctctctttttggatgttcaaagcgatgagaattttgcttttaaaatttttaaagttgcgaaagccaaaggcttgtcgcttgatgtctttgataagcttgttggtcgcttctaatttggcattggaaagggatagctgagggcgtttgtgatgtaagttttgtacttcatgaaggtcctaaagaccattttaaaagcagaattgccagttgttacgttatcatctatgaagctaaagaattcagttgttcgcttttcttagaaatgaaagagtatgagctgataaaggtcgttataatagcggagctcatctgagaaaacttttatacctcaaagtcagtctagctttgatatcatgaagccattaggagttattccttatcttttagtggcgcgcgatccatatagtgatagatcgagatatttagatccaaaagttctatcatcctcttttggcgccttttttccagcagataatattaaggtagcttggtctaacaactccagcactttatttacaccacctattaatgcaaactacaccactcagattcaagctattgggacaacgattaagtcacaaattccggaatcgattttgacggttacggataaaaagagcaggaagttcagcattaacaagattgacgaagctaaagaaggcttagtaggtgcgaccttcaccttgtctaaacgcacaacagtagcggcagatcatcaagtacaaggagatttcattcctgtcagcaaagagacgacagtcggtcggacaacccttacctttgacaaccttaaacctggattttatgaccttaaagaaacgaaagcgccgaatgcttacgtacttgatcctaagacttatgttgtggtcgttcaaaattcaggaaaaacgacaattgtggatgaagctaacttcaaagaggctgattacccaatggctgataataccagccatgtggagtgcgtagcgttgctacaacgaagcaaagggtaaaaatcctttattttaagcactttttcaagcattttgtctttattgaaaagagtgattttaacataaaaaaggtattaaaaaacatattgacgtgaccgtttgttttgaagtggcttgcgtagacaaaaaaatagatacgtcagataaatttctggcattacgagaacatttttagagtgttctctttttttagtttacggaggaaaaatatatatggaaaaacaggattcacgagttctcatccattgggaggggaattctggggacaagctcattgaacaccaaaccagcgcaacggggtggtactaccaagtcgatcgtagctttagtcaaccaaaaggggaaccgcccagaatgatccaaaggcactagaaagtgtccgtaatgattcgatttcgggcggtgatgatgtcatgggttatgcttatagcaaatgtacttggggagttgcggcacgaattaatcagtgggactgaaactcaaaggttgaaatggtgagaagattaccattaccagttcaatgggaaatggtcaggattgggttggaacagccgaaagactagatggtgaaactgatacagttccaaaagaaggtactattctctctttttaggaaagtagttatggttcgtatataggctacggaactatatctttcgtcacattacatctacagatagtaccatgaattttgcttatatgaccaagtaaagtgaggatatactaacaaatgaaatatttattatcgtatttgtccattttatcgaaaagtttgcatattatcattatgtttgataagatgcaaatataatgatagtaggagctaaatatggatatttaaaaaatcaagagtatcctaagtgctttccattttgaaattcaaatatagctaatagttctagaacttctaattgtttttcgtcgacgatatgaattttcaatcttaactgttaggattccacctccctttggttaaagaaaaaaggtcaggtcgtttagataactttgtcaaacaagctcaagctatctaaaaatagtttgaaatgggcattactctagtttttaataagctatctgatgagcagaaggagaagttaatgcatgttgggaagtcttattttgactatcaagaaaatgctcttatcccacaattaggttttctatattctaaattaactaaaaaaattgaacttgataatcggttgtctccgactgaacaaaagttattgattaccttattattacatactaaaggtttaatcattgatatgtaagaagtaagtcagctaaccgatctttctattctaaaacttatattgttgctttagaaattttaaagagcgtggatggcttcataataaacagaaatcttaccaatttgcgaagccaaaaaatatgatatttgaagagtccaaagatctaatagatagtccagttagagaagcgttgattataagtgataaggattttcaaaaattaaaacaagagctattattttaaccgacttattttaaagacttatcatatctaggcttgcttgatgattcggaaaaatacggagactatactatttcaaggaaaagatacaaaagtttcgaatcaagtcttcaactatacatccttcaaagtcatcggctagagatttggaattatgaaccaatccctttgattactagaaaaataaatagcttggagaggctaacgtgacactggttgatccaatctcgctttatttaacactaagaatgatgaagaccctcgtattgaagaagaagttgagcagctagaagataagat

SEQ ID NO: 297 - DNA, 13001 bp, S. agalactiae
taacacggattggaaataacatcaatcaaattgcgcgtgctatcaaccaaagccatctaatttctcaggctcagtatcactttcatcgagaagcacgttaagcccaacagcaggggggttgctctgattcggttaagtaataagcaaaatcctcaccaattttcccagtaataagaggcgttgttgaggtatagggattacctgtgccatagtcgatgatggtcacaaaatgaccattccccataaaagggccaaccaaaacttcacctgtgaccgttttttgatgtcaacaccagtattttggatgtaccccttaacatgccctttggtatctgcaacagagataatatgaccaaaggaagaatcaccgatgactttaaccgtaatcttgctatcgcctttttgattagccgctaatatttgattagcaatcagggtgcgaccaagagcaactgttgaagacgacaaggtatgatgtttttcctgagccaatttaacagtctcggtgctatcgaggacataagacctgaaggcaccagaggcagaaattgatttaataattttatccataacctatgttatagcacaaagagagagtttgtatggactggattagctgaaaattttagactaaaaagtagtgccagtggattttgaaaggtaacaaaagagtcttccgtttaaacgagaaggctctttttagtcgtttcagatgaaggcaaaaggacgatgaaataattccgtaccttcatggattgctatgttactggcatgaggtctcacgatatttagtaagatattcgtttgaagatattcccacgtattttttaaaggttttaagaaaatgtgtggtgtcgtaaaaatgtaataatttcgctacttccccaatcggtacccctctttgcagtagtaattgtccctccttaatttttgcctttagaatataactttgcaaggaaatgtcagagtattttttaaaaactgagcgtaagtgggaatctgagatatataggtagttggcaatatcagatactttgagtttggagtagaggtggttgtccacataatggagaatactattgtacatttgctgcttgtcagagatgctcttattggttaaggattctgaaaaatcaataagagctgcacagcgaattcttgaaacatcaataagatcaggagcctcttcgtttaaagccatatagtgctttaccagcgcataacttttagccacatcagtattttcctcgaaacttaattctagtaattttgttaagtaaacaacagttaagttcttttcagctcttagggcagggattgaagatgaggtaacactggatgatgggaggcgattaatttcttgctttaacagttgagtgttacccagcttaacgagatcaataatgtgattgagatggtttaaaacagtgggtaactgaaaagagtttttcttagtatgttttaggtgaagaacaatatcaggatccgcaacaatctgttctgactcttctaataaatgattgatgacttgttggcaactagcctcaaactgtgtttggaaaaaggcatcgatagacacaagaagactacgtatactggtagtaggaaaacaagggacaagctttatataggataagatttcttttttattacgatgagaaaattgttctagaaagcgactggataactgttcttgcctattgatatcagggctatagggataaaatggtccaatagcaataagatattgacagacaggaaaaattaagaatgattcttcaaaaagaccctcataaacagtgatatcttggttataagggatagctaaatgttttaaaaactgatagtaaggcaacagatagtcttcgttaccatataactgaacgagttccttgtctcgtgacatgactgaaataggtagttgagatatggtatgcaatgtttgaacatgtttaaaatcgaatgtaaccatttgatagaccgccttcattatcatttctagaatttttctttaggtttgtaaagactacaaaataaaatgatgaaaacaactatcttgtggatacactaaaaagacacgctaattagcaaactctctcttcatcatctctcaccattattatactactatttatatgacaaataaaggtgattttgttaaaatataactttgaaaatccacatatatttttaatcttccgtctgaaaaaataaataaaaatagtaaaaataaacacgaatttaaaataagcaaattttttaagaaaatctgtgctaaactttaatagttttgtgcttaataataatcagcacttacaaagaacaaagggaaaagcgaggagagaacttttaatgaaattatcgaagaagttattgttttcggctgctgttttaacaatggtggcggggtcaactgttgaaccagtagctcagtttgcgactggaatgagtattgtaagagctgcagaagtgtcacaagaacgcccagcgaaaacaacagtaaatatctataaattacaagctgatagttataaatcggaaattacttctaatggtggtatcgagaataaagacggcgaagtaatatctaactatgctaaacttggtgacaatgtaaaaggtttgcaaggtgtacagtttaaacgttataaagtcaagacggatatttctgttgatgaattgaaaaaattgacaacagttgaagcagcagatgcaaaagttggaacgattcttgaagaaggtgtcagtctacctcaaaaaactaatgctcaaggtttggtcgtcgatgctctggattcaaaaagtaatgtgagatacttgtatgtagaagatttaaagaattcaccttcaaacattaccaaagcttatgctgtaccgtttgtgttggaattaccagttgctaactctacaggtacaggtttcctttctgaaattaatatttaccctaaaaacgttgtaactgatgaaccaaaaacagataaagatgttaaaaaattaggtcaggacgatgcaggttatacgattggtgaagaattcaaatggttcttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactaggtggtgctgagtttgatttgttggcttctgatgggacagcagtaaaatggacagatgctcttattaaagcgaatactaataaaaactatattgctggagaagctgttactgggcaaccaatcaaattgaaatcacatacagacggtacgtttgagattaaaggtttggcttatgcagttgatgcgaatgcagagggtacagcagtaacttacaaattaaaagaaacaaaagcaccagaaggttatgtaatccctgataaagaaatcgagtttacagtatcacaaacatcttataatacaaaaccaactgacatcacggttgatagtgctgatgcaacacctgatacaattaaaaacaacaaacgtccttcaatccctaatactggtggtattggtacggctatctttgtcgctatcggtgctgcggtgatggcttttgctgttaaggggatgaagcgtcgtacaaaagataactaaataaaaggctacttcttaagtaaccatgtttaagaaaagagaaatagccttatttctctttttgtcgtttttaaaataaaggaacatcatgaaacaaacattaaaacttatgttttcttttctgttgatgttagggactatgtttggaattagccaaactgttttagcgcaagaaactcatcagttgacgattgttcatcttgaagcaagggatattgatcgtccaaatccacagttggagattgcccctaaagaagggactccaattgaaggagtactctatcagttgtaccaattaaaatcaactgaagatggcgatttgttggcacattggaattccctaactatcacagaattgaaaaaacaggcgcagcaggtttttgaagccactactaatcaacaaggaaaggctacatttaaccaactaccagatggaatttattatggtctggcggttaaagccggtgaaaaaaatcgtaatgtctcagctttcttggttgacttgtctgaggataaagtgatttatcctaaaatcatctggtccacaggtgagttggacttgcttaaagttggtgtggatggtgataccaaaaaaccactagcaggcgttgtctttgaactttatgaaaagaatggtaggactcctattcgtgtgaaaaatggggtgcattctcaagatattgacgctgcaaaacatttagaaacagattcatcagggcatatcagaatttccgggctcatccatggggactatgtcttaaaagaaatcgagacacagtcaggatatcagatcggacaggcagagactgctgtgactattgaaaaatcaaaaacagtaacagtaacgattgaaaataaaaaagttccgacacctaaagtgccatctcgaggaggtcttattcccaaaacaggtgagcaacaggcaatggcacttgtaattattggtggtattttaattgctttagccttacgattactatcaaaacatcggaaacatcaaaataaggattagcatgggacaaaaatcaaaaatatctctagctacgaatattcgtatatggatttttcgtttaattttcttagcgggtttccttgttttggcatttcccatcgttagtcaggtcatgtactttcaagcctctcacgccaatattaatgcttttaaagaagctgttaccaagattgaccgggtggagattaatcggcgtttagaacttgcttatgcttataacgccagtatagcaggtgccaaaactaatggcgaatatccagcgcttaaagacccctactctgctgaacaaaagcaggcaggggtcgttgagtacgcccgcatgcttgaagtcaaagaacaaataggtcatgtgattattccaagaattaatcaggatatccctatttacgctggctctgctgaagaaaatcttcagaggggcgttggacatttagaggggaccagtcttccagtcggtggtgagtcaactcatgccgttctaactgcccatcgagggctaccaacggccaagctatttaccaatttagacaaggtaacagtaggtgaccgtttttacattgaacacatcggcggaaagattgcttatcaggtagaccaaatcaaagttatcgcccctgatcagttagaggatttgtacgtgattcaaggagaagatcacgtcaccctattaacttgcacaccttatatgataaatagtcatcgcctcctcgttcgaggcaagcgaattccttatgtggaaaaaacagtgcagaaagattcaaagaccttcaggcaacaacaatacctaacctatgctatgtgggtagtcgttggacttatcttgctgtcgcttctcatttggtttaaaaagacgaaacagaaaaagcggagaaagaatgaaaaagcggctagtcaaaatagtcacaataattcgaaataataaaatcagaaccctcatttttgtgatgggaagtctgattctcttatttccgattgtgagccaggtaagttactaccttgcttcgcatcaaaatattaatcaatttaagcgggaagtcgctaagattgatactaatacggttgaacgacgcatcgctttagctaatgcttacaatgagacgttatcaaggaatcccttgcttatagacccttttaccagtaagcaaaaagaaggtttgagagagtatgctcgtatgcttgaagttcatgagcaaataggtcatgtggcaatcccaagtattggggttgatattccaatttatgctggaacatccgaaactgtgcttcagaaaggtagtgggcatttggagggaaccagtcttccagtgggaggtttgtcaacccattcagtactaactgcccaccgtggcttgccaacagctaggctatttaccgacttaaataaagttaaaaaaggccagattttctatgtgacgaacatcaaggaaacacttgcctacaaagtcgtgtctatcaaagttgtggatccaacagctttaagtgaggttaagattgtcaatggtaaggattatataaccttgctgacttgcacaccttacatgatcaatagtcatcgtctcttggtaaaaggagagcgtattccttatgattctaccgaggcggaaaagcacaaagaacaaaccgtacaagattatcgtttgtcactagtgttgaagatactactagtattattaattggactcttcatcgtgataatgatgagaagatggatgcaacatcgtcaataacgatgttgtgaatggcttacttatcaaataggtgactaatgatgattgtgaataatggttatctagaagggagaaaaatgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaattacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattgtaaggtgtcgttgaaattattaaataatagaaaatgactagttttggcctttccctattgtcagtcagattagttattatcaagcttctcatgccaatattaatgcctttaaaagaacagttacaaccattgaccgtacggagattcaacgacggttaggtctggctaaagcctacaatgctagtatttctggaacaagtagtcagtcgactcaatctgtgctgagagattcttattctgaggagcaaaaaaggcagggtggactgaatacgctaggatgttagaagtcagagagcaggttgaccatgtgatgattccaaaaatcaatcaggatttaccaatctacgctggttcagaagaggacaatctgcaacggggagttggtcatctagaagggataagtttgccgattggaggggcttctacacatgcggtcttgagcggtcaaagaggtatgccagctgctcggttgtttgcggatttggataagatgaaaaaaggtgattatttttatgttaccaatctgaaagaaaccttggcttatcaagtggatcgtatcatggtgattgaacctagccaattggatgccgtgagcattgaagaggataaagattatgttacccttctgacctgtacaccttatatgggctctttgtcaactgtaatgggtgacttatcattaacaacgagagagaatcagcttggttctctctctttttggatgttcaaagcgatgagaattttgcttttaaaatttttaaagttgcgaaagccaaaggcttgtcgcttgatgtctttgataagcttgttggtcgcttctaatttggcattggaaagggatagctgagggcgtttgtgatgtaagttttgtacttcatgaaggtcctaaagaccattttaaaagcagaattgccagttgttacgttatcatctatgaagctaaagaattcagttgttcgcttttcttagaaatgaaagagtatgagctgataaaggtcgttataatagcggagctcatctgagaaaacttttatacctcaaagtcagtctagctttgatatcatgaagccattaggagttattccttatcttttagtggcgcgcgatccatatagtgatagatcgagatatttagatccaaaagttctatcatcctcttttggcgccttttttccagcagataatattaaggtagcttggtctaacaactccagcactttatttacaccacctattaatgcaaactacaccactcagattcaagctattgggacaacgattaagtcacaaattccggaatcgattttgacggttacggataaaaagagcaggaagttcagcattaacaagattgacgaagctaaagaaggcttagtaggtgcgaccttcaccttgtctaaacgcacaacagtagcggcagatcatcaagtacaaggagatttcattcctgtcagcaaagagacgacagtcggtcggacaacccttacctttgacaaccttaaacctggattttatgaccttaaagaaacgaaagcgccgaatgcttacgtacttgatcctaagacttatgttgtggtcgttcaaaattcaggaaaaacgacaattgtggatgaagctaacttcaaagaggctgattacccaatggctgataataccagccatgtggagtgcgtagcgttgctacaacgaagcaaagggtaaaaatcctttattttaagcactttttcaagcattttgtctttattgaaaagagtgattttaacataaaaaaggtattaaaaaacatattgacgtgaccgtttgttttgaagtggcttgcgtagacaaaaaaatagatacgtcagataaatttctggcattacgagaacatttttagagtgttctctttttttagtttacggaggaaaaatatatatggaaaaacaggattcacgagttctcatccattgggaggggaattctggggacaagctcattgaacaccaaaccagcgcaacggggtggtactaccaagtcgatcgtagctttagtcaaccaaaaggggaaccgcccagaatgatccaaaggcactagaaagtgtccgtaatgattcgatttcgggcggtgatgatgtcatgggttatgcttatagcaaatgtacttggggagttgcggcacgaattaatcagtgggactgaaactcaaaggttgaaatggtgagaagattaccattaccagttcaatgggaaatggtcaggattgggttggaacagccgaaagactagatggtgaaactgatacagttccaaaagaaggtactattctctctttttaggaaagtagttatggttcgtatataggctacggaactatatctttcgtcacattacatctacagatagtaccatgaattttgcttatatgaccaagtaaagtgaggatatactaacaaatgaaatatttattatcgtatttgtccattttatcgaaaagtttgcatattatcattatgtttgataagatgcaaatataatgatagtaggagctaaatatggatatttaaaaaatcaagagtatcctaagtgctttccattttgaaattcaaatatagctaatagttctagaacttctaattgtttttcgtcgacgatatgaattttcaatcttaactgttaggattccacctccctttggttaaagaaaaaaggtcaggtcgtttagataactttgtcaaacaagctcaagctatctaaaaatagtttgaaatgggcattactctagtttttaataagctatctgatgagcagaaggagaagttaatgcatgttgggaagtcttattttgactatcaagaaaatgctcttatcccacaattaggttttctatattctaaattaactaaaaaaattgaacttgataatcggttgtctccgactgaaaaaaagttattgattaccttattattacatactaaaggtttaatcattgatatgtaagaagtaagtcagctaaccgatctttctattctaaaacttatattgttgctttagaaattttaaagagcgtggatggcttcataataaacagaaatcttaccaatttgcgaagccaaaaaatatgatatttgaagagtccaaagatctaatagatagtccagttagagaagcgttgattataagtgataaggattttcaaaaattaaaacaagagctattattttaaccgacttattttaaagacttatcatatctaggcttgcttgatgattcggaaaaatacggagactatactatttcaaggaaaagatacaaaagtttcgaatcaagtcttcaactatacatccttcaaagtcatcggctagagatttggaattatgaaccaatccctttgattactagaaaaataaatagcttggagaggctaacgtgacactggttgatccaatctcgctttatttaacactaagaatgatgaagaccctcgtattgaagaagaagttgagcagctagaagataagat

SEQ ID NO: 298 - DNA, 13002 bp, S. agalactiae
catcaagtgactcatgaacacgtgtcaatcttattgacctgcgttcaagaattgattgtggaagtcaatcaaacacagccactcagtcgtgagtttcgtgaaaagtatatgggttaggaggctgcaattgtttatcgttatcgtaccaatctcaaaaaagtctttctaacagattcagaattgaatcaattaaatgagcggattgctaagagcaattgtcaaaatttcgaccattccccataaaagggccaaccaaaacttcacctgtgaccgttttttgatgtcaacaccagtattttggatgtaccccttaacatgccctttggtatctgcaacagagataatatgaccaaaggaagaatcaccgatgactttaaccgtaatcttgctatcgcctttttgattagccgctaatatttgattagcaatcagggtgcgaccaagagcaactgttgaagacgacaaggtatgatgtttttcctgagccaatttaacagtctcggtgctatcgaggacataagacctgaaggcaccagaggcagaaattgatttaataattttatccataacctatgttatagcacaaagagagagtttgtatggactggattagctgaaaattttagactaaaaagtagtgccagtggattttgaaaggtaacaaaagagtcttccgtttaaacgagaaggctctttttagtcgtttcagatgaaggcaaaaggacgatgaaataattccgtaccttcatggattgctatgttactggcatgaggtctcacgatatttagtaagatattcgtttgaagatattcccacgtattttttaaaggttttaagaaaatgtgtggtgtcgtaaaaatgtaataatttcgctacttccccaatcggtacccctctttgcagtagtaattgtccctccttaatttttgcctttagaatataactttgcaaggaaatgtcagagtattttttaaaaactgagcgtaagtgggaatctgagatatataggtagttggcaatatcagatactttgagtttggagtagaggtggttgtccacataatggagaatactattgtacatttgctgcttgtcagagatgctcttattggttaaggattctgaaaaatcaataagagctgcacagcgaattcttgaaacatcaataagatcaggagcctcttcgtttaaagccatatagtgctttaccagcgcataacttttagccacatcagtattttcctcgaaacttaattctagtaattttgttaagtaaacaacagttaagttcttttcagctcttagggcagggattgaagatgaggtaacactggatgatgggaggcgattaatttcttgctttaacagttgagtgttacccagcttaacgagatcaataatgtgattgagatggtttaaaacagtgggtaactgaaaagagtttttcttagtatgttttaggtgaagaacaatatcaggatccgcaacaatctgttctgactcttctaataaatgattgatgacttgttggcaactagcctcaaactgtgtttggaaaaaggcatcgatagacacaagaagactacgtatactggtagtaggaaaacaagggacaagctttatataggataagatttcttttttactacgatgagaaaattgttctagaaagcgactggataactgttcttgcctattgatatcagggctatagggataaaatggtccaatagcaataagatattgacagacaggaaaaattaagaatgattcttcaaaaagaccctcataaacagtgatatcttggttataagggatagctaaatgttttaaaaactgatagtaaggcaacagatagtcttcgttaccatataactgaacgagttccttgtctcgtgacatgactgaaataggtagttgagatatggtatgcaatgtttgaacatgtttaaaatcgaatgtaaccatttgatagaccgccttcattatcatttctagaatttttctttaggtttgtaaagactacaaaataaaatgatgaaaacaactatcttgtggatacactaaaaagacacgctaattagcaaactctctcttcatcatctctcaccattattatactactatttatatgacaaataaaggtgattttgttaaaatataactttgaaaatccacatatatttttaatcttccgtctgaaaaaataaataaaaatagtaaaaataaacacgaatttaaaataagcaaattttttaagaaaatctgtgctaaactttaatagttttgtgcttaataataatcagcacttacaaagaacaaagggaaaagcgaggagagaacttttaatgaaattatcgaagaagttattgttttcggctgctgttttaacaatggtggcggggtcaactgttgaaccagtagctcagtttgcgactggaatgagtattgtaagagctgcagaagtgtcacaagaacgcccagcgaaaacaacagtaaatatctataaattacaagctgatagttataaatcggaaattacttctaatggtggtatcgagaataaagacggcgaagtaatatctaactatgctaaacttggtgacaatgtaaaaggtttgcaaggtgtacagtttaaacgttataaagtcaagacggatatttctgttgatgaattgaaaaaattgacaacagttgaagcagcagatgcaaaagttggaacgattcttgaagaaggtgtcagtctacctcaaaaaactaatgctcaaggtttggtcgtcgatgctctggattcaaaaagtaatgtgagatacttgtatgtagaagatttaaagaattcaccttcaaacattaccaaagcttatgctgtaccgtttgtgttggaattaccagttgctaactctacaggtacaggtttcctttctgaaattaatatttaccctaaaaacgttgtaactgatgaaccaaaaacagataaagatgttaaataattaggtcaggacgatgcaggttatacgattggtgaagaattcaaatggttcttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactaggtggtgctgagtttgatttgttggcttctgatgggacagcagtaaaatggacagatgctcttattaaagcgaatactaataaaaactatattgctggagaagctgttactgggcaaccaatcaaattgaaatcacatacagacggtacgtttgagattaaaggtttggcttatgcagttgatgcgaatgcagagggtacagcagtaacttacaaattaaaagaaacaaaagcaccagaaggttatgtaatccctgataaagaaatcgagtttacagtatcacaaacatcttataatacaaaaccaactgacatcacggttgatagtgctgatgcaacacctgatacaattaaaaacaacaaacgtccttcaatccctaatactggtggtattggtacggctatctttgtcgctatcggtgctgcggtgatggcttttgctgttaaggggatgaagcgtcgtacaaaagataactaaataaaaggctacttcttaagtaaccatgtttaagaaaagagaaatagccttatttctctttttgtcgtttttaaaataaaggaacatcatgaaacaaacattaaaacttatgttttcttttctgttgatgttagggactatgtttggaattagccaaactgttttagcgcaagaaactcatcagttgacgattgttcatcttgaagcaagggatattgatcgtccaaatccacagttggagattgcccctaaagaagggactccaattgaaggagtactctatcagttgtaccaattaaaatcaactgaagatggcgatttgttggcacattggaattccctaactatcacagaattgaaaaaacaggcgcagcaggtttttgaagccactactaatcaacaaggaaaggctacatttaaccaactaccagatggaatttattatggtctggcggttaaagccggtgaaaaaaatcgtaatgtctcagctttcttggttgacttgtctgaggataaagtgatttatcctaaaatcatctggtccacaggtgagttggacttgcttaaagttggtgtggatggtgataccaaaaaaccactagcaggcgttgtctttgaactttatgaaaagaatggtaggactcctattcgtgtgaaaaatggggtgcattctcaagatattgacgctgcaaaacatttagaaacagattcatcagggcatatcagaatttccgggctcatccatggggactatgtcttaaaagaaatcgagacacagtcaggatatcagatcggacaggcagagactgctgtgactattgaaaaatcaaaaacagtaacagtaacgattgaaaataaaaaagttccgacacctaaagtgccatctcgaggaggtcttattcccaaaacaggtgagcaacaggcaatggcacttgtaattattggtggtattttaattgctttagccttacgattactatcaaaacatcggaaacatcaaaataaggattagcatgggacaaaaatcaaaaatatctctagctacgaatattcgtatatggatttttcgtttaattttcttagcgggtttccttgttttggcatttcccatcgttagtcaggtcatgtactttcaagcctctcacgccaatattaatgcttttaaagaagctgttaccaagattgaccgggtggagattaatcggcgtttagaacttgcttatgcttataacgccagtatagcaggtgccaaaactaatggcgaatatccagcgcttaaagacccctactctgctgaacaaaagcaggcaggggtcgttgagtacgcccgcatgcttgaagtcaaagaacaaataggtcatgtgattattccaagaattaatcaggatatccctatttacgctggctctgctgaagaaaatcttcagaggggcgttggacatttagaggggaccagtcttccagtcggtggtgagtcaactcatgccgttctaactgcccatcgagggctaccaacggccaagctatttaccaatttagacaaggtaacagtaggtgaccgtttttacattgaacacatcggcggaaagattgcttatcaggtagaccaaatcaaagttatcgcccctgatcagttagaggatttgtacgtgattcaaggagaagatcacgtcaccctattaacttgcacaccttatatgataaatagtcatcgcctcctcgttcgaggcaagcgaattccttatgtggaaaaaacagtgcagaaagattcaaagaccttcaggcaacaacaatacctaacctatgctatgtgggtagtcgttggacttatcttgctgtcgcttctcatttggtttaaaaagacgaaacagaaaaagcggagaaagaatgaaaaagcggctagtcaaaatagtcacaataattcgaaataataaaatcagaaccctcatttttgtgatgggaagtctgattctcttatttccgattgtgagccaggtaagttactaccttgcttcgcatcaaaatattaatcaatttaagcgggaagtcgctaagattgatactaatacggttgaacgacgcatcgctttagctaatgcttacaatgagacgttatcaaggaatcccttgcttatagacccttttaccagtaagcaaaaagaaggtttgagagagtatgctcgtatgcttgaagttcatgagcaaataggtcatgtggcaatcccaagtattggggttgatattccaatttatgctggaacatccgaaactgtgcttcagaaaggtagtgggcatttggagggaaccagtcttccagtgggaggtttgtcaacccattcagtactaactgcccaccgtggcttgccaacagctaggctatttaccgacttaaataaagttaaaaaaggccagattttctatgtgacgaacatcaaggaaacacttgcctacaaagtcgtgtctatcaaagttgtggatccaacagctttaagtgaggttaagattgtcaatggtaaggattatataaccttgctgacttgcacaccttacatgatcaatagtcatcgtctcttggtaaaaggagagcgtattccttatgattctaccgaggcggaaaagcacaaagaacaaaccgtacaagattatcgtttgtcactagtgttgaagatactactagtattattaattggactcttcatcgtgataatgatgagaagatggatgcaacatcgtcaataacgatgttgtgaatggcttacttacttatcaaataggtgactaatgatgattgtgaataatggttatctagaagggagaaaaatgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaattacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattgtaaggtgtcgttgaaattattaaataatagaaaatgactagttttggcctttccctattgtcagtcagattagttattatcaagcttctcatgccaatattaatgcctttaaaagaacagttacaaccattgaccgtacggagattcaacgacggttaggtctggctaaagcctacaatgctagtatttctggaacaagtagtcagtcgactcaatctgtgctgagagattcttattctgaggagcaaaaaaggcagggtggactgaatacgctaggatgttagaagtcagagagcaggttgaccatgtgatgattccaaaaatcaatcaggatttaccaatctacgctggttcagaagaggacaatctgcaacggggagttggtcatctagaagggataagtttgccgattggaggggcttctacacatgcggtcttgagcggtcaaagaggtatgccagctgctcggttgtttgcggatttggataagatgaaaaaaggtgattatttttatgttaccaatctgaaagaaaccttggcttatcaagtggatcgtatcatggtgattgaacctagccaattggatgccgtgagcattgaagaggataaagattatgttacccttctgacctgtacaccttatatgggctctttgtcaactgtaatgggtgacttatcattaacaacgagagagaatcagcttggttctctctctttttggatgttcaaagcgatgagaattttgcttttaaaatttttaaagttgcgaaagccaaaggcttgtcgcttgatgtctttgataagcttgttggtcgcttctaatttggcattggaaagggatagctgagggcgtttgtgatgtaagttttgtacttcatgaaggtcctaaagaccattttaaaagcagaattgccagttgttacgttatcatctatgaagctaaagaattcagttgttcgcttttcttagaaatgaaagagtatgagctgataaaggtcgttataatagcggagctcatctgagaaaacttttatacctcaaagtcagtctagctttgatatcatgaagccattaggagttattccttatcttttagtggcgcgcgatccatatagtgatagatcgagatatttagatccaaaagttctatcatcctcttttggcgccttttttccagcagataatattaaggtagcttggtctaacaactccagcactttatttacaccacctattaatgcaaactacaccactcagattcaagctattgggacaacgattaagtcacaaattccggaatcgattttgacggttacggataaaaagagcaggaagttcagcattaacaagattgacgaagctaaagaaggcttagtaggtgcgaccttcaccttgtctaaacgcacaacagtagcggcagatcatcaagtacaaggagatttcattcctgtcagcaaagagacgacagtcggtcggacaacccttacctttgacaaccttaaacctggattttatgaccttaaagaaacgaaagcgccgaatgcttacgtacttgatcctaagacttatgttgtggtcgttcaaaattcaggaaaaacgacaattgtggatgaagctaacttcaaagaggctgattacccaatggctgataataccagccatgtggagtgcgtagcgttgctacaacgaagcaaagggtaaaaatcctttattttaagcactttttcaagcattttgtctttattgaaaagagtgattttaacataaaaaaggtattaaaaaacatattgacgtgaccgtttgttttgaagtggcttgcgtagacaaaaaaatagatacgtcagataaatttctggcattacgagaacatttttagagtgttctctttttttagtttacggaggaaaaatatatatggaaaaacaggattcacgagttctcatccattgggaggggaattctggggacaagctcattgaacaccaaaccagcgcaacggggtggtactaccaagtcgatcgtagctttagtcaaccaaaaggggaaccgcccagaatgatccaaaggcactagaaagtgtccgtaatgattcgatttcgggcggtgatgatgtcatgggttatgcttatagcaaatgtacttggggagttgcggcacgaattaatcagtgggactgaaactcaaaggttgaaatggtgagaagattaccattaccagttcaatgggaaatggtcaggattgggttggaacagccgaaagactagatggtgaaactgatacagttccaaaagaaggtactattctctctttttaggaaagtagttatggttcgtatataggctacggaactatatctttcgtcacattacatctacagatagtaccatgaattttgcttatatgaccaagtaaagtgaggatatactaacaaatgaaatatttattatcgtatttgtccattttatcgaaaagtttgcatattatcattatgtttgataagatgcaaatataatgatagtaggagctaaatatggatatttaaaaaatcaagagtatcctaagtgctttccattttgaaattcaaatatagctaatagttctagaacttctaattgtttttcgtcgacgatatgaattttcaatcttaactgttaggattccacctccctttggttaaagaaaaaaggtcaggtcgtttagataactttgtcaaacaagctcaagctatctaaaaatagtttgaaatgggcattactctagtttttaataagctatctgatgagcagaaggagaagttaatgcatgttgggaagtcttattttgactatcaagaaaatgctcttatcccacaattaggttttctatattctaaattaactaaaaaaattgaacttgataatcggttgtctccgactgaacaaaagttattgattaccttattattacatactaaaggtttaatcattgatatgtaagaagtaagtcagctaaccgatctttctattctaaaacttatattgttgctttagaaattttaaagagcgtggatggcttcataataaacagaaatcttaccaatttgcgaagccaaaaaatatgatatttgaagagtccaaagatctaatagatagtccagttagagaagcgttgattataagtgataaggattttcaaaaattaaaacaagagctattattttaaccgacttattttaaagacttatcatatctaggcttgcttgatgattcggaaaaatacggagactatactatttcaaggaaaagatacaaaagtttcgaatcaagtcttcaactatacatccttcaaagtcatcggctagagatttggaattatgaaccaatccctttgattactagaaaaataaatagcttggagaggctaacgtgacactggttgatccaatctcgctttatttaacactaagaatgatgaagaccctcgtattgaagaagaagttgagcagctagaagataagat

SEQ ID NO: 299 - DNA, 13006 bp, S. agalactiae
taacacggattggaaataacatcaatcaaattgcgcgtgctatcaaccaaagccatctaatttctcaggctcagtatcactttcatcgagaagcacgttaagcccaacagcagggggggttgctctgattcggttaagtaataagcaaaatcctcaccaattttcccagtaataagaggcgttgttgaggtatagggattacctgtgccatagtcgatgatggtcacaaaatgaccattccccataaaagggccaaccaaaacttcacctgtggccgttttttgatgtcaacaccagtattttggatgtaccccttaacatgccctttggtatctgcaacagagataatatgaccaaaggaagaatcaccgatgactttaaccgtaatcttgctatcgcctttttgattagccgctaatatttgattagcaatcagggtgcgaccaagagcaactgttgaagacgacaaggtatgatgtttttcctgagccaatttaacagtctcggtgctatcgaggacataagacctgaaggcaccagaggcagaaattgatttaataattttatccataacctatgttatagcacaaagagagagtttgtatggactggattagctgaaaattttagactaaaaagtagtgccagtggattttgaaaggtaacaaaagagtcttccgtttaaacgagaaggctgtttttagtcgtttcagatgaaggcaaaaggacgatgaaataattccgtaccttcatggattgctatgttactggcatgaggtctcacgatatttagtaagatattcgtttgaagatattcccacgtattttttaaaggttttaagaaaatgtgtggtgtcgtaaaaatgtaataatttcgctacttccccaatcggtacccctctttgcagtagtaattgtccctccttaatttttgcctttagaatataactttgcaaggaaatgtcagagtattttttaaaaactgagcgtaagtgggaatctgagatatataggtagttggcaatatcagatactttgagtttggagtagaggtggttgtccacataatggagaatactattgtacatttgctgcttgtcagagatgctcttattggttaaggattctgaaaaatcaataagagctgcacagcgaattcttgaaacatcaataagatcaggagcctcttcgtttaaagccatatagtgctttaccagcgcataacttttagccacatcagtattttcctcgaaacttaattctagtaattttgttaagtaaacaacagttaagttcttttcagctcttagggcagggattgaagatgaggtaacactggatgatgggaggcgattaatttcttgctttaacagttgagtgttacccagcttaacgagatcaataatgtgattgagatggtttaaaacagtgggtaactgaaaagagtttttcttagtatgttttaggtgaagaacaatatcaggatccgcaacaatctgttctgactcttctaataaatgattgatgacttgttggcaactagcctcaaactgtgtttggaaaaaggcatcgatagacacaagaagactacgtatactggtagtaggaaaacaagggacaagctttatataggataagatttcttttttactacgatgagaaaattgttctagaaagcgactggataactgttcttgcctattgatatcagggctatagggataaaatggtccaatagcaataagatattgacagacaggaaaaattaagaatgattcttcaaaaagaccctcataaacagtgatatcttggttataagggatagctaaatgttttaaaaactgatagtaaggcaacagatagtcttcgttactatataactgaacgagttccttgtctcgtgacatgactgaaataggtagttgagatatggtatgcaatgtttgaacatgtttaaaatcgaatgtaaccatttgatagaccgccttcattatcatttctagaatttttctttaggtttgtaaagactacaaaataaaatgatgaaaacaactatcttgtggatacactaaaaagacacgctaattagcaaactctctcttcatcatctctcaccattattatactactatttatatgacaaataaaggttattttgttaaaatataactttgaaaatccacatatatttttaatcttccgtctgaaaaaataaataaaaatagtaaaaataaacacgaatttaaaataagcaaattttttaagaaaatctgtgctaaactttaatagttttgtgcttaataataatcagcacttacaaagaacaaagggaaaagcgaggagagaacttttaatgaaattatcgaagaagttattgttttcggctgctgttttaacaatggtggcggggtcaactgttgaaccagtagctcagtttgcgactggaatgagtattgtaagagctgcagaagtgtcacaagaacgcccagcgaaaacaacagtaaatatctataaattacaagctgatagttataaatcggaaattacttctaatggtggtatcgagaataaagacggcgaagtaatatctaactatgctaaacttggtgacaatgtaaaaggtttgcaaggtgtacagtttaaacgttataaagtcaagacggatatttctgttgatgaattgaaaaaattgacaacagttgaagcagcagatgcaaaagttggaacgattcttgaagaaggtgtcagtctacctcaaaaaactaatgctcaaggtttggtcgtcgatgctctggattcaaaaagtaatgtgagatacttgtatgtagaagatttaaagaattcaccttcaaacattaccaaagcttatgctgtaccgtttgtgttggaattaccagttgctaactctacaggtacaggtttcctttctgaaattaatatttaccctaaaaacgttgtaactgatgaaccaaaaacagataaagatgttaaaaaattaggtcaggacgatgcaggttatacgattggtgaagaattcaaatggttcttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactaggtggtgctgagtttgatttgttggcttctgatgggacagcagtaaaatggacagatgctcttattaaagcgaatactaataaaaactatattgctggagaagctgttactgggcaaccaatcaaattgaaatcacatacagacggtacgtttgagattaaaggtttggcttatgcagttgatgcgaatgcagagggtacagcagtaacttacaaattaaaagaaacaaaagcaccagaaggttatgtaatccctgataaagaaatcgagtttacagtatcacaaacatcttataatacaaaaccaactgacatcacggttgatagtgctgatgcaacacctgatacaattaaaaacaacaaacgtccttcaatccctaatactggtggtattggtacggctatctttgtcgctatcggtgctgcggtgatggcttttgctgttaaggggatgaagcgtcgtacaaaagataactaaataaaaggctacttcttaagtaaccatgtttaagaaaagagaaatagccttatttctctttttgtcgtttttaaaataaaggaacatcatgaaacaaacattaaaacttatgttttcttttctgttgatgttagggactatgtttggaattagccaaactgttttagcgcaagaaactcatcagttgacgattgttcatcttgaagcaagggatattgatcgtccaaatccacagttggagattgcccctaaagaagggactccaattgaaggagtactctatcagttgtaccaattaaaatcaactgaagatggcgatttgttggcacattggaattccctaactatcacagaattgaaaaaacaggcgcagcaggtttttgaagccactactaatcaacaaggaaaggctacatttaaccaactaccagatggaatttattatggtctggcggttaaagccggtgaaaaaaatcgtaatgtctcagctttcttggttgacttgtctgaggataaagtgatttatcctaaaatcatctggtccacaggtgagttggacttgcttaaagttggtgtggatggtgataccaaaaaaccactagcaggcgttgtctttgaactttatgaaaagaatggtaggactcctattcgtgtgaaaaatggggtgcattctcaagatattgacgctgcaaaacatttagaaacagattcatcagggcatatcagaatttccgggctcatccatggggactatgtcttaaaagaaatcgagacacagtcaggatatcagatcggacaggcagagactgctgtgactattgaaaaatcaaaaacagtaacagtaacgattgaaaataaaaaagttccgacacctaaagtgccatctcgaggaggtcttattcccaaaacaggtgagcaacaggcaatggcacttgtaattattggtggtattttaattgctttagccttacgattactatcaaaacatcggaaacatcaaaataaggattagcatgggacaaaaatcaaaaatatctctagctacgaatattcgtatatggatttttcgtttaattttcttagcgggtttccttgttttggcatttcccatcgttagtcaggtcatgtactttcaagcctctcacgccaatattaatgcttttaaagaagctgttaccaagattgaccgggtggagattaatcggcgtttagaacttgcttatgcttataacgccagtatagcaggtgccaaaactaatggcgaatatccagcgcttaaagacccctactctgctgaacaaaagcaggcaggggtcgttgagtacgcccgcatgcttgaagtcaaagaacaaataggtcatgtgattattccaagaattaatcaggatatccctatttacgctggctctgctgaagaaaatcttcagaggggcgttggacatttagaggggaccagtcttccagtcggtggtgagtcaactcatgccgttctaactgcccatcgagggctaccaacggccaagctatttaccaatttagacaaggtaacagtaggtgaccgtttttacattgaacacatcggcggaaagattgcttatcaggtagaccaaatcaaagttatcgcccctgatcagttagaggatttgtacgtgattcaaggagaagatcacgtcaccctattaacttgcacaccttatatgataaatagtcatcgcctcctcgttcgaggcaagcgaattccttatgtggaaaaaacagtgcagaaagattcaaagaccttcaggcaacaacaatacctaacctatgctatgtgggtagtcgttggacttatcttgctgtcgcttctcatttggtttaaaaagacgaaacagaaaaagcggagaaagaatgaaaaagcggctagtcaaaatagtcacaataattcgaaataataaaatcagaaccctcatttttgtgatgggaagtctgattctcttatttccgattgtgagccaggtaagttactaccttgcttcgcatcaaaatattaatcaatttaagcgggaagtcgctaagattgatactaatacggttgaacgacgcatcgctttagctaatgcttacaatgagacgttatcaaggaatcccttgcttatagacccttttaccagtaagcaaaaagaaggtttgagagagtatgctcgtatgcttgaagttcatgagcaaataggtcatgtggcaatcccaagtattggggttgatattccaatttatgctggaacatccgaaactgtgcttcagaaaggtagtgggcatttggagggaaccagtcttccagtgggaggtttgtcaacccattcagtactaactgcccaccgtggcttgccaacagctaggctatttaccgacttaaataaagttaaaaaaggccagattttctatgtgacgaacatcaaggaaacacttgcctacaaagtcgtgtctatcaaagttgtggatccaacagctttaagtgaggttaagattgtcaatggtaaggattatataaccttgctgacttgcacaccttacatgatcaatagtcatcgtctcttggtaaaaggagagcgtattccttatgattctaccgaggcggaaaagcacaaagaacaaaccgtacaagattatcgtttgtcactagtgttgaagatactactagtattattaattggactcttcatcgtgataatgatgagaagatggatgcaacatcgtcaataacgatgttgtgaatggcttacttacttatcaaataggtgactaatgatgattgtgaataatggttatctagaagggagaaaaatgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaaatacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattgtaaggtgtcgttgaaattattaaataatagaaaatgactagttttggcctttccctattgtcagtcagattagttattatcaagcttctcatgccaatattaatgcctttaaaagaacagttacaaccattgaccgtacggagattcaacgacggttaggtctggctaaagcctacaatgctagtatttctggaacaagtagtcagtcgactcaatctgtgctgagagattcttattctgaggagcaaaaaaggcagggtggactgaatacgctaggatgttagaagtcagagagcaggttgaccatgtgatgattccaaaaatcaatcaggatttaccaatctacgctggttcagaagaggacaatctgcaacggggagttggtcatctagaagggataagtttgccgattggaggggcttctacacatgcggtcttgagcggtcaaagaggtatgccagctgctcggttgtttgcggatttggataagatgaaaaaaggtgattatttttatgttaccaatctgaaagaaaccttggcttatcaagtggatcgtatcatggtgattgaacctagccaattggatgccgtgagcattgaagaggataaagattatgttacccttctgacctgtacaccttatatgggctctttgtcaactgtaatgggtgacttatcattaacaacgagagagaatcagcttggttctctctctttttggatgttcaaagcgatgagaattttgcttttaaaatttttaaagttgcgaaagccaaaggcttgtcgcttgatgtctttgataagcttgttggtcgcttctaatttggcattggaaagggatagctgagggcgtttgtgatgtaagttttgtacttcatgaaggtcctaaagaccattttaaaagcagaattgccagttgttacgttatcatctatgaagctaaagaattcagttgttcgcttttcttagaaatgaaagagtatgagctgataaaggtcgttataatagcggagctcatctgagaaaacttttatacctcaaagtcagtctagctttgatatcatgaagccattaggagttattccttatcttttagtggcgcgcgatccatatagtgatagatcgagatatttagatccaaaagttctatcatcctcttttggcgccttttttccagcagataatattaaggtagcttggtctaacaactccagcactttatttacaccacctattaatgcaaactacaccactcagattcaagctattgggacaacgattaagtcacaaattccggaatcgattttgacggttacggataaaaagagcaggaagttcagcattaacaagattgacgaagctaaagaaggcttagtaggtgcgaccttcaccttgtctaaacgcacaacagtagcggcagatcatcaagtacaaggagatttcattcctgtcagcaaagagacgacagtcggtcggacaacccttacctttgacaaccttaaacctggattttatgaccttaaagaaacgaaagcgccgaatgcttacgtacttgatcctaagacttatgttgtggtcgttcaaaattcaggaaaaacgacaattgtggatgaagctaacttcaaagaggctgattacccaatggctgataataccagccatgtggagtgcgtagcgttgctacaacgaagcaaagggtaaaaatcctttattttaagcactttttcaagcattttgtctttattgaaaagagtgattttaacataaaaaaggtattaaaaaacatattgacgtgaccgtttgttttgaagtggcttgcgtagacaaaaaaatagatacgtcagataaatttctggcattacgagaacatttttagagtgttctctttttttagtttacggaggaaaaatatatatggaaaaacaggattcacgagttctcatccattgggaggggaattctggggacaagctcattgaacaccaaaccagcgcaatggggtggtactaccaagtcgatcgtagctttagtcaaccaaaaggggaaccgcccagaatgatccaaaggcactagaaagtgtccgtaatgattcgatttcgggcggtgatgatgtcatgggttatgcttatagcaaatgtacttggggagttgcggcacgaattaatcagtgggactgaaactcaaaggttgaaatggtgagaagattaccattaccagttcaatgggaaatggtcaggattgggttggaacagccgaaagactagatggtgaaactgatacagttccaaaagaaggtactattctctctttttaggaaagtagttatggttcgtatataggctacggaactatatctttcgtcacattacatctacagatagtaccatgaattttgcttatatgaccaagtaaagtgaggatatactaacaaatgaaatatttattatcgtatttgtccattttatcgaaaagtttgcatattatcattatgtttgataagatgcaaatataatgatagtaggagctaaatatggatatttaaaaaatcaagagtatcctaagtgctttccattttgaaattcaaatatagctaatagttctagaacttctaattgtttttcgtcgacgatatgaattttcaatcttaactgttaggattccacctccctttggttaaagaaaaaaggtcaggtcgtttagataactttgtcaaacaagctcaagctatctaaaaatagtttgaaatgggcattactctagtttttaataagctatctgatgagcagaaggagaagttaatgcatgttgggaagtcttattttgactatcaagaaaatgctcttatcccacaattaggttttctatattctaaattaactaaaaaaattgaacttgataatcggttgtctccgactgaacaaaagttattgattaccttattattacatactaaaggtttaatcattgatatgtaagaagtaagtcagctaaccgatctttctattctaaaacttatattgttgctttagaaattttaaagagcgtggatggcttcataataaacagaaatcttaccaatttgcgaagccaaaaaatatgatatttgaagagtccaaagatctaatagatagtccagttagagaagcgttgattataagtgataaggattttcaaaaattaaaacaagagctattattttaaccgacttattttaaagacttatcatatctaggcttgcttgatgattcggaaaaatacggagactatactatttcaaggaaaagatacaaaagtttcgaatcaagtcttcaactatacatccttcaaagtcatcggctagagatttggaattatgaaccaatccctttgattactagaaaaataaatagcttggagaggctaacgtgacactggttgatccaatctcgctttatttaacactaagaatgatgaagaccctcgtattgaagaagaagttgagcagctagaagataagat

SEQ ID NO: 300 - DNA, 13000 bp, S. agalactiae
taacacggattggaaataacatcaatcaaatttcgcgtgctatcaaccaaagccatctaatttctcaggctcagtatcactttcatcgagaagcacgttaagcccaacagcagggggggtgctctgattcggttaagtaataagcaaaatcctcaccaattttcccagtaataagaggcgttgttgaggtatagggattacctgtgccatagtcgatgatggtcacaaaatgaccattccccataaaagggccaaccaaaacttcacctgtggccgttttttgatgtcaacaccagtattttggatgtaccccttaacatgccctttggtatctgcaacagagataatatgaccaaaggaagaatcaccgatgactttaaccgtaatcttgctatcgcctttttgattagccgctaatatttgattagcaatcagggtgcgaccaagagcaactgttgaagacgacaaggtatgatgtttttcctgagccaatttaacagtctcggtgctatcgaggacataagacctgaaggcaccagaggcagaaattgatttaataattttatccataacctatgttatagcacaaagagagagtttgtatggactggattagctgaaaattttagactaaaaagtagtgccagtggattttgaaaggtaacaaaagagtcttccgtttaaacgagaaggctgtttttagtcgtttcagatgaaggcaaaaggacgatgaaataattccgtaccttcatggattgctatgttactggcatgaggtctcacgatatttagtaagatattcgtttgaagatattcccacgtattttttaaaggttttaagaaaatgtgtggtgtcgtaaaaatgtaataatttcgctacttccccaatcggtacccctctttgcagtagtaattgtccctccttaatttttgcctttagaatataactttgcaaggaaatgtcagagtattttttaaaaaccgagcgtaagtgggaatttgagatatataggtagttggcaatatcagatactttgagtttggagtagaggtggttgtccacataatggagaatactattgtacatttgctgcttgtcagagatgctcttattggttaaggattctgaaaaatcaataagagctgcacagcgaattcttgaaacatcaataagatcaggagcctcttcgtttaaagccatatagtgctttaccagcgcataacttttagccacatcagtatttttctcgaaacttaattctagtaattttgttaagtaaacaacagttaagttcttttcagctcttagggcagggattgaagatgaggtaacactggatgatgggaggcgattaatttcttgctttaacagttgagtgttacccagcttaacgagatcaataatgtgattgagatggtttaaaacagtgggtaactgaaaagagtttttcttagtatgttttaggtgaagaacaatatcaggatccgcaacaatctgttctgactcttctaataaatgattgatggcttgttggcaactagcctcaaactgtgtttggaaaaaggcatcgatagacacaagaagactacgtatactggtagtaggaaaacaagggacaagctttatataggataagatttcttttttactacgatgagaaaattgttctagaaagcgactggataactgttcttgcctattgatatcagggctatagggataaaatggtccaatagcaataagatattgacagacaggaaaaattaagaatgattcttcaaaaagaccctcataaacagtgatatcttggttataagggatagctaaatgttttaaaaactgatagtaaggcaacagatagtcttcgttaccatataactgaacgagttccttgtctcgtgacatgactgaaataggtagttgagatatggtatgcaatgtttgaacatgtttaaaatcgaatgtaaccatttgatagaccgccttcattatcatttctagaatttttctttaggtttgtaaagactacaaaataaaatgatgaaaacaactatcttgtggatacactaaaaagacacgctaattagcaaactctctcttcatcatctctcaccattattatactactatttatatgacaaataaaggtgattttgttaaaaatataactttgaaaatccacatatatttttaatcttccgtctgaaaaaataaataaaaatagtaaaaataaacacgaatttaaaataagcaaattttttaagaaaatctgtgctaaactttaatagttttgtgcttaataataatcagcacttacaaagaacaaagggaaaagcgaggagagaacttttaatgaaattatcgaagaagttattgttttcggctgctgttttaacaatagtggcggggtcaactgttgaaccagtagctcagtttgcgactggaatgagtattgtaagagctgcagaagtgtcacaagaacgcccagcgaaaacaacagtaaatatctataaattacaagctgatagttataaatcggaaattacttctaatggtggtatcgagaataaagacggcgaagtaatatctaactatgctaaacttggtgacaatgtaaaaggtttgcaaggtgtacagtttaaacgttataaagtcaagacggatatttctgttgatgaattgaaaaaattgacaacagttgaagcagcagatgcaaaagttggaacgattcttgaagaaggtgtcagtctacctcaaaaaactaatgctcaaggtttggtcgtcgatgctctggattcaaaaagtaatgtgagatacttgtatgtagaagatttaaagaattcaccttcaaacattaccaaagcttatgctgtaccgtttgtgttggaattaccagttgctaactctacaggtacaggtttcctttctgaaattaatatttaccctaaaaacgttgtaactgatgaaccaaaaacagataaagatgttaaaaaattaggtcaggacgatgcaggttatacgattggtgaagaattcaaatggttcttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactaggtggtgctgagtttgatttgttggcttctgatgggacagcagtaaaatggacagatgctcttattaaagcgaatactaataaaaactatattgctggagaagctgttactgggcaaccaatcaaattgaaatcacatacagacggtacgtttgagattaaaggtttggcttatgcagttgatgcgaatgcagagggtacagcagtaacttacaaattaaaagaaacaaaagcaccagaaggttatgtaatccctgataaagaaatcgagtttacagtatcacaaacatcttataatacaaaaccaactgacatcacggttgatagtgctgatgcaacacctgatacaattaaaaacaacaaacgtccttcaatccctaatactggtggtattggtacggctatctttgtcgctatcggtgctgcggtgatggcttttgctgttaaggggatgaagcgtcgtacaaaagataactaaataaaaggctacttcttaagtaaccatgtttaagaaaagagaaatagccttatttctctttttgtcgtttttaaaataaaggaacatcatgaaacaaacattaaaacttatgttttcttttctgttgatgttagggactatgtttggaattagccaaactgttttagcgcaagaaactcatcagttgacgattgttcatcttgaagcaagggatattgatcgtccaaatccacagttggagattgcccctaaagaagggactccaattgaaggagtactctatcagttgtaccaattaaaatcaactgaagatggcgatttgttggcacattggaattccctaactatcacagaattgaaaaaacaggcgcagcaggtttttgaagccactactaatcaacaaggaaaggctacatttaaccaactaccagatggaatttattatggtctggcggttaaagccggtgaaaaaaatcgtaatgtctcagctttcttggttgacttgtctgaggataaagtgatttatcctaaaatcatctggtccacaggtgagttggacttgcttaaagttggtgtggatggtgataccaaaaaaccactagcaggcgttgtctttgaactttatgaaaagaatggtaggactcctattcgtgtgaaaaatggggtgcattctcaagatattgacgctgcaaaacatttagaaacagattcatcagggcatatcagaatttccgggctcatccatggggactatgtcttaaaagaaatcgagacacagtcaggatatcagatcggacaggcagagactgctgtgactattgaaaaatcaaaaacagtaacagtaacgattgaaaataaaaaagttccgacacctaaagtgccatctcgaggaggtcttattcccaaaacaggtgagcaacaggcaatggcacttgtaattattggtggtattttaattgctttagccttacgattactatcaaaacatcggaaacatcaaaataaggattagcatgggacaaaaatcaaaaatatctctagctacgaatattcgtatatggatttttcgtttaattttcttagcgggtttccttgttttggcatttcccatcgttagtcaggtcatgtactttcaagcctctcacgccaatattaatgcttttaaagaagctgttaccaagattgaccgggtggagattaatcggcgtttagaacttgcttatgcttataacgccagtatagcaggtgccaaaactaatggcgaatatccagcgcttaaagacccctactctgctgaacaaaagcaggcaggggtcgttgagtacgcccgcatgcttgaagtcaaagaacaaataggtcatgtgattattccaagaattaatcaggatatccctatttacgctggctctgctgaagaaaatcttcagaggggcgttggacatttagaggggaccagtcttccagtcggtggtgagtcaactcatgccgttctaactgcccatcgagggctaccaacggccaagctatttaccaatttagacaaggtaacagtaggtgaccgtttttacattgaacacatcggcggaaagattgcttatcaggtagaccaaatcaaagttatcgcccctgatcagttagaggatttgtacgtgattcaaggagaagatcacgtcaccctattaacttgcacaccttatatgataaatagtcatcgcctcctcgttcgaggcaagcgaattccttatgtggaaaaaacagtgcagaaagattcaaagaccttcaggcaacaacaatacctaacctatgctatgtgggtagtcgttggacttatcttgctgtcgcttctcatttggtttaaaaagacgaaacagaaaaagcggagaaagaatgaaaaagcggctagtcaaaatagtcacaataattcgaaataataaaatcagaaccctcatttttgtgatgggaagtctgattctcttatttccgattgtgagccaggtaagttactaccttgcttcgcatcaaaatattaatcaatttaagcgggaagtcgctaagattgatactaatacggttgaacgacgcatcgctttagctaatgcttacaatgagacgttatcaaggaatcccttgcttatagacccttttaccagtaagcaaaaagaaggtttgagagagtatgctcgtatgcttgaagttcatgagcaaataggtcatgtggcaatcccaagtattggggttgatattccaatttatgctggaacatccgaaactgtgcttcagaaaggtagtgggcatttggagggaaccagtcttccagtgggaggtttgtcaacccattcagtactaactgcccaccgtggcttgccaacagctaggctatttaccgacttaaataaagttaaaaaaggccagattttctatgtgacgaacatcaaggaaacacttgcctacaaagtcgtgtctatcaaagttgtggatccaacagctttaagtgaggttaagattgtcaatggtaaggattatataaccttgctgacttgcacaccttacatgatcaatagtcatcgtctcttggtaaaaggagagcgtattccttatgattctaccgaggcggaaaagcacaaagaacaaaccgtacaagattatcgtttgtcactagtgttgaagatactactagtattattaattggactcttcatcgtgataatgatgagaagatggatgcaacatcgtcaataacgatgttgtgaatggcttacttacttatcaaataggtgactaatgatgattgtgaataatggttatctagaagggagaaaaatgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaattacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattgtaaggtgtcgttgaaattattaaataatagaaaatgactagttttggcctttccctattgtcagtcagattagttattatcaagcttctcatgccaatattaatgcctttaaaagaacagttacaaccattgaccgtacggagattcaacgacggttaggtctggctaaagcctacaatgctagtatttctggaacaagtagtcagtcgactcaatctgtgctgagagattcttattctgaggagcaaaaaaggcagggtggactgaatacgctaggatgttagaagtcagagagcaggttgaccatgtgatgattccaaaaatcaatcaggatttaccaatctacgctggttcagaagaggacaatctgcaacggggagttggtcatctagaagggataagtttgccgattggaggggcttctacacatgcggtcttgagcggtcaaagaggtatgtcagctgctcggttgtttgcggatttggataagatgaaaaaaggtgattatttttatgttaccaatctgaaagaaaccttggcttatcaagtggatcgtatcatggtgattgaacctagccaattggatgccgtgagcattgaagaggataaagattatgttacccttctgacctgtacaccttatatgggctctttgtcaactgtaatgggtgacttatcattaacaacgagagagaatcagcttggttctctctctttttggatgttcaaagcgatgagaattttgcttttaaaatttttaaagttgcgaaagccaaaggcttgtcgcttgatgtctttgataagcttgttggtcgcttctaatttggcattggaaagggatagctgagggcgtttgtgatgtaagttttgtacttcatgaaggtcctaaagaccattttaaaagcagaattgccagttgttacgttatcatctatgaagctaaagaattcagttgttcgcttttcttagaaatgaaagagtatgagctgataaaggtcgttataatagcggagctcatctgagaaaacttttatacctcaaagtcagtctagctttgatatcatgaagccattaggagttattccttatcttttagtggcgcgcgatccatatagtgatagatcgagatatttagatccaaaagttctatcatcctcttttggcgccttttttccagcagataatattaaggtagcttggtctaacaactccagcactttatttacaccacctattaatgcaaactacaccactcagattcaagctattgggacaacgattaagtcacaaattccggaatcgattttgacggttacggataaaaagagcaggaagttcagcattaacaagattgacgaagctaaagaaggcttagtaggtgcgaccttcaccttgtctaaacgcacaacagtagcggcagatcatcaagtacaaggagatttcattcctgtcagcaaagagacgacagtcggtcggacaactcttacctttgacaaccttaaacctggattttatgaccttaaagaaacgaaagcgccgaatgcttacgtacttgatcctaagacttatgttgtggtcgttcaaaattcaggaaaaacgacaattgtggatgaagctaacttcaaagaggctgattacccaatggctgataataccagccatgtggagtgcgtagcgttgctacaacgaagcaaagggtaaaaatcctttattttaagcactttttcaagcattttgtctttattgaaaagagtgattttaacataaaaaaggtattaaaaaacatattgacgtgaccgtttgttttgaagtggcttgcgtagacaaaaaaatagatacgtcagataaatttctggcattacgagaacatttctagagtgttctctttttttagtttacggaggaaaaatatatatggaaaaacaggattcacgagttctcatccattgggaggggaattctggggacaagctcattgaacaccaaaccagcgcaacggggtggtactaccaagtcgatcgtagctttagtcaaccaaaaggggaaccgcccagaatgatccaaaggcactagaaagtgtccgtaatgattcgatttcgggcggtgatgatgtcatgggttatgcttatagcaaatgtacttggggagttgcggcacgaattaatcagtgggactgaaactcaaaggttgaaatggtgagaagattaccattaccagttcaatgggaaatggtcaggattgggttggaacagccgaaagactagatggtgaaactgatacagttccaaaagaaggtactattctctctttttaggaaagtagttatggttcgtatataggctacggaactatatctttcgtcacattacatctacagatagtaccatgaattttgcttatatgaccaagtaaagtgaggatatactaacaaatgaaatatttattatcgtatttgtccattttatcgaaaagtttgcatattatcattatgtttgataagatgcaaatataatgatagtaggagctaaatatggatatttaaaaaatcaagagtatcctaagtgctttccattttgaaattcaaatatagctaatagttctagaacttctaattgtttttcgtcgacgatatgaattttcaatcttaactgttaggattccacctccctttggttaaagaaaaaaggtcaggtcgtttagataactttgtcaaacaagctcaagctatctaaaaatagtttgaaatgggcattactctagtttttaataagctatctgatgagcagaaggagaagttaatgcatgttgggaagtcttattttgactatcaagaaaatgctcttatcccacaattaggttttctatattctaaattaactaaaaaaattgaacttgataatcggttgtctccgactgaacaaaagttattgattaccttattattacatactaaaggtttaatcattgatatgtaagaagtaagtcagctaaccgatctttctattctaaaacttatattgttgctttagaaattttaaagagcgtggatggcttcataataaacagaaatcttaccaatttgcgaagccaaaaaatatgatatttgaagagtccaaagatctaatagatagtccagttagagaagcgttgattataagtgataaggattttcaaaaattaaaacaagagctattattttaaccgacttattttaaagacttatcatatctaggcttgcttgatgattcggaaaaatacggagactatactatttcaaggaaaagatacaaaagtttcgaatcaagtcttcaactatacatccttcaaagtcatcggctagagatttggaattatgaaccaatccctttgattactagaaaaataaatagcttggagaggctaacgtgacactggttgatccaatctcgctttatttaacactaagaatgatgaagaccctcgtattgaagaagaagttgagcagctagaaga

SEQ ID NO: 301 - DNA, 13000 bp, S. agalactiae
taacacggattggaaataacatcaatcaaattgcgcgtgctatcaaccaaagccatctaatttctcaggctcagtatcactttcatcgagaagcacgttaagcccaacagcaggggggggtgctctgattcggttaagtaataagcaaaatcctcaccaattttcccagtaataagaggcgttgttgaggtatagggattacctgtgccatagtcgatgatggtcacaaaatgaccattccccataaaagggccaaccaaaacttcacctgtggccgttttttgatgtcaacaccagtattttggatgtaccccttaacatgccctttggtatctgcaacagagataatatgaccaaaggaagaatcaccgatgactttaaccgtaatcttgctatcgcctttttgattagccgctaatatttgattagcaatcagggtgcgaccaagagcaactgttgaagacgacaaggtatgatgtttttcctgagccaatttaacagtctcggtgctatcgaggacataagacctgaaggcaccagaggcagaaattgatttaataattttatccataacctatgttatagcacaaagagagagtttgtatggactggattagctgaaaattttagactaaaaagtagtgccagtggattttgaaaggtaacaaaagagtcttccgtttaaacgagaaggctgtttttagtcgtttcagatgaaggcaaaaggacgatgaaataattccgtaccttcatggattgctatgttactggcatgaggtctcacgatatttagtaagatattcgtttgaagatattcccacgtattttttaaaggttttaagaaaatgtgtggtgtcgtaaaaatgtaataatttcgctacttccccaatcggtacccctctttgcagtagtaattgtccctccttaatttttgcctttagaatataactttgcaaggaaatgtcagagtattttttaaaaaccgagcgtaagtgggaatctgagatatataggtagttggcaatatcagatactttgagtttggagtagaggtggttgtccacataatggagaatactattgtacatttgctgcttgtcagagatgctcttattggttaaggattctgaaaaatcaataagagctgcacagcgaattcttgaaacatcaataagatcaggagcctattcgtttaaagccatatagtgctttaccagcgcataacttttagccacatcagtattttcctcgaaacttaattctagtaattttgttaagtaaacaacagttaagttcttttcagctcttagggcagggattgaagatgaggtaacactggatgatgggaggcgattaatttcttgctttaacagttgagtgttacccagcttaacgagatcaataatgtgattgagatggtttaaaacagtgggtaactgaaaagagtttttcttagtatgttttaggtgaagaacaatatcaggatccgcaacaatctgttctgactcttctaataaatgattgatggcttgttggcaactagcctcaaactgtgtttggaaaaaggcatcgatagacacaagaagactacgtatactggtagtaggaaaacaagggacaagctttatataggataagatttcttttttactacgatgagaaaattgttctagaaagcgactggataactgttcttgcctattgatatcagggctatagggataaaatggtccaatagcaataagatattgacagacaggaaaaattaagaatgattcttcaaaaagaccctcataaacagtgatatcttggttataagggatagctaaatgttttaaaaactgatagtaaggcaacagatagtcttcgttaccatataactgaacgagttccttgtctcgtgacatgactgaaataggtagttgagatatggtatgcaatgtttgaacatgtttaaaatcgaatgtaaccatttgatagaccgccttcattatcatttctagaatttttctttaggtttgtaaagactacaaaataaaatgatgaaaacaactatcttgtggatacactaaaaagacacgctaattagcaaactctctcttcatcatctctcaccattattatactactatttatatgacaaataaaggtgattttgttaaaaatataactttgaaaatccacatatatttttaatcttccgtctgaaaaaaataaataaaaatagtaaaaataaacacgaatttaaaataagcaaattttttaagaaaatctgtgctaaactttaatagttttgtgcttaataataatcagcacttacaaagaacaaagggaaaagcgaggagagaacttttaatgaaattatcgaagaagttattgttttcggctgctgttttaacaatggtggcggggtcaactgttgaaccagtagctcagtttgcgactggaatgagtattgtaagagctgcagaagtgtcacaagaacgcccagcgaaaacaacagtaaatatctataaattacaagctgatagttataaatcggaaattacttctaatggtggtatcgagaataaagacggcgaagtaatatctaactatgctaaacttggtgacaatgtaaaaggtttgcaaggtgtacagtttaaacgttataaagtcaagacggatatttctgttgatgaattgaaaaaattgacaacagttgaagcagcagatgcaaaagttggaacgattcttgaagaaggtgtcagtctacctcaaaaaactaatgctcaaggtttggtcgtcgatgctctggattcaaaaagtaatgtgagatacttgtatgtagaagatttaaagaattcaccttcaaacattaccaaagcttatgctgtaccgtttgtgttggaattaccagttgctaactctacaggtacaggtttcctttctgaaattaatatttaccctaaaaacgttgtaactgatgaaccaaaaacagataaagatgttaaaaaattaggtcaggacgatgcaggttatacgattggtgaagaattcaaatggttcttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactaggtggtgctgagtttgatttgttggcttctgatgggacagcagtaaaatggacagatgctcttattaaagcgaatactaataaaaactatattgctggagaagctgttactgggcaaccaatcaaattgaaatcacatacagacggtacgtttgagattaaaggtttggcttatgcagttgatgcgaatgcagagggtacagcagtaacttacaaattaaaagaaacaaaagcaccagaaggttatgtaatccctgataaagaaatcgagtttacagtatcacaaacatcttataatacaaaaccaactgacatcacggttgatagtgctgatgcaacacctgatacaattaaaaacaacaaacgtccttcaatccctaatactggtggtattggtacggctatctttgtcgctatcggtgctgcggtgatggcttttgctgttaaggggatgaagcgtcgtacaaaagataactaaataaaaggctacttcttaagtaaccatgtttaagaaaagagaaatagccttatttctctttttgtcgtttttaaaataaaggaacatcatgaaacaaacattaaaacttatgttttcttttctgttgatgttagggactatgtttggaattagccaaactgttttagcgcaagaaactcatcagttgacgattgttcatcttgaagcaagggatattgatcgtccaaatccacagttggagattgcccctaaagaagggactccaattgaaggagtactctatcagttgtaccaattaaaatcaactgaagatggcgatttgttggcacattggaattccctaactatcacagaattgaaaaaacaggcgcagcaggtttttgaagccactactaatcaacaaggaaaggctacatttaaccaactaccagatggaatttattatggtctggcggttaaagccggtgaaaaaaatcgtaatgtctcagctttcttggttgacttgtctgaggataaagtgatttatcctaaaatcatctggtccacaggtgagttggacttgcttaaagttggtgtggatggtgataccaaaaaaccactagcaggcgttgtctttgaactttatgaaaagaatggtaggactcctattcgtgtgaaaaatggggtgcattctcaagatattgacgctgcaaaacatttagaaacagattcatcagggcatatcagaatttccgggctcatccatggggactatgtcttaaaagaaatcgagacacagtcaggatatcagatcggacaggcagagactgctgtgactattgaaaaatcaaaaacagtaacagtaacgattgaaaataaaaaagttccgacacctaaagtgccatctcgaggaggtcttattcccaaaacaggtgagcaacaggcaatggcacttgtaattattggtggtattttaattgctttagccttacgattactatcaaaacatcggaaacatcaaaataaggattagcatgggacaaaaatcaaaaatatctctagctacgaatattcgtatatggatttttcgtttaattttcttagcgggtttccttgttttggcatttcccatcgttagtcaggtcatgtactttcaagcctctcacgccaatattaatgcttttaaagaagctgttaccaagattgaccgggtggagattaatcggcgtttagaacttgcttatgcttataacgccagtatagcaggtgccaaaactaatggcgaatattcagcgcttaaagacccctactctgctgaacaaaagcaggcaggggtcgttgagtacgcccgcatgcttgaagtcaaagaacaaataggtcatgtgattattccaagaattaatcaggatatccctatttacgctggctctgctgaagaaaatcttcagaggggcgttggacatttagaggggaccagtcttccagtcggtggtgagtcaactcatgccgttctaactgcccatcgagggctaccaacggccaagctatttaccaatttagacaaggtaacagtaggtgaccgtttttacattgaacacatcggcggaaagattgcttatcaggtagaccaaatcaaagttatcgcccctgatcagttagaggatttgtacgtgattcaaggagaagatcacgtcaccctattaacttgcacaccttatatgataaatagtcatcgcctcctcgttcgaggcaagcgaattccttatgtggaaaaaacagtgcagaaagattcaaagaccttcaggcaacaacaatacctaacctatgctatgtgggtagtcgttggacttatcttgctgtcgcttctcatttggtttaaaaagacgaaacagaaaaagcggagaaagaatgaaaaagcggctagtcaaaatagtcacaataattcgaaataataaaatcagaaccctcatttttgtgatgggaagtctgattctcttatttccgattgtgagccaggtaagttactaccttgcttcgcatcaaaatattaatcaatttaagcgggaagtcgctaagattgatactaatacggttgaacgacgcatcgctttagctaatgcttacaatgagacgttatcaaggaatcccttgcttatagacccttttaccagtaagcaaaaagaaggtttgagagagtatgctcgtatgcttgaagttcatgagcaaataggtcatgtggcaatcccaagtattggggttgatattccaatttatgctggaacatccgaaactgtgcttcagaaaggtagtgggcatttggagggaaccagtcttccagtgggaggtttgtcaacccattcagtactaactgcccaccgtggcttgccaacagctaggctatttaccgacttaaataaagttaaaaaaggccagattttctatgtgacgaacatcaaagaaacacttgcctacaaagtcgtgtctatcaaagttgtggatccaacagctttaagtgaggttaagattgtcaatggtaaggattatataaccttgctgacttgcacaccttacatgatcaatagtcatcgtctcttggtaaaaggagagcgtattccttatgattctaccgaggcggaaaagcacaaagaacaaaccgtacaagattatcgtttgtcactagtgttgaagatactactagtattattaattggactcttcatcgtgataatgatgagaagatggatgcaacatcgtcaataacgatgttgtgaatggcttacttacttatcaaataggtgactaatgatgattgtgaataatggttatctagaagggagaaaaatgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaattacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattgtaaggtgtcgttgaaattattaaataatagaaaatgactagttttggcctttccctattgtcagtcagattagttattatcaagcttctcatgccaatattaatgcctttaaaagaacagttacaaccattgaccgtacggagattcaacgacggttaggtctgtctaaagcctacaatgctagtatttctggaacaagtagtcagtcgactcaatctgtgctgagagattcttattctgaggagcaaaaaaggcagggtggactgaatacgctaggatgttagaagtcagagagcaggttgaccatgtgatgattccaaaaatcaatcaggatttaccaatctacgctggtccagaagaggacaatctgcaacggggagttggtcatctagaagggataagtttgccgattggaggggcttctacacatgcggtcttgagcggtcaaagaggtatgccagctgctcggttgtttgcggatttggataagatgaaaaaaggtgattatttttatgttaccaatctgaaagaaaccttggcttatcaagtggatcgtatcatggtgattgaacctagccaattggatgccgtgagcattgaagaggataaagattatgttacccttctgacctgtacaccttatatgggctctttgtcaactgtaatgggtgacttatcattaacaacgagagagaatcagcttggttctctctctttttggatgttcaaagcgatgagaattttgcttttaaaatttttaaagttgcgaaagccaaaggcttgtcgcttgatgtctttgataagcttgttggtcgcttctaatttggcattggaaagggatagctgagggcgtttgtgatgtaagttttgtacttcatgaaggtcctaaagaccattttaaaagcagaattgccagttgttacgttatcatctatgaagctaaagaattcagttgttcgcttttcttagaaatgaaagagtatgagctgataaaggtcgttataatagcggagctcatctgagaaaacttttatacctcaaagtcagtctagctttgatatcatgaagccattaggagttattccttatcttttagtggcgcgcgatccatatagtgatagatcgagatatttagatccaaaagttctatcatcctcttttggcgccttttttccagcagataatattaaggtagcttggtctaacaactccagcactttatttacaccacctattaatgcaaactacaccactcagattcaagctattgggacaacgattaagtcacaaattccggaatcgattttgacgattacggataaaaagagcaggaagttcagcattaacaagattgacgaagctaaagaaggcttagtaggtgcgaccttcaccttgtctaaacgcacaacagtagcggcagatcatcaagtacaaggagatttcattcctgtcagcaaagagacgacagtcggtcggacaacccttacctttgacaaccttaaacctggattttatgaccttaaagaaacgaaagcgccgaatgcttacgtacttgatcctaagacttatgttgtggtcgttcaaaattcaggaaaaacgacaattgtggatgaagctaacttcaaagaggctgattacccaatggctgataataccagccatgtggagtgcgtagcgttgctacaacgaagcaaagggtaaaaatcctttattttaagcactttttcaagcattttgtctttattgaaaagagtgattttaacataaaaaaggtattaaaaaacatattgacgtgaccgtttgttttgaagtggcttgcgtagacaaaaaaatagatacgtcagataaatttctggcattacgagaacatttttagagtgttctctttttttagtttacggaggaaaaatatatatggaaaaacaggattcacgagttctcatccattgggaggggaattctggggacaagctcattgaacaccaaaccagcgcaacggggtggtactaccaagtcgatcgtagctttagtcaaccaaaaggggaaccgcccagaatgatccaaaggcactagaaagtgtccgtaatgattcgatttcgggcggtgatgatgtcatgggttatgcttatagcaaatgtacttggggagttgcggcacgaattaatcagtgggactgaaactcaaaggttgaaatggtgagaagattaccattaccagttcaatgggaaatggtcaggattgggttggaacagccgaaagactagatggtgaaactgatacagttccaaaagaaggtactattctctctttttaggaaagtagttatggttcgtatataggctacggaactatatctttcgtcacattacatctacagatagtaccatgaattttgcttatatgaccaagtaaagtgaggatatactaacaaatgaaatatttattatcgtatttgtccattttatcgaaaagtttgcatattatcattatgtttgataagatgcaaatataatgatagtaggagctaaatatggatatttaaaaaatcaagagtatcctaagtgctttccattttgaaattcaaatatagctaatagttctagaacttctaattgtttttcgtcgacgatatgaattttcaatcttaactgttagaattccacctccctttggttaaagaaaaaaggtcaggtcgtttagataactttgtcaaacaagctcaagctatctaaaaatagtttgaaatgggcattactctagtttttaataagctatctgatgagcagaaggagaagttaatgcatgttgggaagtcttattttgactatcaagaaaatgctcttatcccacaattaggttttctatattctaaattaactaaaaaaattgaacttgataatcggttgtctccgactgaacaaaagttattgattaccttattattacatactaaaggtttaatcattgatatgtaagaagtaagtcagctaaccgatctttctattctaaaacttatattgttgctttagaaattttaaagagcgtggatggcttcataataaacagaaatcttaccaatttgcgaagccaaaaaatatgatatttgaagagtccaaagatctaatagatagtccagttagagaagcgttgattataagtgataaggattttcaaaaattaaaacaagagctattattttaaccgacttattttaaagacttatcatatctaggcttgcttgatgattcggaaaaatacggagactatactatttcaaggaaaagatacaaaagtttcgaatcaagtcttcaactatacatccttcaaagtcatcggctagagatttggaattatgaaccaatccctttgattactagaaaaataaatagcttggagaggctaacgtgacactggttgatccaatctcgctttatttaacactaagaatgatgaagaccctcgtattgaagaagaagttgagcagctagaa

SEQ ID NO: 302 - DNA, 13008 bp, S. agalactiae
taacacggattggaaataacatcaatcaaatttcgcgtgctatcaaccaaagccatctaatttctcaggctcagtatcactttcatcgagaagcacgttaagcccaacagcagggggggttgctctgattcggttaagtaataagcaaaatcctcaccaattttcccagtaataagaggcgttgttgaggtatagggattacctgtgccatagtcgatgatggtcacaaaatgaccattccccataaaagggccaaccaaaacttcacctgtggccgttttttgatgtcaacaccagtattttggatgtaccccttaacatgccctttggtatctgcaacagagataatatgaccaaaggaagaatcaccgatgactttaaccgtaatcttgctatcgcctttttgattagccgctaatatttgattagcaatcagggtgcgaccaagagcaactgttgaagacgacaaggtatgatgtttttcctgagccaatttaacagtctcggtgctatcgaggacataagacctgaaggcaccagaggcagaaattgatttaataattttatccataacctatgttatagcacaaagagagagtttgtatggactggattagctgaaaattttagactaaaaagtagtgccagtggattttgaaaggtaacaaaagagttttccgtttaaacgagaaggctgtttttagtcgtttcagatgaaggcaaaaggacgatgaaataattccgtaccttcatggattgctatgttactggcatgaggtctcacgatatttagtaagatattcgtttgaagatattcccacgtattttttaaaggttttaagaaaatgtgtggtgtcgtaaaaatgtaataatttcgctacttccccaatcggtacccctctttgcagtagtaattgtccctccttaatttttgcctttagaatataactttgcaaggaaatgtcagagtattttttaaaaaccgagcgtaagtgggaatctgagatatataggtagttggcaatatcagatactttgagtttggagtagaggtggttgtccacataatggagaatactattgtacatttgctgcttgtcagagatgctcttattggttaaggattctgaaaaatcaataagagctgcacagcgaattcttgaaacatcaataagatcaggagcctcttcgtttaaagccatatagtgctttaccagcgcataacttttagccacatcagtattttcctcgaaacttaattctagtaattttgttaagtaaacaacagttaagttcttttcagctcttagggcagggattgaagatgaggtaacactggatgatgggaggcgattaatttcttgctttaacagttgagtgttacccagcttaacgagatcaataatgtgattgagatggtttaaaacagtgggtaactgaaaagagtttttcttagtatgttttaggtgaagaacaatatcaggatccgcaacaatctgttctgactcttctaataaatgattgatggcttgttggcaactagcctcaaactgtgtttggaaaaaggcatcgatagacacaagaagactacgtatactggtagtaggaaaacaagggacaagctttatataggataagatttcttttttactacgatgagaaaattgttctagaaagcgactggataactgttcttgcctattgatatcagggctatagggataaaatggtccaatagcaataagatattgacagacaggaaaaattaagaatgattcttcaaaaagatcctcataaacagtgatatcttggttataagggatagctaaatgttttaaaaactgatagtaaggcaacagatagtcttcgttaccatataactgaacgagttccttgtctcgtgacatgactgaaataggtagttgagatatggtatgcaatgtttgaacatgtttaaaatcgaatgtaaccatttgatagaccgccttcattatcatttctagaatttttctttaggtttgtaaagactacaaaataaaatgatgaaaacaactatcttgtggatacactaaaaagacacgctaattagcaaactctctcttcatcatctctcaccattattatactactatttatatgacaaataaaggtgattttgttaaaaatataactttgaaaatccacatatatttttaatcttccgtctgaaaaaataaataaaaatagtaaaaataaacacgaatttaaaataagcaaattttttaagaaaatctgtgctaaactttaatagttttgtgcttaataataatcagcacttacaaagaacaaagggaaaagcgaggagagaacttttaatgaaattatcgaagaagttattgttttcggctgctgttttaacaatagtggcggggtcaactgttgaaccagtagctcagtttgcgactggaatgagtattgtaagagctgcagaagtgtcacaagaacgcccagcgaaaacaacagtaaatatctataaattacaagctgatagttataaatcggaaattacttctaatggtggtatcgagaataaagacggcgaagtaatatctaactatgctaaacttggtgacaatgtaaaaggtttgcaaggtgtacagtttaaacgttataaagtcaagacggatatttctgttgatgaattgaaaaaattgacaacagttgaagcagcagatgcaaaagttggaacgattcttgaagaaggtgtcagtctacctcaaaaaactaatgctcaaggtttggtcgtcgatgctctggattcaaaaagtaatgtgagatacttgtatgtagaagatttaaagaattcaccttcaaacattaccaaagcttatgctgtaccgtttgtgttggaattaccagttgctaactctacaggtacaggtttcctttctgaaattaatatttaccctaaaaacgttgtaactgatgaaccaaaaacagataaagatgttaaaaaattaggtcaggacgatgcaggttatacgattggtgaagaattcaaatggttcttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactaggtggtgctgagtttgatttgttggcttctgatgggacagcagtaaaatggacagatgctcttattaaagcgaatactaataaaaactatattgctggagaagctgttactgggcaaccaatcaaattgaaatcacatacagacggtacgtttgagattaaaggtttggcttatgcagttgatgcgaatgcagagggtacagcagtaacttacaaattaaaagaaacaaaagcaccagaaggttatgtaatccctgataaagaaatcgagtttacagtatcacaaacatcttataatacaaaaccaactgacatcacggttgatagtgctgatgcaacacctgatacaattaaaaacaacaaacgtccttcaatccctaatactggtggtattggtacggctatctttgtcgctatcggtgctgcggtgatggcttttgctgttaaggggatgaagcgtcgtacaaaagataactaaataaaaggctacttcttaagtaaccatgtttaagaaaagagaaatagccttatttctctttttgtcgtttttaaaataaaggaacatcatgaaacaaacattaaaacttatgttttcttttctgttgatgttagggactatgtttggaattagccaaactgttttagcgcaagaaactcatcagttgacgattgttcatcttgaagcaagggatattgatcgtccaaatccacagttggagattgcccctaaagaagggactccaattgaaggagtactctatcagttgtaccaattaaaatcaactgaagatggcgatttgttggcacattggaattccctaactatcacagaattgaaaaaacaggcgcagcaggtttttgaagccactactaatcaacaaggaaaggctacatttaaccaactaccagatggaatttattatggtctggcggttaaagccggtgaaaaaaatcgtaatgtctcagctttcttggttgacttgtctgaggataaagtgatttatcctaaaatcatctggtccacaggtgagttggacttgcttaaagttggtgtggatggtgataccaaaaaacacactagcaggcgttgtctttgaactttatgaaaagaatggtaggactcctattcgtgtgaaaaatggggtgcattctcaagatattgacgctgcaaaacatttagaaacagattcatcagggcatatcagaatttccgggctcatccatggggactatgtcttaaaagaaatcgagacacagtcaggatatcagatcggacaggcagagactgctgtgactattgaaaaatcaaaaacagtaacagtaacgattgaaaataaaaaagttccgacacctaaagtgccatctcgaggaggtcttattcccaaaacaggtgagcaacaggcaatggcacttgtaattattggtggtattttaattgctttagccttacgattactatcaaaacatcggaaacatcaaaataaggattagcatgggacaaaaatcaaaaatatctctagctacgaatattcgtatatggatttttcgtttaattttcttagcgggtttccttgttttggcatttcccatcgttagtcaggtcatgtactttcaagcctctcacgccaatattaatgcttttaaagaagctgttaccaagattgaccgggtggagattaatcggcgtttagaacttgcttatgcttataacgccagtatagcaggtgccaaaactaatggcgaatatccagcgcttaaagacccctactctgctgaacaaaagcaggcaggggtcgttgagtacgcccgcatgcttgaagtcaaagaacaaataggtcatgtgattattccaagaattaatcaggatatccctatttacgctggctctgctgaagaaaatcttcagaggggcgttggacatttagaggggaccagtcttccagtcggtggtgagtcaactcatgccgttctaactgcccatcgagggctaccaacggccaagctatttaccaatttagacaaggtaacagtaggtgaccgtttttacattgaacacatcggcggaaagattgcttatcaggtagaccaaatcaaagttatcgcccctgatcagttagaggatttgtacgtgattcaaggagaagatcacgtcaccctattaacttgcacaccttatatgataaatagtcatcgcctcctcgttcgaggcaagcgaattccttatgtggaaaaaacagtgcagaaagattcaaagaccttcaggcaacaacaatacctaacctatgctatgtgggtagtcgttggacttatcttgctgtcgcttctcatttggtttaaaaagacgaaacagaaaaagcggagaaagaatgaaaaagcggctagtcaaaatagtcacaataattcgaaataataaaatcagaaccctcatttttgtgatgggaagtctgattctcttatttccgattgtgagccaggtaagttactaccttgcttcgcatcaaaatattaatcaatttaagcgggaagtcgctaagattgatactaatacggttgaacgacgcatcgctttagctaatgcttacaatgagacgttatcaaggaatcccttgcttatagacccttttaccagtaagcaaaaagaaggtttgagagagtatgctcgtatgcttgaagttcatgagcaaataggtcatgtggcaatcccaagtattggggttgatattccaatttatgctggaacatccgaaactgtgcttcagaaaggtagtgggcatttggagggaaccagtcttccagtgggaggtttgtcaacccattcagtactaactgcccaccgtggcttgccaacagctaggctatttaccgacttaaataaagttaaaaaaggccagattttctatgtgacgaacatcaaggaaacacttgcctacaaagtcgtgtctatcaaagttgtggatccaacagctttaagtgaggttaagattgtcaatggtaaggattatataaccttgctgacttgcacaccttacatgatcaatagtcatcgtctcttggtaaaaggagagcgtattccttatgattctaccgaggcggaaaagcacaaagaacaaaccgtacaagattatcgtttgtcactagtgttgaagatactactagtattattaattggactcttcatcgtgataatgatgagaagatggatgcaacatcgtcaataacgatgttgtgaatggcttacttacttatcaaataggtgactaatgatgattgtgaataatggttatctagaagggagaaaaatgaaaaagagacaaaaaatatggagagggttatcagttactttactaatcctgtcccaaattccatttggtatattggtacaaggtgaaacccaagataccaatcaagcacttggaaaagtaattgttaaaaaaacgggggacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaattacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattgtaaggtgtcgttgaaattattaaataatagaaaatgactagttttggcctttccctattgtcagtcagattagttattatcaagcttctcatgccaatattaatgcctttaaaagaacagttacaaccattgaccgtacggagattcaacgacggttaggtctggctaaagcctacaatgctagtatttctggaacaagtagtcagtcgactcaatctgtgctgagagattcttattctgaggagcaaaaaaggcagggtggactgaatacgctaggatgttagaagtcagagagcaggttgaccatgtgatgattccaaaaatcaatcaggatttaccaatctacgctggtccagaagaggacaatctgcaacggggagttggtcatctagaagggataagtttgccgattggaggggcttctacacatgcggtcttgagcggtcaaagaggtatgtcagctgctcggttgtttgcggatttggataagatgaaaaaaggtgattatttttatgttaccaatctgaaagaaaccttggcttatcaagtggatcgtatcatggtgattgaacctagccaattggatgccgtgagcattgaagaggataaagattatgttacccttctgacctgtacaccttatatgggctctttgtcaactgtaatgggtgacttatcattaacaacgagagagaatcagcttggttctctctctttttggatgttcaaagcgatgagaattttgcttttaaaatttttaaagttgcgaaagccaaaggcttgtcgcttgatgtctttgataagcttgttggtcgcttctaatttggcattggaaagggatagctgagggcgtttgtgatgtaagttttgtacttcatgaaggtcctaaagaccattttaaaagcagaattgccagttgttacgttatcatctatgaagctaaagaattcagttgttcgcttttcttagaaatgaaagagtatgagctgataaaggtcgttataatagcggagctcatctgagaaaacttttatacctcaaagtcagtctagctttgatatcatgaagccattaggagttattccttatcttttagtggcgcgcgatccatatagtgatagatcgagatatttagatccaaaagttctatcatcctcttttggcgccttttttccagcagataatattaaggtagcttggtctaacaactccagcactttatttacaccacctattaatgcaaactacaccactcagattcaagctattgggacaacgattaagtcacaaattccggaatcgattttgacggttacggataaaaagagcaggaagttcagcattaacaagattgacgaagctaaagaaggcttagtaggtgcgaccttcaccttgtctaaacgcacaacagtagcggcagatcatcaagtacaaggagatttcattcctgtcagcaaagagacgacagtcggtcggacaactcttacctttgacaaccttaaacctggattttatgaccttaaagaaacgaaagcgccgaatgcttacgtacttgatcctaagacttatgttgtggtcgttcaaaattcaggaaaaacgacaattgtggatgaagctaacttcaaagaggctgattacccaatggctgataataccagccatgtggagtgcgtagcgttgctacaacgaagcaaagggtaaaaatcctttattttaagcactttttcaagcattttgtctttattgaaaagagtgattttaacataaaaaaggtattaaaaaacatattgacgtgaccgtttgttttgaagtggcttgcgtagacaaaaaaatagatacgtcagataaatttctggcattacgagaacatttctagagtgttctctttttttagtttacggaggaaaaatatatatggaaaaacaggattcacgagttctcatccattgggaggggaattctggggacaagctcattgaacaccaaaccagcgcaacggggtggtactaccaagtcgatcgtagctttagtcaaccaaaaggggaaccgcccagaatgatccaaaggcactagaaagtgtccgtaatgattcgatttcgggcggtgatgatgtcatgggttatgcttatagcaaatgtacttggggagttgcggcacgaattaatcagtgggactgaaactcaaaggttgaaatggtgagaagattaccattaccagttcaatgggaaatggtcaggattgggttggaacagccgaaagactagatggtgaaactgatacagttccaaaagaaggtactattctctctttttaggaaagtagttatggttcgtatataggctacggaactatatctttcgtcacattacatctacagatagtaccatgaattttgcttatatgaccaagtaaagtgaggatatactaacaaatgaaatatttattatcgtatttgtccattttatcgaaaagtttgcatattatcattatgtttgataagatgcaaatataatgatagtaggagctaaatatggatatttaaaaaatcaagagtatcctaagtgctttccattttgaaattcaaatatagctaatagttctagaacttctaattgtttttcgtcgacgatatgaattttcaatcttaactgttaggattccacctccctttggttaaagaaaaaaggtcaggtcgtttagataactttgtcaaacaagctcaagctatctaaaaatagtttgaaatgggcattactctagtttttaataagctatctgatgagcagaaggagaagttaatgcatgttgggaagtcttattttgactatcaagaaaatgctcttatcccacaattaggttttctatattctaaattaactaaaaaaattgaacttgataatcggttgtctccgactgaacaaaagttattgattaccttattattacatactaaaggtttaatcattgatatgtaagaagtaagtcagctaaccgatctttctattctaaaacttatattgttgctttagaaattttaaagagcgtggatggcttcataataaacagaaatcttaccaatttgcgaagccaaaaaatatgatatttgaagagtccaaagatctaatagatagtccagttagagaagcgttgattataagtgataaggattttcaaaaattaaaacaagagctattattttaaccgacttattttaaagacttatcatatctaggcttgcttgatgattcggaaaaatacggagactatactatttcaaggaaaagatacaaaagtttcgaatcaagtcttcaactatacatccttcaaagtcatcggctagagatttggaattatgaaccaatccctttgattactagaaaaataaatagcttggagaggctaacgtgacactggttgatccaatctcgctttatttaacactaagaatgatgaagaccctcgtattgaagaagaagttgagcagctagaagataagat

SEQ ID NO: 303 - DNA, 14015 bp, S. agalactiae
ggccttgttccgatgttgatcccgataactcctggctcattaatagcctgttcgtaacgctctttaattatctctaacttagcatgggtattggtaaaattttgaaaatagactaagtatttattaacctcaggccactttctatgcatgaaatcaatttctttatagaattgttcacgaataggagcttctggagcaactatagcatcccctgaaccagaaactgtgcaaaaagtgcaccctcctctagcaactgttccgtctctgttaggacagtcaaaaccagcatctataggtaatttaaatattttttctccaaagagttctcgataataatcattaatcgcacgataacgttttttcataggataattgtatcacaattttaactaaaataacctcactactacaataaaactaaaaaagattggaacgtcagttagtcccaatcttttatttacttcactttctttaaccaatccttggctaaaaagatatacgcagttagattcaaaataccataagcaagtataaaaccagctaaaacatctgtcggaaaatgaacccctaggtaaatacgagataacccaattaaaaaaatgagcaaacccaaagtaccttggcacaacagtttccatatactcttaggcatatagtactgcaataaaataataatactcccaaatatcataaatgttcccatcgagtgcccactgggaaacgaatagccacctgcaaatactaaatgggttaaagttggtcttactctttgaaaaataagttttaaagaaagtatacatataccagagataatagcatttactgcgataaatctagcttgaggataccacttcttaaggtaacagaaagtgacgctcataatcgcaatagctatctggcttacagtattaccaatcacagtgattaacttgaaaaatcttgtagaaagatttggcaactgtcctctaacactttcttgaatagtttggtcaaatgaaattacagtgtcgggccaatatttgatgaccaatcctaaactgaaaaataagataatagcaataaatgcttgaataagtttactattttgacgagataacattagtctttttatatctttctaatattggcaaacaagccacgtaagttagatagaaaacaatcgaaattaaaattccctcaacgatattaaatggaataaccattgttaaaaggtaattgcctacaccaataaatgttctgatatcaaagttagcaaatatagcatacaaaggaatcgcaaagacatagttgagagctaccatagatacggtcaagctaactgtaccaaatagactagctttaataaaatcttttgcactctctctatttttccagaaaatagcgaaacttgctaaaaataaagctagagcaaccatattcatcggtaaaccaataaacgtttctggaccacgattagcaagtataacttttaaaagtgatcttaataagagtacaccataacttgatttcaaatcaaataaaataaaagcaactaacatcggaaggattgaaaaatcaacctttaaaaattctgctcctggtattaatggaaatgaaaccatcatcaatacaaaagataaggcagaaagaatggcgattgtcaccattttacgtgtatttgtcataaaaaaattcctccaatttaaataaattgaaagaagctccaaaggtaagcgtatgtacgcgaaaaaacctttgtcttctcccatccagactttactgtcggttgtggaatctcaccacatcagctttcgctcgcggactgatgcttcacaactgacaaataagttggaagcgattaccgccggtcgggaattacaccctgccctgaagacacctatagcataacaaaaaaaacttgcaattgcaagttttttaattactaattagtagtagtgattaaaaatcatattaataccaaattactatactgtatcgtttctttcagatttgctatttttagtttttcttaaaaagataaacaaaattcccaaaataatacaaccaagaattgtcagtcctccaccaataatcattcctgttttaggaagaaatgattgtggaaaaagcggttgtgatggtttaggatttgttggtggaggagtttctttttcgttttctacctctacttcctgtgttttattagcaactacagcaactacagcatccttcatagatatacggtaaccagttagtgcttttgcttctcgaaaaatatacttaccaggtaataaaccttcaacctcaatttctcccttatcatcagttactaatgaagtaatcccatcttgatcggtcgtaaatcgtccatttttaaagcgaactggctgattctggttatcgtataatacaaatattactccggatagccttttctttatctttccttcttttgtatatttaataagttttaatcggcctgtttcaacttttcgcttaggatttatctgtaattgatttgataacttatcatctggtaattcaatataaaaaggtactattgttgaaacgctttgatcagctttataagcacgaccaaagtacgaaccatttgggagtgctatctttgtctgaccattagtatcagtaggagaagtcaagatactcttatacttctggttcaattcgctatctgtcatttggctcaataaatcaacttttaagttgtcagtcacagtccataaacgataagaaatcccctcctctgtagtatttggctgaagtcctatctgtgtgattgttagttgattaggggtatcagcatttacactggctaccgaaaaaaacgctaattgtaccaatcctaaaaagcaacatagtagaagtcctaaactttttctaatctttttcatttttgatttccctttctctttctctctttaaattttcgttttaaatataatagtaaagcgactaatataagaataactaggattgataagaggaaataaagtttatagtgtgtttgcaattctttcattaaatagttcttttctttaacaggaggtacatacttgattcgatgccctctaactagtaaacgatgtgaattaatcgaataaggtgtacatgttagcaaagtcgcataatccttacctttaacaaccaataatttagaaaaattatctggctttacaacacttatttgatcaaccttataggctaaaacttctttgatattatgaatataaaaaatttttccttttttaagtttatctaaatctgtaaataacttagctttaggtaagccgcgatgagctgtgataacagtatgtgaactttttccaccaattggcaaggaggttccttcaaggtgtcctgctcctttttcaagaacactactggtagtccccgcatagataggtaatttttgcttgatagacggtatatcaatatatccaatcatttcagcaatctcaagcatgtgggcgtattcagcaataccttttttttctttttcagtatagggatctgataggcggcttgggtccagtgttctattataagcttttgctaactcaaatcgtctattaatctctttagtatttaatttttgggtttgattatcaaagttagttacttgattattagctttaatattatagtaccaatttgaaataaaaggatatgaggttatcaaaagaccaactaagaacaatagtatcaagcctacattcatccatcgatttaaaacgaccgatttcttaaggtttttctgaaattttcctcccattatgattcaattccttttctaacacttgctaaacgatttttttgacgttgacgttttattaaccaaagtaaccaagcaataataactaaagatatatagaaaagatatctataaatcgtgtttaaatgaccgtcttttattaatttttcatcaataggacctttataagggatacgatgtccccttactaaaagtctgtgtgtattgaccataatcggggtgcaagtcaataaggttgcataatcatgtccaggaacaaccaacaaatctgaaaagttatcgggtgtaacgacttttatctgatctacttgatatgctatcgtttcttttatgttttgaatataaaacttatctcctttttttaactttttaaggttagaaaagagttctttatctggaattcctgaatgcgctgttataacagtatgtgtactattgccctcaattggaagagaggtaccttctaaatgccctgctcctttagatagaacttcttgacttgaacctgcaaatatagggagtttttgacctatcttaggaactgaaattgtgccgattttttcacttacctctaacatacgggcgtactctgctacccccttttgaattcgttttttctcataaggatcttcaagatggacattatttaaagaatcattataagcttgtgctagagccatacgtcgattgatttctttctgactaagttttttagcagctctctcaaaatcctgtgtttgattattagattctatcgtatagtaaaaacgtgataccactggatacaataaaatagatagacctattagaaaaagaatgataaaaggaagatttgacttcttcttttttgtttttttgatgatttttttagtcttcacgtcatctcctaaataatggctcttgcttatgatctaagagtacttctactgaaatacccttagatcataagcacagctttaactgtgcttatacatcatcaaagactagccttaagcttcctctgattgacgtcttttcatgataactactgctccaagcataatgcttaaaccaataattgtgaaaagaattgtaccaataccacctgtttgtgggattgttacctttttattttctactcgttgcgcatctttttttttgctgctagcagcgtagtcaatgttacctgaaccttttctgtatgacctttgattaacttcaaacttaacatcacctgccaatttagcataacctgctggagcttgtgtttcttcaaggttgtaagtaccttctgcaagacctgtaacttcaaattgaccttgatcgtttgaagtcaatttaacaactttagcagctttttatctgttacccactcataagctgtacgagcttcaatgaaggctgcattgtaagcttcttgtttagttttgatagttgcttttgctgttttacctttttgacctttttgttcttctgcagacaacttgttataagctgcgatagcttcatctaaagctattttagtagtagctaaagctgttttttgagctgcttttgcttcatctgctttaagtgcaaggtatttacctgctgagtttttaacaacgaattgtgcacctgccaagcgttcagtttcaggttcatttgttttgacaaatttcttaccatgagtcacaacttttggttcagttgggttgattggtgttgggttatctgaatctttggtattggtgatggttacattaccattttcaagagttattgcagtaccgtaaccagtaacacgttctgagatcatgtatgttttattatcatccagaccagtgaatttacctgcgaagttaccagatactgtaaatttgataccattaccaatgtcgattgtaccattaggtgtttttgtcaatgatactgaagcaacagctgtatcattatctttaaatgtgtaaacaacgtttacattatctggttcactaccttctgcccaagttttagtaactgttatttcaccctttgatggtgtaactggtagttctttcatttctttacctggtttgttaccatagtccaatttgatatcattggtttctggattttcaacaatagctggaccgttaacagtagctctataagtcaatgtgaattcaacatcttttgtttttgctgctttttccacttttgccaaacctttagctgtgaattttaatgtgaaaccacggtcatcagttccaagtttgtagtctgtatccttaacaaaagttcctgccgatgcttcaaggttaacagtgttacccattgtcaaaccatttgacatgctatctgtccaaaccaagtttttgtatttagaacctttgtgaatttttgttttaacttcgtaaggtataactttaccgatttcagcagtagcagttgctttgtctttttgatagttagcataatctgcgccagctgtcaaaagtctattaacactgtcaattgtcaagttgtttgttttagcaaagtttttatctatttgtggtttttcttcagtgttctttggataaacgtgagcatcttcaacaacaccatcttcgtttaccaatggaagagtgattttaactggaactgcttttgaatcagccaggatggaaccattattgttgtaagtagatttttctttcaattcaacgatttggtactttccttttaattttgtagtgttaaaaacaatacctttgtctgttgtcaatcctttaagaacaccatcttcattaatttctgttggttttaatttgttacttccttaccactttccgtaatgtattttgttttatcttcattcataacagcaaagaaagcaccttcgatttctttagatccttcgccaaagtaacctgtaaggtcagtaatttgtttacctatgtagtcttttccattcataccttttgttcctgggaagttacttttgtcaaaattagcttgtgtttggacaatcttgtgcaaggtcactgtattagttgttgcttcatccgcaaacgctggtgcaactgagaacaatgacgttaaagtcagtaacaatgccgagaacattgcaaaatatttgttgattcttttcatttctatctccttcttattttagttaatcaacatgattaataatatgcggattttaatacaccgcagcaccactcccttcaagtcatggaattttagttaattaattaagaatactaaagcgcataatttttaatcttttttgatggacatatcactagatttcttataccttttccaaatataaattccacctgcaatagacatcatagctccacctattaaaatgaaagatagaattcctttcccacctgtcataggaataattccttttggtggaatatgcgtgttggtaattaaatgcttgtcaccttcctcatgatattcagaaatctgtttattaacagctattatattttttatcgatcctttaaccacttcaaaagttaaaattggtttattagtaattttttgataatcctccggcgaaactgcttctattaactgatatttgccatctttcaaatctttgtaagaaattttgccgttttctcccgtcactacttttgaattattattttttattggtaaataaagtttataatcttcattaaattcttgaagttcaaacgtagctcctttgagaagcaacttattattatctttatcaacttttataaattcaatttcacctaacttcttctcgtttttaatcgttattgtaggatattctctcacatcacgaattttagggattggaaaatctctaagtgtattaggatcctctgacttaggattcaatgttgttctaccattagtgtcatagaatttgttacttataaaactgtcatctagtttcacatcatatgtgagtgttactttttgaccttctcctaaattcaaacctctaacatagagtttatttccgatgtattctaatttaacccccttaagtattccaccatcattattaggcccaccagttgcaataccatccttcattacacttccatcatttccctgtaaagtataatcacttggctgtaatgtttgtccattaccaagctgtaaattgattttatcacccataggatcttcgatagttccattaacaattgagttttcttttgttaaaatcgtttcaaattgttgctgaattttagataaaatttcattgttagatgtatcggctgaagttacgataggggtgtagtactcaggtttggaagagaacgacctcattagttctgtgatttctccatctgaaagtttaaaagcttcctctttcaatttttgaaaagtaccatcttgatttttcttatactcctcattataaacttgtctaaaaccagatatatcgataccaaaattaaaaatgtcataatttttctgttttaaactatttatataaagtttggttggtgttccatgttctttcactggtccatttcgataaattgtacctttagggtaattaagatttaaatctaaataatgaagtttttgtaagtttccagagattatctgtgtttgataactatctaagggaaacaaaaagtaactctccccatttccttttatatcctcgggcttatcagtaagtagaaaattacttttatttagatatccattttttttcatttgttcaaattggctttcatatgatgcacccagtttaaaattattaatagcatatgatctcgtaggaacaccatcagttacatgaacaataattttttgactatttcgatttacttgactcaaaatatcatctgcctccatgaaggctttcatagtaaatgtttctcctactttactaagatagtactccttttgttgctctggagttaatccattggtagtagatccccacttagctttaggagcttctgtcggaatcctttttataatctcttcagcattatttgttaattgtttatgactataattctctgtctgaattgtgaacttagtttgaaggccataatatttatcatcttctttaaatccttttacgacatctacactcctaccatcaaaaatatctgaaccataggtaactaatgcaaccctattatcactgtttgctcctaaaatatcttttactgcggtcccaagagcttcggcagctttcttggctttattatgcctttgaaaatttgggccatcgttattcattgagttagaattatcgagtacgaagacaacatctaacggcttttgtttgtccactggttttactatggtttttccactgacagttaactcaattttatatttattatgagctaaatcacctacttctgaaatacgtttagataatgttccctctggaatttctcttatatgctcaccttcacttgaatatgggttaactgcttttgcctctgactttccatttggaactgaacctttaacatgctcaagtttataagattcctttgtatcttcataaattcctgtggggggatactgcttatctagttcttcctgattttgtccaattgtggaatttttatcaccactattttgtatcgtagtttttccattactctcaaccttaacttgccaagtctggttagtctttttataaccttcgggcgctgtttcttctgataaagtataatctccaggtatgagattatcaaaagtagcttcacctgttagctcagcagttactttttctattttactttctggatgagcagtagtttttaaaacaaaggtagcttttgaaagtggtttgttctggtcatctgtctttttaacaactaactttcctttagcaccattttccggtacggtactttcccctaaaacattggtattaagcggtatttgcgacaaacaaaaaagacttaacgtcaatattttagaaaatttttggtattttctcattttacaactcctattgtgccgaaatgtcgtttctaaatctaagatcagatacagaatatcctagaatatacaaactatcacttattatgatatcaataatttcttattataaggtatggaattttaatgttttttcccaatttttgaataatttttctttttatttgataatcttattttttattatcttagaaatatttcaatgagcttaagtagttgatttttctttttttatgttttaaaatattgcttaaaaataatgtttgagagagtttactgaattgattgaaaattatttagaaaaagacatccttaatcaaataaaacttctaactttatgctatgattactacccttccattactctagacaaatcatgtcatcaacttggtttatctgaactacttattaggaaatattgtcatgatttaacaactttatttaacagtcaactctctctgaatatcgaaaagagtacaatagtctaccaatctaatggtgtaactagagaacaagctttcaaatatatttatcatcaatcacacgttttacaacttttaaaatttttgatcacgaatgattcaggcaggttacctttaacttactttagtgaaaaatttggactatcttgtgcaactgcttatcgcatacgaaaacatattagtccattactagaaaaacttggatttcagattgtcaaaaatactattaccggtgacgagtatcgaattcgctatttaatcgcatttttaaatgctcaatttggtatagaagtttatcccatgtctaagatggataaattgctcatcaaacgattgttattagaacactcaactacttttactgcttctcattacttcccaaatacatttattttctttgatacattgttgtctctatcatggaaacgtattaattataatgtagttgtcccttactcatcccttttcactgaactacaaaatatatttatctatgatacattacaatattgtgtcaaaaatgttattatagattcctttaaaattaatttaaaaaaagacgatatagactatatttttcttgcttaccttacttcccataactctttttctaatccaaattggactgagaagcgtatcgataatgtaatagctattttcgaaaattatcccaaattccaaaaattattacagccactcaaagatgctcttcccttatctggctcctatcatgatgagttggtaaaagttgctatcttttttttccgaacatttattttaggattaaatcaattaatccctgaaacaatttcatttccttcatggaactatcatagacatgataaattaactactattctccgaccgataattacaaattggttaagtaaaattggagaatacacgtttaaagaacaacattttcttctcctttgtactcatctagaaagaatcatcaaaaatcatattcctccgatacagatagccgtactaactacagactttattaataaccaaattttaacagaatgcttattacagagattttcttctaaaaagattcatttccacccttactatttattaactgatgatctttccaatattactaatcttaatccagacattattattaccaataaaaagctttctccctttatcaaacatgagatttcttcagagagtttaattacatatattgatctgattaatacttcagaccaaatcaatcaaatccaaaaaattatttcatcaatacaggaagaaaaatattgcaaactttttgcaaaaactaatgaaataactaatcgtagctcctataactcttaaaaattaacattaaaaagctagagcattgtgtaatgctctagctttttaatgttaatttttttgaataatataatccaacttttcaactgttttttcccatgtgaaatgttctttaattcttttagcaatattctgttgtagtttctctcttaatgccttatcttttactaataaatcaagagattcatggagtgactgagtattttcttccatgatgattcctaactcagggctatcaataacttcaactgttccaccgcgatctgttgcaataatagcacttgaaagtagaccagcttctaaaatagaggttggtaatccctctggatacattgaagggtaaacaaagatatcagtctgtgccattaaagacatagtctgttcaaagtttaatttccccaaaaagttaatctgtttggactgatatttctctttcaaatgtgctaattcaggtccgtctcctgcaatctgtaaataaacattttcagagtactgtgacatcgaaaatgcttctaagagcaattcaatgcctttttctttaataattctaccagcataagtgatgaaaatatcatcagcagatttttcaaggtaagccgtaccagcaaaatcagagcctagactttcagataccgaattataaataactcctttagcttctatattaaaatgttttaaccattcaacgcttctcttggataccgcataaaaatctggacgataatgcttaacacgcgctgtgagaagatgttcatagatagctccaaagaaatctaaaaaacgattattgacagaaaaatgacttgacccatggtctaaaacaatactaggtaaatggtgattctttgcaaaagatagcccttctagcgttgttaactgaaaacgtgtattacaaatcacaaaatcaatattttcatctgaaacatatttcatcagcgtgttgtattctcgatttttgttaataataggatagcgctgcttgacaatatttttggtcggtaaacggtaaatttttctacccttgtcttcatctataatcggtaaatcaccatgattagttgttacaataacaacacggtagccacgcttaaccaaatctgctgtcattttatctgtataacgttcaatacctccgaggaagggtagataatatcctgagaaaacagcaactgtttttaccttattttccatatttatccactttcatcaataagccatcttttaagcctttaatcatagcaactatttttttgctcttttgctcttctgctaccaacactcgaacaaattcatttcgcataaatactaaatatttgtatcgcttcttcttaccatatttttttataatatagatcgcattgcgtatcatgtaatattttcgaaatggtgaatgattcaatacatgaaaaacatggccaaattttttaactcgtgaagagtgtccaatttcgtgtaacagaccaataaaattaacctgataagtcttatatcccatctctgacagacgataattcatttcagagtcaacaaaatcaataaacatctcttctgcaaagccagatgtttcttcgaaaacgctcgttttcattaaagcagccgaagtaatacactcttcaatttctttatagtcaaattcttgcatcactaaattttcacggttcatatcttgatacaaacaagataacataccgaccttaggtaaatgaaggtaattttcataattatctatcaaatcacctaggacaaccgaatcttgatctaaagtcaagaaccaatcaaattcttgtgctactgcaaattgaccgatacagttcaaagcatatgcaattcctttattttctgttaaataatcaacagttaggtgcccctcttcattataatcggctactaattgagaaatttcttccttatttttcgagccattatctacgatgtagatatggcttacttgaggataaattgctcgaatgttctgatctaagcgttcaatattggggttaaaggtgacaatacccgctaaatatttcatgttctatgctcttttctaaaatctctaaataactgaatgactggtgctttggttataaaaacgataccgacatagatagttactgctactaaactttgaatgacataatttaccaatgatactgacatttgagtattgatataatagagtacagctccactaagagtagcagcaattaaatagcgcagcattcctcttgttaattctttaaaagtaaatacatctcttaaagagatagcttgatatagggagacaataaattcagtaataactgtagagataatagctcccatagcacctaaaattggtattaaaagtatattaagcacaacatttgccacaagtccaataactgcagacattgtgtaagcttttgtacgtcttgaagccagtagatactgtgtccctaaagcgttaccataagaaatgcaaatgatcatcaaagactcaacaccgacaacttcataccctttcccaaaaaagaagacgcaaa

SEQ ID NO: 304 - DNA, 14000 bp, S. agalactiae
ggccttgttccgatgttgattccgataactcctggctcattaatagcctgttcgtaacgctctttaattatctctaacttagcatgggtattggtaaaattttgaaaatagactaagtatttattaacctcaggccactttctatgcatgaaatcaatttctttatagaattgttcacgaataggagcttctggagcaactatagcatcccctgaaccagaaactgtgcaaaaagtgcaccctcctctagcaactgttccgtctctgttaggacagtcaaaaccagcatctataggtaatttaaatattttttctccaaagagttctcgataataatcattaatcgcacgataacgttttttcataggataattgtatcacaattttaactaaaataacctcactactacaataaaactaaaaaagattggaacgtcagttagtcccaatcttttatttacttcactttctttaaccaatccttggctaaaaagatatacgcagttagattcaaaataccataagcaagtataaaaccagctaaaacatctgtcggaaaatgaacccctaggtaaatacgagataacccaattaaaaaaatgagcaaacccaaagtaccttggcacaacagtttccatatactcttaggcatatagtactgcaataaaataataatactcccaaatatcataaatgttcccatcgagtgcccactgggaaacgaatagccacctgcaaatactaaatgggttaaagttggtcttactctttgaaaaataagttttaaagaaagtatacatataccagagataatagcatttactgcgataaatctagcttgaggataccacttcttaaggtaacagaaagtgacgctcataatcgcaatagctatctggcttacagtattaccaatcacagtgattaacttgaaaaatcttgtagaaagatttggcaactgtcctctaacactttcttgaatagtttggtcaaatgaaattacagtgtcgggccaatatttgatgaccaatcctaaactgaaaaataagataatagcaataaatgcttgaataagtttactattttgacgagataacattagtctttttatatctttctaatattggcaaacaagccacgtaagttagatagaaaacaatcgaaattaaaattccctcaacgatattaaatggaataaccattgttaaaaggtaattgcctacaccaataaatgttctgatatcaaagttagcaaatatagcatacaaaggaatcgcaaagacatagttgagagctaccatagatacggtcaagctaactgtaccaaatagactagctttaataaaatcttttgcactctctctatttttccagaaaatagcgaaacttgctaaaaataaagctagagcaaccatattcatcggtaaaccaataaacgtttctggaccacgattagcaagtataacttttaaaagtgatcttaataagagtacaccataacttgatttcaaatcaaataaaataaaagcaactaacatcggaaggattgaaaaatcaacctttaaaaattctgctcctggtattaatggaaatgaaaccatcatcaatacaaaagataaggcagaaagaatggcgattgtcaccattttacgtgtatttgtcataaaaaaattcctccaatttaaataaattgaaagaagctccaaaggtaagcgtatgtacgcgaaaaaacctttgtcttctcccatccagactttactgtcggttgtggaatctcaccacatcagctttcgctcgcggactgatgcttcacaactgacaaataagttggaagcgattaccgccggtcgggaattacaccctgccctgaagacacctatagcataacaaaaaaaacttgcaattgcaagttttttaattactaattagtagtagtgattaaaaatcatattaataccaaattactatactgtatcgtttctttcagatttgctatttttagtttttcttaaaaagataaacaaaattcccaaaataatacaaccaagaattgtcagtcctccaccaataatcattcctgttttaggaagaaatgattgtggaaaaagcggttgtgatggtttaggatttgttggtggaggagtttctttttcgttttctacctctacttcctgtgttttattagcaactacagcaactacagcatccttcatagatatacggtaaccagttagtgcttttgcttctcgaaaaatatacttaccaggtaataaaccttcaacctcaatttctcccttatcatcagttactaatgaagtaatcccatcttgatcggtcgtaaatcgtccatttttaaagcgaactggctgattctggttatcgtataatacaaatattactccggatagccttttctttatctttccttcttttgtatatttaataagttttaatcggcctgtttcaacttttcgcttaggatttatctgtaattgatttgataacttatcatctggtaattcaatataaaaaggtactattgttgaaacgctttgatcagctttataagcacgaccaaagtacgaaccatttgggagtgctatctttgtctgaccattagtatcagtaggagaagtcaagatactcttatacttctggttcaattcgctatctgtcatttggctcaataaatcaacttttaagttgtcagtcacagtccataaacgataagaaatcccctcctctgtagtatttggctgaagtcctatctgtgtgattgttagttgattaggggtatcagcatttacactggctaccgaaaaaaacgctaattgtaccaatcctaaaaagcaacatagtagaagtcctaaactttttctaatctttttcatttttgatttccctttctctttctctctttaaattttcgttttaaatataatagtaaagcgactaatataagaataactaggattgataagaggaaataaagtttatagtgtgtttgcaattctttcattaaatagttcttttctttaacaggaggtacatacttgattcgatgccctctaactagtaaacgatgtgaattaatcgaataaggtgtacatgttagcaaagtcgcataatccttacctttaacaaccaataatttagaaaaattatctggctttacaacacttatttgatcaaccttataggctaaaacttctttgatattatgaatataaaaaatttttccttttttaagtttatctaaatctgtaaataacttagctttaggtaagccgcgatgagctgtgataacagtatgtgaactttttccaccaattggcaaggaggttccttcaaggtgtcctgctcctttttcaagaacactactggtagtccccgcatagataggtaatttttgcttgatagacggtatatcaatatatccaatcatttcagcaatctcaagcatgtgggcgtattcagcaataccttttttttctttttcagtatagggatctgataggcggcttgggtccagtgttctattataagcttttgctaactcaaatcgtctattaatctctttagtatttaatttttgggtttgattatcaaagttagttacttgattattagctttaatattatagtaccaatttgaaataaaaggatatgaggttatcaaaagaccaactaagaacaatagtatcaagcctacattcatccatcgatttaaaacgaccgatttcttaaggtttttctgaaattttcctcccattatgattcaattccttttctaacacttgctaaacgatttttttgacgttgacgttttattaaccaaagtaaccaagcaataataactaaagatatatagaatagatatctataaatcgtgtttaaatgaccgtcttttattaatttttcatcaataggacctttataagggatacgatgtccccttactaaaagtctgtgtgtattgatcataatcggggtgcaagtcaataaggttgcataatcatgtccaggaacaaccaacaaatctgaaaagttatcgggtgtaacgacttttatctgatctacttgatatgctatcgtttcttttatgttttgaatataaaacttatctcctttttttaactttttaaggttagaaaagagttctttatctggaattcctgaatgcgctgttataacagtatgtgtactattgcccccaattggaagagaggtaccttctaaatgccctgctcctttagatagaacttcttgacttgaacctgcaaatatagggagtttttgacctatcttaggaactgaaattgttccgattttttcacttacctctaacatacgggcgtactctgctacccccttttgaattcgttttttctcataaggatcttcaagatggacattatttaaagaatcattataagcttgtgctagagccatacgtcgattgatttctttctgactaagttttttagcagctctctcaaaatcctgtgtttgattattagattctatcgtatagtaaaaacgtgataccactggatacaataaaatagatagacctattagaaaaagaatgataaaaggaagatttgacttcttctttttttttgtttttttgatgatttttttagtcttcacgtcatctcctagataatggctcttgcttatgatctaagagtacttctactgaaatacccttagatcataagcacagctttaactgcgcttatacatcatcaaagactagccttaagcttcctttgattggcgtcttttcatgataactactgctccaagcataatgcttaaaccaataattgtgaaaagaattgtaccaataccacctgtttgtgggattgttacctttttattttctacacgtgtcgcatctttttggttgctgttagcaacgtagtcaatgttaccacctgttatgtatgacccttgattaactacaaacttaatattacctgccaacttagcaaatcctgctggagcaagtgtttcttcaaggttgtaagtaccgtctgcaagacctgtaacttcaaattgaccttgatcgtttgaagtgtaggtaatggctctagccttatctgttatccactcataagctgtacgagcctcaatgaaggctgcatcgtaatctgcttgtttagttttgataagttcttttgcagtaattcctttttcacctttttggtctgttgcagacaacttgttataagcagcgatagcttcatctaaagctattttcttagcagctaaagttttttgaccttctgattgatctgctttaagagcaaggtatttacctgctgagtttttcacaacgaattgtgcaccagccaaacggtcaccttgttcattagttttgacaaatttcttaccatgagtttcaacttttggttcagttgggttcaatggtgttgggttatcagaatctttggtattggtaatggttactttaccattttctagatttattgcacttccgtaaccagaaacacgttctgagatcatgtatgatttgttttctagaccagtgaatttacccgagaagttaccagatacttcaaatttgataccatttccaaggtcgattgtacctttagatgtttttgtcaatgatactgaagcaacagttttatctttatctttcaatgtgtaaacaacgtttacaccatcaggtgcaattccgtcagaccaagttttagcaactgttacttcaccctttgaaggtgtaacaggaagttcagtcaagtctttacctggtttgttaccatacgacaatttgatatcattggattctggattatcaataattgcttgaccattaacagtagcactataagtcaatgtaaattcaatatcagctgttttagctgctttttccaatttgcccaatccatcagctgtgaattttaatgtgaaaccacgggcatcaatgctaagttcatagtctgtatccttagcaaaagtttctgtagttcctgaagctttaaggctaacagttgaacccattgtcaaaccatttgacattatatctgtccaaaccaagttttcgtatttagaacctttgtgaatttttgttttaacttcataaggaacaactttaccgatttcagcagtagcagttgctttgtcacgtgcataattaccataatttgcgccagctgtcaaaagtctattaacatctgtcaatgctgtcaaatcgtttgttttagcaaagtttttatcaatttctggtttttcttcagtgttctttggataaacatgggcatcagcaacaacaccatcttcatttaccaatggaagagtgatgttaactggaaccgcttttgaagcagccaggagggaaccattattgttgtaagtagattttgatttaacttcaacaattttaaactcgcctttcaatcctttggtgttgaaaacaagtccagtatctccctctggtgtcaatccagacacggcctcatcaatatttactgttatttcaggagtaccatctttattaattaaggctggtgttaatttgttaccttcttttgccttaacatattgcactttaccacttttatcttctttcaaagctaaagcaaagaacgcaccttcgatttctttagatccctcgccaaagtaaccagcaaggtcagaaatagctccacctttgtagtcttttccgttaagacctgtagttcctgggaagttacttttgttaagatttgattcggtttgcaaaatcttgtgcaaagtcactgtattagttgttgcttcatccgcaaacgctggtgcaactgagagcaatgacgttaaagtcagtaacaatgccgagaacattgcaaaatatttgttgattcttttcatttctatctccttcttattttagttaatcaacatgattaataatatgcggattttaatacaccgcagcaccactcccttcaagtcatggaattttagttaattaattaagaatactaaagcgcataatttttaatcttttttgatggacatatcactagatttcttataccttttccaaatataaattccacctgcaatagacatcatagctccacctattaaaatgaaagatagaattcctttcccacctgtcataggaataattccttttggtggaatatgcgtgttggtaattaaatgcttgtcaccttcctcatgatattcagaaatctgtttattaacagctattatattttttatcgatcctttaaccacttcaaaagttaaaattggtttattagtaattttttgataatcctccggcgaaactgcttctattaactgatatttgccatctttcaaatctttgtaagaaattttgccgttttctcccgtcactacttttgaattattattttttattggtaaataaagtttataatcttcattaaattcttgaagttcaaacgtagctcctttgagaagcaacttattattatctttatcaacttttataaattcaatttcacctaacttcttctcgtttttaatcgttattgtaggatattctctcacatcacgaattttagggattggaaaatctctaagtgtattaggatcctctgacttaggattcaatgttgttctaccattagtgtcatagaatttgttacttataaaactgtcatctagtttcacatcatatgtgagtgttactttttgaccttctcctaaattcaaacctctaacatagagtttatttccgatgtattctaatttaacccccttaagtattccaccatcattattaggcccaccagttgcaataccatccttcattacacttccatcatttccctgtaaagtataatcacttggctgtaatgtttgtccattaccaagctgtaaattgattttatcacccataggatcttcgatagttccattaacaattgagttttcttttgttaaaatcgtttcaaattgttgctgaattttagataaaatttcattgttagatgtatcggctgaagttacgataggggtgtagtactcaggtttggaagagaacgacctcattagttctgtgatttctccatctgaaagtttaaaagcttcctctttcaatttttgaaaagtaccatcttgatttttcttatactcctcattataaacttgtctaaaaccagatatatcgataccaaaattaaaaatgtcataatttttctgttttaaactatttatataaagtttggttggtgttccatgttctttcactggtccatttcgataaattgtacctttagggtaattaagatttaaatctaaataatgaagtttttgtaagtttccagagattatctgtgtttgataactatctaagggaaacaaaaagtaactctccccatttccttttatatcctcgggcttatcagtaagtagaaaattacttttatttagatatccattttttttcatttgttcaaattggctttcatatgatgcacccagtttaaaattattaatagcatatgatctcgtaggaacaccatcagttacatgaacaataattttttgactatttcgatttacttgactcaaaatatcatctgcctccatgaaggctttcatagtaaatgtttctcctactttactaagatagtactccttttgttgctctggagttaatccattggtagtagatccccacttagctttaggagcttctgtcggaatcctttttataatctcttcagcattatttgttaattgtttatgactataattctctgtctgaattgtgaacttagtttgaaggccataatatttatcatcttctttaaatccttttacgacatctacactcctaccatcaaaaatatctgaaccataggtaactaatgcaaccctattatcactgtttgctcctaaaatatcttttactgcggtcccaagagcttcggcagctttcttggctttattatgcctttgaaaatttgggccatcgttattcattgagttagaattatcgagtacgaagacaacatctaacggcttttgtttgtccactggttttactatggtttttccactgacagttaactcaattttatatttattatgagctaaatcacctacttctgaaatacgtttagataatgttccctctggaatttctcttatatgctcaccttcacttgaatatgggttaactgcttttgcctctgactttccatttggaactgaacctttaacatgctcaagtttataagattcctttgtatcttcataaattcctgtggggggatactgcttatctagttcttcctgattttgtccaattgtggaatttttatcaccactattttgtatcgtagtttttccattactctcaaccttaacttgccaagtctggttagtctttttataaccttcgggcgctgtttcttctgataaagtataatctccaggtatgagattatcaaaagtagcttcacctgttagctcagcagttactttttctattttactttctggatgagcagtagtttttaaaacaaaggtagcttttgaaagtggtttgttctggtcatctgtctttttaacaactaactttcctttagcaccattttccggtacggtactttcccctaaaacattggtattaagcggtatttgcgacaaacaaaaaagacttaacgtcaatattttagaaaatttttggtattttctcattttacaactcctattgtgccgaaatgtcgtttctaaatctaagatcagatacagaatatcctagaatatacaaactatcacttattatgatatcaataatttcttattataaggtatggaattttaatgttttttcccaatttttgaataatttttctttttatttgataatcttattttttattatcttagaaatatttcaatgagcttaagtagttgatttttctttttttatgttttaaaatattgcttaaaaataatgtttgagagagtttactgaattgattgaaaattatttagaaaaagacatccttaatcaaataaaacttctaactttatgctatgattactacccttccattactctagacaaatcatgtcatcaacttggtttatctgaactacttattaggaaatattgtcatgatttaacaactttatttaacagtcaactctctctgaatatcgaaaagagtacaatagtctaccaatctaatggtgtaactagagaacaagctttcaaatatatttatcatcaatcacacgttttacaacttttaaaatttttgatcacgaatgattcaggcaggttacctttaacttactttagtgaaaaatttggactatcttgtgcaactgcttatcgcatacgaaaacatattagtccattactagaaaaacttggatttcagattgtcaaaaatactattaccggtgacgagtatcgaattcgctatttaatcgcatttttaaatgctcaatttggtatagaagtttatcccatgtctaagatggataaattgctcatcaaacgattgttattagaacactcaactacttttactgcttctcattacttcccaaatacatttattttctttgatacattgttgtctctatcatggaaacgtattaattataatgtagttgtcccttactcatcccttttcactgaactacaaaatatatttatctatgatacattacaatattgtgtcaaaaatgttattatagattcctttaaaattaatttaaaaaaagacgatatagactatatttttcttgcttaccttacttcccataactctttttctaatccaaattggactgagaagcgtatcgataatgtaatagctattttcgaaaattatcccaaattccaaaaattattacagccactcaaagatgctcttcccttatctggctcctatcatgatgagttggtaaaagttgctatctttttttccgaacatttattttaggattaaatcaattaatccctgaaacaatttcatttccttcatggaactatcatagacatgataaattaactactattctccgaccgataattacaaattggttaagtaaaattggagaatacacgtttaaagaacaacattttcttctcctttgtactcatctagaaagaatcatcaaaaatcatattcctccgatacagatagccgtactaactacagactttattaataaccaaattttaacagaatgcttattacagagattttcttctaaaaagattcatttccacccttactatttattaactgatgatctttccaatattactaatcttaatccagacattattattaccaataaaaagctttctccctttatcaaacatgagatttcttcagagagtttaattacatatattgatctgattaatacttcagaccaaatcaatcaaatccaaaaaattatttcatcaatacaggaagaaaaatattgcaaactttttgcaaaaactaatgaaataactaatcgtagctcctataactcttaaaaattaacattaaaaagctagagcattgtgtaatgctctagctttttaatgttaatttttttgaataatataatccaacttttcaactgttttttcccatgtgaaatgttctttaattcttttagcaatattctgttgtagtttctctcttaatgccttatcttttactaataaatcaagagattcatggagtgactgagtattttcttccatgatgattcctaactcagggctatcaataacttcaactgttccaccgcgatctgttgcaataatagcacttgaaagtagaccagcttctaaaatagaggttggtaatccctctggatacattgaagggtaaacaaagatatcagtctgtgccattaaagacatagtctgttcaaagtttaatttccccaaaaagttaatctgtttggactgatatttctctttcaaatgtgctaattcaggtccgtctcctgcaatctgtaaataaacattttcagagtactgtgacatcgaaaatgcttctaagagcaattcaatgcctttttctttaataattctaccagcataagtgatgaaaatatcatcagcagatttttcaaggtaagccgtaccagcaaaatcagagcctagactttcagataccgaattataaataactcctttagcttctatattaaaatgttttaaccattcaacgcttctcttggataccgcataaaaatctggacgataatgcttaacacgcgctgtgagaagatgttcatagatagctccaaagaaatctaaaaaacgattattgacagaaaaatgacttgacccatggtctaaaacaatactaggtaaatggtgattctttgcaaaagatagcccttctagcgttgttaactgaaaacgtgtattacaaatcacaaaatcaatattttcatctgaaacatatttcatcagcgtgttgtattctcgatttttgttaataataggatagcgctgcttgacaatatttttggtcggtaaacggtaaatttttctacccttgtcttcatctataatcggtaaatcaccatgattagttgttacaataacaacacggtagccacgcttaaccaaatctgctgtcattttatctgtataacgttcaatacctccgaggaagggtagataatatcctgagaaaacagcaactgtttttaccttattttccatatttatccactttcatcaataagccatcttttaagcctttaatcatagcaactatttttttgctcttttgctcttctgctaccaacactcgaacaaattcatttcgcataaatactaaatatttgtatcgcttcttcttaccatatttttttataatatagatcgcattgcgtatcatgtaatattttcgaaatggtgaatgattcaatacatgaaaaacatggccaaattttttaactcgtgaagagtgtccaatttcgtgtaacagaccaataaaattaacctgataagtcttatatcccatctctgacagacgataattcatttcagagtcaacaaaatcaataaacatctcttctgcaaagccagatgtttcttcgaaaacgctcgttttcattaaagcagccgaagtaatacactcttcaatttctttatagtcaaattcttgcatcactaaattttcacggttcatatcttgatacaaacaagataacataccgaccttaggtaaatgaaggtaattttcataattatctatcaaatcacctaggacaaccgaatcttgatctaaagtcaagaaccaatcaaattcttgtgctactgcaaattgaccgatacagttcaaagcatatgcaatccctttattttctgttaaataatcaacagttaggtgcccctcttcattataatcggctactaattgagaaatttcttccttatttttcgagccattatctacgatatagatgtggcttacttgaggataaattgctcgaatgttctgatctaagcgttcaatattggggttaaaggtgacaatacccgctaaatatttcatgttctatgctcttttctaaaatctctaaataactgaatgactggtgctttggttataaaaacgataccgacatagatagttactgctactaaactttgaatgacataatttaccaatgatactgacatttgagtattgatataatagagtacagctccactaagagtagcagcaattaaatagcgcagcattcctcttgttaattctttaaaagtaaatacatctcttaaagagatagcttgatatagggagacaataaattcagtaataactgtagagataatagctcccatagcacctaaaattggtattaaaagtatattaagcacaacatttgccacaagtccaataactgcagacattgtgtaagcttttgtacgtcttgaagccagtagatactgtgtccctaaagcgttaccataagaaatgcaaatgatcatcaaa

SEQ ID NO: 305 - DNA, 14000 bp, S. agalactiae
ggccttgttccgatgttgattccgataactcctggctcattaatagcctgttcgtaacgctctttaattatctctaacttagcatgggtattggtaaaattttgaaaatagactaagtatttattaacctcaggccactttctatgcatgaaatcaatttctttatagaattgttcacgaataggagcttctggagcaactatagcatcccctgaaccagaaactgtgcaaaaagtgcaccctcctctagcaactgttccgtctctgttaggacagtcaaaaccagcatctataggtaatttaaatattttttctccaaagagttctcgataataatcattaatcgcacgataacgttttttcataggataattgtatcacaattttaactaaaataacctcactactacaataaaactaaaaaagattggaacgtcagttagtcccaatcttttatttacttcactttctttaaccaatccttggctaaaaagatatacgcagttagattcaaaataccataagcaagtataaaaccagctaaaacatctgtcggaaaatgaacccctaggtaaatacgagataacccaattaaaaaaatgagcaaacccaaagtaccttggcacaacagtttccatatactcttaggcatatagtactgcaataaaataataatactcccaaatatcataaatgttcccatcgagtgcccactgggaaacgaatagccacctgcaaatactaaatgggttaaagttggtcttactctttgaaaaataagttttaaagaaagtatacatataccagagataatagcatttactgcgataaatctagcttgaggataccacttcttaaggtaacagaaagtgacgctcataatcgcaatagctatctggcttacagtattaccaatcacagtgattaacttgaaaaatcttgtagaaagatttggcaactgtcctctaacactttcttgaatagtttggtcaaatgaaattacagtgtcgggccaatatttgatgaccaatcctaaactgaaaaataagataatagcaataaatgcttgaataagtttactattttgacgagataacattagtctttttatatctttctaatattggcaaacaagccacgtaagttagatagaaaacaatcgaaattaaaattccctcaacgatattaaatggaataaccattgttaaaaggtaattgcctacaccaataaatgttctgatatcaaagttagcaaatatagcatacaaaggaatcgcaaagacatagttgagagctaccatagatacggtcaagctaactgtaccaaatagactagctttaataaaatcttttgcactctctctatttttccagaaaatagcgaaacttgctaaaaataaagctagagcaaccatattcatcggtaaaccaataaacgtttctggaccacgattagcaagtataacttttaaaagtgatcttaataagagtacaccataacttgatttcaaatcaaataaaataaaagcaactaacatcggaaggattgaaaaatcaacctttaaaaattctgctcctggtattaatggaaatgaaaccatcatcaatacaaaagataaggcagaaagaatggcgattgtcaccattttacgtgtatttgtcataaaaaaattcctccaatttaaataaattgaaagaagctccaaaggtaagcgtatgtacgcgaaaaaacctttgtcttctcccatccagactttactgtcggttgtggaatctcaccacatcagctttcgctcgcggactgatgcttcacaactgacaaataagttggaagcgattaccgccggtcgggaattacaccctgccctgaagacacctatagcataacaaaaaaaacttgcaattgcaagttttttaattactaattagtagtagtgattaaaaatcatattaataccaaattactatactgtatcgtttctttcagatttgctatttttagtttttcttaaaaagataaacaaaattcccaaaataatacaaccaagaattgtcagtcctccaccaataatcattcctgttttaggaagaaatgattgtggaaaaagcggttgtgatggtttaggatttgttggtggaggagtttctttttcgttttctacctctacttcctgtgttttattagcaactacagcaactacagcatccttcatagatatacggtaaccagttagtgcttttgcttctcgaaaaatatacttaccaggtaataaaccttcaacctcaatttctcccttatcatcagttactaatgaagtaatcccatcttgatcggtcgtaaatcgtccatttttaaagcgaactggctgattctggttatcgtataatacaaatattactccggatagccttttctttatctttccttcttttgtatatttaataagttttaatcggcctgtttcaacttttcgcttaggatttatctgtaattgatttgataacttatcatctggtaattcaatataaaaaggtactattgttgaaacgctttgatcagctttataagcacgaccaaagtacgaaccatttgggagtgctatctttgtctgaccattagtatcagtaggagaagtcaagatactcttatacttctggttcaattcgctatctgtcatttggctcaataaatcaacttttaagttgtcagtcacagtccataaacgataagaaatcccctcctctgtagtatttggctgaagtcctatctgtgtgattgttagttgattaggggtatcagcatttacactggctaccgaaaaaaacgctaattgtaccaatcctaaaaagcaacatagtagaagtcctaaactttttctaatctttttcatttttgatttccctttctctttctctctttaaattttcgttttaaatataatagtaaagcgactaatataagaataactaggattgataagaggaaataaagtttatagtgtgtttgcaattctttcattaaatagttcttttctttaacaggaggtacatacttgattcgatgccctctaactagtaaacgatgtgaattaatcgaataaggtgtacatgttagcaaagtcgcataatccttacctttaacaaccaataatttagaaaaattatctggctttacaacacttatttgatcaaccttataggctaaaacttctttgatattatgaatataaaaaatttttccttttttaagtttatctaaatctgtaaataacttagctttaggtaagccgcgatgagctgtgataacagtatgtgaactttttccaccaattggcaaggaggttccttcaaggtgtcctgctcctttttcaagaacactactggtagtccccgcatagataggtaatttttgcttgatagacggtatatcaatatatccaatcatttcagcaatctcaagcatgtgggcgtattcagcaataccttttttttctttttcagtatagggatctgataggcggcttgggtccagtgttctattataagcttttgctaactcaaatcgtctattaatctctttagtatttaatttttgggtttgattatcaaagttagttacttgattattagctttaatattatagtaccaatttgaaataaaaggatatgaggttatcaaaagaccaactaagaacaatagtatcaagcctacattcatccatcgatttaaaacgaccgatttcttaaggtttttctgaaattttcctcccattatgattcaattccttttctaacacttgctaaacgatttttttgacgttgacgttttattaaccaaagtaaccaagcaataataactaaagatatatagaatagatatctataaatcgtgtttaaatgaccgtcttttattaatttttcatcaataggacctttataagggatacgatgtccccttactaaaagtctgtgtgtattgatcataatcggggtgcaagtcaataaggttgcataatcatgtccaggaacaaccaacaaatctgaaaagttatcgggtgtaacgacttttatctgatctacttgatatgctatcgtttcttttatgttttgaatataaaacttatctcctttttttaactttttaaggttagaaaagagttctttatctggaattcctgaatgcgctgttataacagtatgtgtactattgcccccaattggaagagaggtaccttctaaatgccctgctcctttagatagaacttcttgacttgaacctgcaaatatagggagtttttgacctatcttaggaactgaaattgttccgattttttcacttacctctaacatacgggcgtactctgctacccccttttgaattcgttttttctcataaggatcttcaagatggacattatttaaagaatcattataagcttgtgctagagccatacgtcgattgatttctttctgactaagttttttagcagctctctcaaaatcctgtgtttgattattagattctatcgtatagtaaaaacgtgataccactggatacaataaaatagatagacctattagaaaaagaatgataaaaggaagatttgacttcttctttttttttgtttttttgatgatttttttagtcttcacgtcatctcctagataatggctcttgcttatgatctaagagtacttctactgaaatacccttagatcataagcacagctttaactgcgcttatacatcatcaaagactagccttaagcttcctttgattggcgtcttttcatgataactactgctccaagcataatgcttaaaccaataattgtgaaaagaattgtaccaataccacctgtttgtgggattgttacctttttattttctacacgtgtcgcatctttttggttgctgttagcaacgtagtcaatgttaccacctgttatgtatgacccttgattaactacaaacttaatattacctgccaacttagcaaatcctgctggagcaagtgtttcttcaaggttgtaagtaccgtctgcaagacctgtaacttcaaattgaccttgatcgtttgaagtgtaggtaatggctctagccttatctgttatccactcataagctgtacgagcctcaatgaaggctgcatcgtaatctgcttgtttagttttgataagttcttttgcagtaattcctttttcacctttttggtctgttgcagacaacttgttataagcagcgatagcttcatctaaagctattttcttagcagctaaagttttttgaccttctgattgatctgctttaagagcaaggtatttacctgctgagtttttcacaacgaattgtgcaccagccaaacggtcaccttgttcattagttttgacaaatttcttaccatgagtttcaacttttggttcagttgggttcaatggtgttgggttatcagaatctttggtattggtaatggttactttaccattttctagatttattgcacttccgtaaccagaaacacgttctgagatcatgtatgatttgttttctagaccagtgaatttacccgagaagttaccagatacttcaaatttgataccatttccaaggtcgattgtacctttagatgtttttgtcaatgatactgaagcaacagttttatctttatctttcaatgtgtaaacaacgtttacaccatcaggtgcaattccgtcagaccaagttttagcaactgttacttcaccctttgaaggtgtaacaggaagttcagtcaagtctttacctggtttgttaccatacgacaatttgatatcattggattctggattatcaataattgcttgaccattaacagtagcactataagtcaatgtaaattcaatatcagctgttttagctgctttttccaatttgcccaatccatcagctgtgaattttaatgtgaaaccacgggcatcaatgctaagttcatagtctgtatccttagcaaaagtttctgtagttcctgaagctttaaggctaacagttgaacccattgtcaaaccatttgacattatatctgtccaaaccaagttttcgtatttagaacctttgtgaatttttgttttaacttcataaggaacaactttaccgatttcagcagtagcagttgctttgtcacgtgcataattaccataatttgcgccagctgtcaaaagtctattaacatctgtcaatgctgtcaaatcgtttgttttagcaaagtttttatcaatttctggtttttcttcagtgttctttggataaacatgggcatcagcaacaacaccatcttcatttaccaatggaagagtgatgttaactggaaccgcttttgaagcagccaggagggaaccattattgttgtaagtagattttgatttaacttcaacaattttaaactcgcctttcaatcctttggtgttgaaaacaagtccagtatctccctctggtgtcaatccagacacggcctcatcaatatttactgttatttcaggagtaccatctttattaattaaggctggtgttaatttgttaccttcttttgccttaacatattgcactttaccacttttatcttctttcaaagctaaagcaaagaacgcaccttcgatttctttagatccctcgccaaagtaaccagcaaggtcagaaatagctccacctttgtagtcttttccgttaagacctgtagttcctgggaagttacttttgttaagatttgattcggtttgcaaaatcttgtgcaaagtcactgtattagttgttgcttcatccgcaaacgctggtgcaactgagagcaatgacgttaaagtcagtaacaatgccgagaacattgcaaaatatttgttgattcttttcatttctatctccttcttattttagttaatcaacatgattaataatatgcggattttaatacaccgcagcaccactcccttcaagtcatggaattttagttaattaattaagaatactaaagcgcataatttttaatcttttttgatggacatatcactagatttcttataccttttccaaatataaattccacctgcaatagacatcatagctccacctattaaaatgaaagatagaattcctttcccacctgtcataggaataattccttttggtggaatatgcgtgttggtaattaaatgcttgtcaccttcctcatgatattcagaaatctgtttattaacagctattatattttttatcgatcctttaaccacttcaaaagttaaaattggtttattagtaattttttgataatcctccggcgaaactgcttctattaactgatatttgccatctttcaaatctttgtaagaaattttgccgttttctcccgtcactacttttgaattattattttttattggtaaataaagtttataatcttcattaaattcttgaagttcaaacgtagctcctttgagaagcaatttattattatctttatcaacttttataaattcaatttcacctaacttcttctcgtttttaatcgttattgtaggatattctctcacatcacgaattttagggattggaaaatctctaagtgtattaggatcctctgacttaggattcaatgttgttctaccattagtgtcatagaatttgttacttataaaactgtcatctagtttcacatcatatgtgagtgttactttttgaccttctcctaaattcaaacctctaacatagagtttatttccgatgtattctaatttaacccccttaagtattccaccatcattattgggcccaccagttgcaataccatccttcattacacttccatcatttccctgtaaagtataatcacttggctgtaatgtttgtccattaccaagctgtaaattgattttatcacccataggatcttcgatagttccattaacaattgagttttcttttgttaaaatcgtttcaaattgttgctgaattttagataaaatttcattgttagatgtatcggctgaagttacgataggggtgtagtactcaggtttggaagagaacgacctcattagttctgtgatttctccatctgaaagtttaaaagcttcctctttcaatttttgaaaagtaccatcttgatttttcttatactcctcattataaacttgtctaaaaccagatatatcgataccaaaattaaaaatgtcataatttttctgttttaaactatttatataaagtttggttggtgttccatgttctttcactggtccatttcgataaattgtacctttagggtaattaagatttaaatctaaataatgaagtttttgtaagtttccagagattatctgtgtttgataactatctaagggaaacaaaaagtaactctccccatttccttttatatcctcgggcttatcagtaagtagaaaattacttttatttagatatccattttttttcatttgttcaaattggctttcatatgatgcacccagtttaaaattattaatagcatatgatctcgtaggaacaccatcagttacatgaacaataattttttgactatttcgatttacttgactcaaaatatcatctgcctccatgaaggctttcatagtaaatgtttctcctactttactaagatagtactccttttgttgctctggagttaatccataggtagtagatccccacttagctttaggagcttctgtcggaatcctttttataatctcttcagcattatttgttaattgtttatgactataattctctgtctgaattgtgaacttagtttgaaggccataatatttatcatcttctttaaatccttttacgacatctacactcctaccatcaaaaatatctgaaccataggtaactaatgcaaccctattatcactgtttgctcctaaaatatcttttactgcggtcccaagagcttcggcagctttcttggctttattatgcctttgaaaatttgggccatcgttattcattgagttagaattatcgagtacgaagacaacatctaacggcttttgtttgtccactggttttactatggtttttccactgacagttaactcaattttatatttattatgagctaaatcacctacttctgaaatacgtttagataatgttccctctggaatttctcttatatgctcaccttcacttgaatatgggttaactgcttttgcctctgactttccatttggaactgaacctttaacatgctcaagtttataagattcctttgtatcttcataaattcctgtggggggatactgcttatctagttcttcctgattttgtccaattgtggaatttttatcaccactattttgtatcgtagtttttccattactctcaaccttaacttgccaagtctggttagtctttttataaccttcgggcgctgtttcttctgataaagtataatctccaggtatgagattatcaaaagtagcttcacctgttagctcagcagttactttttctattttactttctggatgagcagtagtttttaaaacaaaggtagcttttgaaagtggtttgttctggtcatctgtctttttaacaactaactttcctttagcaccattttccggtacggtactttcccctaaaacattggtattaagcggtatttgcgacaaacaaaaaagacttaacgtcaatattttagaaaatttttggtattttctcattttacaactcctattgtgccgaaatgtcgtttctaaatctaagatcagatacagaatatcctagaatatacaaactatcacttattatgatatcaataatttcttattataaggtatggaattttaatgttttttcccaatttttgaataatttttctttttatttgataatcttattttttattatcttagaaatatttcaatgagcttaagtagttgatttttctttttttatgttttaaaatattgcttaaaaataatgtttgagagagtttactgaattgattgaaaattatttagaaaaagacatccttaatcaaataaaacttctaactttatgctatgattactacccttccattactctagacaaatcatgtcatcaacttggtttatctgaactacttattaggaaatattgtcatgatttaacaactttatttaacagtcaactctctctgaatatcgaaaagagtacaatagtctaccaatctaatggtgtaactagagaacaagctttcaaatatatttatcatcaatcacacgttttacaacttttaaaatttttgatcacgaatgattcaggcaggttacctttaacttactttagtgaaaaatttggactatcttgtgcaactgcttatcgcatatgaaaacatattagtccattactagaaaaacttggatttcagattgtcaaaaatactattaccggtgacgagtatcgaattcgctatttaatcgcatttttaaatgctcaatttggtatagaagtttatcccatgtctaagatggataaattgctcatcaaacgattgttattagaacactcaactacttttactgcttctcattacttcccaaatacattgattttctttgatacattgttgtctctatcatggaaacgtattaattataatgtagttgtcccttactcatcccttttcactgaactacaaaatatatttatctatgatacattacaatattgtgtcaaaaatgttattatagattcctttaaaattaatttaaaaaaagacgatatagactatatttttcttgcttaccttacttcccataactctttttctaatccaaattggactgagaagcgtatcgataatgtaatagctattttcgaaaattatcccaaattccaaaaattattacagccactcaaagatgctcttcccttatctggctcctatcatgatgagttggtaaaagttgctatcttttttttccgaacatttattttaggattaaatcaattaatccctgaaacaatttcatttccttcatggaactatcatagacatgataaattaactactattctccgaccgataattacaaattggttaagtaaaattggagaatgcacgtttaaagaacaacattttcttctcctttgtactcatctagaaagaatcatcaaaaatcatattcctccgatacagatagccgtactaactacagactttattaataaccaaattttaacagaatgcttattacagagattttcttctaaaaagattcatttccacccttactatttattaactgatgatctttccaatattactaatcttaatccagacattattattaccaataaaaagctttctccctttatcaaacatgagatttcttcagagagtttaattacatatattgatctgattaatacttcagaccaaatcaatcaaatccaaaaaattatttcatcaatacaggaagaaaaatattgcaaactttttgcaaaaactaatgaaataactaatcgtagctcctataactcttaaaaattaacattaaaaagctagagcattgtgtaatgctctagctttttaatgttaatttttttgaataatataatccaacttttcaactgttttttcccatgtgaaatgttctttaattcttttagcaatattctgttgtagtttctctcttaatgccttatcttttactaataaatcaagagattcatggagtgactgagtattttcttccatgatgattcctaactcagggctatcaataacttcaactgttccaccgcgatctgttgcaataatagcacttgaaagtagaccagcttctaaaatagaggttggtaatccctctggatacattgaagggtaaacaaagatatcagtctgtgccattaaagacatagtctgttcaaagtttaatttccccaaaaagttaatctgtttggactgatatttctctttcaaatgtgctaattcaggtccgtctcctgcaatctgtaaataaacattttcagagtactgtgacatcgaaaatgcttctaagagcaattcaatgcctttttctttaataattctaccagcataagtgatgaaaatatcatcagcagatttttckaggtaagccgtaccagcaaaatcagagcctagactttcagataccgaattataaataactcctttagcttctatattaaaatgttttaaccattcaacgcttctcttggataccgcataaaaatctggacgataatgcttaacacgcgctgtgagaagatgttcatagatagctccaaagaaatctaaaaaacgattattgacagaaaaatgacttgacccatggtctaaaacaatactaggtaaatggtgattctttgcaaaagatagcccttctagcgttgttaactgaaaacgtgtattacaaatcacaaaatcaatattttcatctgaaacatatttcatcagcgtgttgtattctcgatttttgttaataataggatagcgctgcttgacaatatttttggtcggtaaacggtaaatttttctacccttgtcttcatctataatcggtaaatcaccatgattagttgttacaataacaacacggtagccacgcttaaccaaatctgctgtcattttatctgtataacgttcaatacctccgaggaagggtagataatatcctgagaaaacagcaactgtttttaccttattttccatatttatccactttcatcaataagccatcttttaagcctttaatcatagcaactatttttttgctcttttgctcttctgctaccaacactcgaacaaattcatttcgcataaatactaaatatttgtatcgcttcttcttaccatatttttttataatatagatcgcattgcgtatcatgtaatattttcgaaatggtgaatgattcaatacatgaaaaacatggccaaattttttaactcgtgaagagtgtccaatttcgtgtaacagaccaataaaattaacctgataagtcttatatcccatctctgacagacgataattcatttcagagtcaacaaaatcaataaacatctcttctgcaaagccagatgtttcttcgaaaacgctcgttttcattaaagcagccgaagtaatacactcttcaatttctttatagtcaaattcttgcatcactaaattttcacggttcatatcttgatacaaacaagataacataccgaccttaggtaaatgaaggtaattttcataattatctatcaaatcacctaggacaaccgaatcttgatctaaagtcaagaaccaatcaaattcttgtgctactgcaaattgaccgatacagttcaaagcatatgcaatccctttattttctgttaaataatcaacagttaggtgcccctcttcattataatcggctactaattgagaaatttcttccttatttttcgagccattatctacgatatagatgtggcttacttgaggataaattgctcgaatgttctgatctaagcgttcaatattggggttaaaggtgacaatacccgctaaatatttcatgttctatgctcttttctaaaatctctaaataactgaatgactggtgctttggttataaaaacgataccgacatagatagttactgctactaaactttgaatgacataatttaccaatgatactgacatttgagtattgatataatagagtacagctccactaagagtagcagcaattaaatagcgcagcattcctcttgttaattctttaaaagtaaatacatctcttaaagagatagcttgatatagggagacaataaattcagtaataactgtagagataatagctcccatagcacctaaaattggtattaaaagtatattaagcacaacatttgccacaagtccaataactgcagacattgtgtaagcttttgtacgtcttgaagccagtagatactgtgtccctaaagcgttaccataagaaatgcaaatgatcatcaa

SEQ ID NO: 306 - DNA, 14000 bp, S. agalactiae
ggccttgttccgatgttgatcccgataactcctggctcattaatagcctgttcgtaacgctctttaattatctctaacttagcatgggtattggtaaaattttgaaaatagactaagtatttattaacttcaggccactttctatgcatgaaatcaatttctttatagaattgttcacgaataggagcttctggagcaactatagcatcccctgaaccagaaactgtgcaaaaagtgcaccctcctctagcaactgttccgtctctgttaggacagtcaaaaccagcatctataggtaatttaaatattttttctccaaagagttctcgataataatcattaatcgcacgataacgttttttcataggataattgtatcacaattttaactaaaataacctcactactacaataaaactaaaaaagattggaacatcagttagtcccaatcttttatttacttcactttctttaaccaatccttggctaaaaagatatacgcagttagattcaaaataccataagcaagtataaaaccagctaaaacatctgtcggaaaatgaacccctaggtaaatacgagataacccaattaaaaaaatgagcaaacccaaaataccttggcacaacagtttccatatactattaggcatatagtactgcaataaaataataatactcccaaatatcataaatgttcccatcgagtgcccactgggaaacgaatagccacctgcaaatactaaatggggtaaagttggtcttactctttgaaaaataagttttaaagaaagtatacatataccagagataatagcatttactgcgataaatctagcttgaggataccacttcttaaggtaacagaaagtgacgctcataatcgcaatagctatctggcttacagtattaccaatcacagtgattaacttgaaaaatcttgtagaaagatttggcaactgtcctctaacactttcttgaatagtttggtcaaatgcaattacagtgtcgggccaatatttgatgaccaatcctaaactgaaaaataagataatagcaataaatgcttgaataagtttactattttgacgagataacattagtctttttatatctttctaatattggcaaacaagccacgtaagttagatagaaaacaatcgaaattaaaattccctcaacgatattaaatggaataaccattgttaaaaggtaattgcctacaccaataaatgttctgatatcaaagttagcaaatatagcatacaaaggaatcgcaaagacatagttgagagctaccatagatacagtcaagctaactgtaccaaatagactagctttaataaaatcttttgcactctctctatttttccagaaaatagcgaaacttgctaaaaataaagctagagcaaccatattcatcggtaaaccgataaaggtttctggaccacgattagcaagtataacttttaaaagtgatcttaataagagtacaccataacttgatttcaaatcaaataaaataaaagtaactaacatcggaaggattgaaaaatcaacctttaaaaattctgctcctggtattaatggaaatgaaaccatcatcaatacaaaagataaggcagaaagaatggcgattgtcaccattttacgtgtatttgtcataaaaaaattcctccaatttaaataaattgaaagaagctccaaaggtaagcgtaggtacgcgaaaaaaacctttgtcttctcccatccagactttactgtcggttgtggaatctcaccacatcagctttcgctcgcggactgatgcttcacaactgacaaataagttggaagcgattaccgccggtcgggaattacaccctgccctgaagacacctatagcataacaaaaaaaacttgcaattgcaagttttttaattactaattagtagtagtgattaaaaatcatattaataccaaattactatactgtatcgtttctttcagatttgctatttttagtttttcttaaaaagataaacaaaattcccaaaataatacaaccaagaattgtcagtcctccaccaataatcattcctgttttaggaagaaatgattgtggaaaaagcggttgtgatggtttaggatttgttggtggaggagtttctttttcgttttctacctctacttcctgtgttttattagcaactacagcaactacagcatccttcatagatatacggtaaccagttagtgcttttacttctcgaaaaatatacttaccaggtaataaaccttcaacctcaatttctcccttatcatcagttactaatgaagtaatcccatcttgatcggtcgtaaatcgtccatttttaaagcgaactggctgattctggttatcgtataatacaaatattactcctgatagccttttctttatctttccttcttttgtatatttaataagttttaatcggcctgtttcaacttttcgcttaggatttatctgtaattgatttgataacttatcatctggtaattcaatataaaaaggtactattgttgaaacgctttgatcagctttataagcacgaccaaagtacgaaccatttgggagtgctatctttgtctgaccattagtatcagtaggagaagtcaagatactcttatacttctggttcaattcgctatctgtcatttggctcaataaatcaacttttaagttgtcagtcacagtccataaacgataagaaatcccctcctctgtagtatttggctgaagtcctatctgtgtgattgttagttgattaggggtatcagcatttacactggctaccgaaaaaaacgctaattgtaccaatcctaaaaagcaacatagtagaagtcctaaactttttctaatctttttcatttttgatttccctttctctttctctctttaaattttcgttttaaatataatagtaaagcgactaatataagaataactaggattgataagaggaaataaagtttatagtgtgtttgcaattctttcattaaatagttcttttctttaacaggaggtacatacttgattcgatgccctctaactagtaaacgatgtgaattaatcgaataaggtgtacatgttagcaaagtcgcataatccttacctttaacaaccaataatttagaaaaattatctggctttacaacacttatttgatcaaccttataggctaaaacttctttgatattatgaatataaaaaatttttccttttttaagtttatctaaatctgtaaataacttagctttaggtaagccgcgatgagctgtgataacagtatgtgaactttttccaccaattggcaaagaagttccttcaaggtgtcctgatcctttttcaagaacactactggtagtccccgcatagataggtaatttttgcttgatagacggtatatcaatatatccaatcatttcagtaatctcaagcatatgggcgtattcagcaataccttttttttctttttcagtatagggatctgataggcggcttgggtccagtgttctattataagcttttgctaactcaaatcgtctattaatctctttagcatttaatttttgggtttgattatcaaagttagttacttgattattagctttaatattatagtaccaatttgaaataaaaggatatgaggttatcaaaagacctactaagaataataatatcaaacctatattcatccatcgatttaaaacgaccgatttcttaaggtttttctgaaattttcctcgcattatgattcaattccttttctaacacttgataaacgatttttttgacgttgacgttttattaaccaaagtaaccaagcaataataactaaagatatatagaaaagatatctataaatcgtgtttaaatgaccgtcttttattaatttttcatcaataggacctttataagggatacgatgaccccttactaaaagtctgtgtgtattgaccataatcggggtgcaagtcaataaggttgcataatcatgtccaggaacaaccaacaaatctgaaaagttatcgggtgtaacgacttttatctgatctacttgatatgctatcgtttcttttatgttttgaatataaaacttatctcctttttttaactttttaaggttagaaaagagctctttatctggaattcctgagtgcgctgttataacggtatgggtgctattgcctccaattggaagagaggtaccttctaaatgacctgctcctttagatagaacttcttgacttgaacctgcaaatatagggagtttttgacctatcttaggaactgaaattatgccgattttttcacttacctctaacatacgggcgtactctgctatccccttttgaattcgttttttctcataaggatcttcaagatggacattatttaaagaatcattatatgcttgtgctagagccatacgccgattgatttctttctgactaagttttttagcagctctctcaaaatcttgtgtttggttattagattctatcgtatagtaaaatcgtgataccactggatacaataagatagatagacctattagaaaaagaatgataaaaggcagatttgatttctttttttttgtttttttgataatttttttagtcttcacgtcatctcctaaataatggctcttgcttatgatctaagagtacttctactgaaatacccttagatcataagcacagctttaactgtgcttacacatcatcaaaagctaatcttaaacttcctctgattgacgtcttttcatgataactaccgctccaagcataatacttaatccaataattgtgaaaaaaattgtaccaataccacctgtttgtggaatagtaaccttcttattgataacttgttgtgcatctttagttttagaaccttgggtatactcaatatcttgagcagaacctttactgtatgaagtagcattaacattaaacgaaacatcacctgataatttagcataaccagttggtgcttgtgtttcttccaatgagtattgaccttcagtcaagccagtaatttcaaattgacctttatcgttagaaatcaatttaacaacattcttagcatttttatcttcaacccattcgtatgagtagttagctttaacaaaggcatcattgtaagctttttgtttttcactaacggtagccaatgctgatttaccatcttgaccttcttgtttttctttagtcaaatcattgtaagctttaacagcagcatccaatgctgatttagttgaatctacagcagctttttctgcatctgttgcaacacctgatttacgtgccaagtacttgccatctttcttaacaaggaaggtagctcctgccaagcgttcttttccatctttatttgttttcacaaatttacgtccataagtcaccacttttggttctgatgggttgattggagttggctcatttgagtctttgttgttcttgatggttacaacgccatttacaaatgagacgtattctggagcgtagccgctaacacgttcgataacgcggtaagttttagcattatccaagttttcaaaagtgtgtttgaagctagttgcagctgttgctttagctgaatcaacattcacccatttgtcaccatctttaacttgcaaggtgaagacagcatcaactgtttcatctgctttattcacttcattgccatctactgcccatgttttgttaacagtgattttcttatcaactggaataccttcttttggttcattttcaattgttgggttgttgccgtagtccaatttaacatcattggtttctagaacttcaacgacagcagaaccgttcaaagtagctgagtaagtgatcttgatttcaacatcttttgtttttgcggcttttgccactgcttcaagacctttgtcagtcaagacaaggcggaaaccttggtcatctgctacaagtttgtaatttgtagcatcaagagttgcaccatccaatgttacagcaatatcgttgttgaaagtcaaacctttggtcatgctatcggtccagattaatttcttatagtctgaacctttaaggatttttgttccaacatggtattttttaacatcaccaacagatgctgagacagtccctttgtcttttttgttgttcgcataatcaagttctttatctgcgaagttcttatctacttgtggttttgtttcagtgttctttggataaacgtgagcgtctttaacaacaccattgtcgtttaccaatggaagagtgattttaactggaactgcttttgaatcagccaagatagaaccatcgttgttgtatgtagatttttctttcaattcaacgatttggtaagttcctgttaatttagaagtgttaaatttgaaaccattgtctgttgttaaacctttaagaacagcacaacctttggcatctgttgtatccaaagtatcaacttcttcaccattttcagtgatgtatttagtaccagcttcatttttgaaagcaaagtaagcacctgcgatttctttcgcttcgcctgagccaaagtaagttttaaggtcttcgatttgtttaccaacgtagtcagtattatccttaccctttgtaccagcagtaaaaccgtcaaatgcagttcgaggcatgacaatcttgtgcaaggtcactgtgtcagtagtttttgcttcttccgcaaacactggtgcaactgagaacaatgatgttacggtcagtagcaatgccgagaagactgcaaaatatttgttgatttttttcatttctatctccttcttattttagttaatcaacatgattaataatatgcggattttaatacaccgcagcaccactcccttcaagtcatggaattttagttaattaattaagaatactaaagcgcataatttttaatcttttttgatggacatatcactagatttcttataccttttccaaatataaattccacctgcaatagacatcatagctccacctattaaaatgaaagatagaattcctttcccacctgtcttaggaataattccttttggtggaatatgcgtgttggtaattaaatgcttgtcaccttcctcatgatattcagaaatctgtttattaacagctattatattttttatcgatcctttaaccacttcaaaagttaaaattggtttattagtaattttttgataatcctccggcgaaactgcttctattaactgatatttgccatctttcaaatctttgtaagaaattttgccgttttctcccgtcactacttttgaattattattttttattggtaaataaagtttataatcttcattaaattcttgaagttcaaacgtagctcctttgaggagcaacttattattatctttatcaacttttataaattcaatttcacctaacttcttctcgtttttaatcgttattgtaggatattctctcacatcacgaattttagggattggaaaatctctaagtgtattaggatcctctgacttaggattcaatgttgttctaccattagtgtcatagaatttgttacttataaaactgtcatctagtttcacatcatatgtgagtgttactttttgaccttctcctaaattcaaacctctaacatagagtttatttccgatgtattctaatttaacccccttaagtattccaccatcattattaggcccaccagttgcaataccatccttcattacacttccatcatttccctgtaaagtataatcacttggctgtaatatttgtccattaccaagctgtaaattgattttatcacccataggatcttcgatagttccattaacaattgagttttcttttgttaaaatcgtttcaaattgttgctgaattttagataaaatttcattgttagatgtatcggctgaagttacgataggggtgtagtactcaggtttggaagagaacgacctcattagttctgtgatttctccatctgaaagtttaaaagcttcctctttcaatttttgaaaagtaccatcttgatttttcttatactcctcattataaacttgtctaaaaccagatatatcgataccaaaattaaaaatgtcataatttttctgttttaaactatttatataaagtttggttggtgttccatgttctttcactggtccatttcgataaattgtacctttagggtaattaagatttaaatctaaataatgaagtttttgtaagtttccagagattatctgtgtttgataactatctaagggaaataaaaagtaactctccccatttccttttatatcatcgggcttatcagtaagtagaaaattacttttatttagatatccattttttttcatttgttcaaattggctttcatatgatgcacccagtttaaaattattaatagcatatgatctcgtaggaacaccatcagttacatgaacaataattttttgactatttcgatttacttgactcaaaatatcatctgcctccatgaaggctttcatagtaaatgtttctcctactttactaagatagtactccttttgttgctctggagttaatccattggtagtagatccccacttagctttaggagcttctgtcggaatcctttttataatctcttcagcattatttgttaattgtttatgactataattctctgtctgaattgtgaacttagtttgaaggccataatatttatcatcttctttaaatccttttacgacatctacactcctaccatcaaaaatatctgaaccataggtaactaatgcaaccctattatcactgtttgctcctaaaatatcttttactgcggtcccaagagcttcggcagctttcttggctttattatgcctttgaaaatttgggccatcgttattcattgagttagaattatcgagtacgaagacaacatctaacggcttttgtttgtccactggttttactatggtttttccactgacagttaactcaattttatatttattatgagctaaatcacctacttctgaaatacgtttagataatgttccctctggaatttctcttatatgctcaccttcacttgaatatgggttaactgcttttgcctctgactttccatttggaactgaacctttaacatgctcaagtttataagattcctttgtatcttcataaattcctgtggggggatactgcttatctagttcttcctgattttgtccaattgtggaatttttatcaccactattttgtatcgtagtttttccattactctcaaccttaacttgccaagtctggttagtctttttataaccttcgggcgctgtttcttctgataaagtataatctccaggtatgagattatcaaaagtagcttcacctgttagctcagcagttactttttctattttactttctggatgagcagtagtttttaaaacaaaggtagcttttgaaagtggtttgttctggtcatctgtctttttaacaactaactttcctttagcaccattttccggtacggtactttcccctaaaacattggtattaagcggtatttgcgacaaacaaaaaagacttaacgtcaatattttagaaaatttttggtattttctcattttacaactcctattgtgccgaaatgtcgtttctaaatctaagatcagatacagaatatcctagaatataaaaactatcacttattatgatatcaataatttcttattataaggtatggaattttaaagttttttcccaatttttgaatgatttttctttttatttgatacattattgtctctatcatggaaacgtattaattataatgtagttgtcccttactcaccccttttcattgaactacaaaatatatttatctatgatacattacaatattgtgtcaaaaatgttattatagattcctttaaaattaatttaaaaaagacgatatagactatatttttcttgcttaccttacttcccataactctttttctaatccaaattggactgagaagcgtatcgataatgtaatagctattttcgaaaattatcccaaattccaaaaattattacagccactcaaagatgcccttcccttatctgactcctatcatgacgagttggtaaaagttgctatcattttttcccgaacatttattttaggattaaatcaattaatccctgaaacaatttcatttccttcatggaactatcatagacatgataaattaactactattctccgaccgataattacaaattggttaagtgaaattggagaatacacgtttaaggaacaacattttcttctcctttgtgctcacctagaaagaattatcaaaaatcatattcctccgatacaaatagccgtactaactacagactttattaataacaaaattttaacagaatgtttatcacagaggttttcttctaaacagattcatttccacccttactatttattaactgatgatctttccaatattactaatcttaatccagatattattattaccaacccaaagctttcttcctttataaaacatgagatttcttcagagagtttaattacatatattgatttgattcatactccagaccagatcaatcaaatccaagaaattatttcatcaatacaagaagaaaaatattgtaaactttttgcaaagaacaatgaaataactacccgtagctcctataactcttaaaaattaacattaaaaagctagagcattacacaatgctctagctttttaatgttaatttttttgaataatataatccaacttttcaactgttttttcccaggtgaaatgttctttaattcttttagcaatattctgttgtagtttctctcttaatgccttatcttttactaataaatcaagagattcatggagtgactgagtattttcttccatgatgattcctaactcagggctatcgataacttcaactgttccaccgcgatctgttgcaataatagcacttgaaagtagaccagcttctaaaatagaggttggtaatccctctggatacattgatgggtaaacaaagatatcagtctgtgccattaaagacatagtctgttcaaagtttaatttccccaaaaagttaatctgtttggactgatatttctctttcaaatgtgctaattcaggtccgtctcctgcaatctgtaaataaacattttcagagtactgtgacatcaaaaatgcttctaagagcaattcaatgcctttttctttaataattctaccagcataagtgatgaaaatatcatcagcagatttttcaaggtaagccgtgtcagcaaaatcagagcctagactttcagataccgaattataaataactcctttagcttctatattaaaatgttttaaccattcaacgcttctcttggataccgcataaaaatctggacgataatgcttaacacgcgctgtgagaagatgttcatagatagctccaaagaaatctaaaaaacgattattgacagaaaaatgacttgacccatggtctaaaacaatactaggtaaatggtgcttctttgcaaaagatagcccttctaacgttgttaactgaaaacgtgtattacaaatcacaaaatcaatattttcatctgaaacatatttcatcagcgtgttgtattctcgatttttgttaataataggatagcgctgcttgacaatatttttggtcggtaaacggtaaatttttctacccttgtcttcatctataatcggtaaatcaccatgattagttgttacaataacaacacggtagccacgcttaaccaaatctgctgtcattttatctgtataacgttcaatacctccgaggaagggtagataatatcctgagaaaacagcaactgtttttaccttattttccatatttatccactttcatcaataagccatcttttaagcctttaatcatagcaactatttttttgctcttttgctcttctgctaccaacactcgaacaaattcatttcgcataaatactaaatatttgtatcgcttcttcttaccatatttttttataatatagatcgcattgcgtatcatgtaatattttcgaaatggtgaatgattcaatacatgaaaaacatggccaaattttttaactcgtgaagagtgtccaatttcgtgtaacagaccaataaaattaacctgataagtcttatatcccatctctgacagacgataattcatttcagagtcaacaaaatcaataaacatctcttctgcaaagccagatgtttcttcgaaaacgctcgttttcattaaagcagccgaagtaatacactcttcaatttctttatagtcaaattcttgcatcactaaattttcacggttcatatcttgatacaaacaagataacataccgaccttaggtaaatgaaggtaattttcataattatctatcaaatcacctaggacaaccgaatcttgatctaaagtcaagaaccaatcaaattcttgtgctactgcaaattgaccgatacagttcaaagcatatgcaatccctttattttctgttaaataatcaacagttaggtgcccctcttcattataatcggctactaattgagaaatttcttccttatttttcgagccattatctacgatatagatgtggcttacttgaggataaattgctcgaatgttctgatctaagcgttcaatattggggttaaaggtgacaatacccgctaaatatttcatgttctatgctcttttctaaaatctctaaataactgaatgactggtgctttggttataaaaacgataccgacatagatagttactgctactaaactttgaatgacataatttaccaatgatactgacatttgagtattgatataatagagtacagctccactaagagtagcagcaattaaatagcgcagcattcctcttgttaattctttaaaagtaaatacatctcttaaagagatagcttgatatagggagacaataaattcagtaataactgtagagataatagctcccatagcacctaaaattggtattaaaagtatattaagcacaacatttgccacaagtccaataactgcagacattgtgtaagcttttgtacgtcttgaagccagtagatactgtgtccctaaagcgttaccataagaaatgcaaatgatcatcaaagactcaacagccattagcggaccgacagcttcataccctttcccaaaaaagaagacagcaaatgtcgacgaaactcctaccactcccgcaatcattaacattgagatagcattgcttaaatcaacaagtttcaaaagtaaagccttagcttgcttttcttttcctgaagaaaatagactggagagccttggtaagaaaactcctccgattgctgaaacaatggtaaataaaatacgaataattttatcagattgatcaaaatatccagcactgaccacactatccattgctcccagcatactcttgttaagagagagataaatctgcatggtgatttggggtaaaaataacattaaagttggtcttagatgtattaagatatctaatctactaaatggtatcttgatgatttcatgctttaaatgatgccagactgttaaatttccgagtaatgatgcaaatgcaattaaaaacatataaagtgctaggtcatctggcgtcttcacaactaagaaggtcaaaacaactgtaataagcttaacaatggtattacgaatgacaattatcttaaagtcttcaactccaataaaataccacgaaatatcagttgcagtcgctaataaattaataccttgaattaaatagaataattgccattcgtttgtaagtaagacaaatccaaagaataataacgttgctatagatacagaggcaagttttaatacaactaattcccaaaatatcttacttctcttatacttatttgactgcacaaaagctatctcacgattaccgtacaaagatatc

SEQ ID NO: 307 - DNA, 14000 bp, S. agalactiae
ggccttgttccgatgttgatcccgataactcctggctcattaatagcctgttcgtaacgctctttaattatctctaacttagcatgggtattggtaaaattttgaaaatagactaagtatttattaacctcaggccactttctatgcatgaaatcaatttctttatagaattgttcacgaataggagcttctggagcaactatagcatcccctgaaccagaaactgtgcaaaaagtgcaccctcctctagcaactgttccatctctgttaggacagtcaaaaccagcatctataggtaatttaaatattttttctccaaagagttctcgataataatcattaatcgcacgataacgttttttcataggataattgtatcacaattttaactaaaataacctcactactacaataaaactaaaaaagattggaactaactgacgttccaatcttttatttacttcactttctttaaccaatccttggctaaaaagatatacgcagttagattcaaaataccataagcaagtataaaaccagctaaaacatctgtcggaaaatgaacccctaggtaaatacgagataacccaattaaaaaaatgagcaaacccaaaataccttggtacaacagtttccatatactcttaggcatatagtactgcaataagataataatactcccaaatatcataaatgttcccatcgagtgcccactgggaaacgaatagccacctgcaaatactaaatgggttaaagttggtcttactctttgaaaaataagttttaaagaaagtatacatataccagagataatagcatttactgcgataaatctagcttgaggataccacttcttaaggtaacagaaagtgacgctcataatcgcaatagctatctggcttacagtattaccaatcacagtgattaacttgaaaaatcttgtagaaagatttggcaactgtcctctaacactttcttgaatagtttggtcaaatgaaattacagtgtcgggccaatatttgatgaccaatcctaaactgaaaaataagataatagcaataaatgcttgaataagtttactattttgacgagataacattagtctttttatatctttctaatattggcaaacaagccacgtaagttagatagaaaacaatcgaaattaaaattccctcaacgatattaaatggaataaccattgttaaaaggtaattgcctacaccaataaatgttctgatatcaaagttagcaaatatagcatacaaaggaatcgcaaagacatagttgagagctaccatagatacggtcaagctaactgtaccaaatagactagctttaataaaatcttttgcactctctctatttttccagaaaatagcgaaacttgctaaaaataaagctagagcaaccatattcatcggtaaaccaataaacgtttctggaccacgattagcaagtataacttttaaaagtgatcttaataagagtacaccataacttgatttcaaatcaaataaaataaaagcaactaacatcggaaggattgaaaaatcaacctttaaaaattctgctcctggtattaatggaaatgaaaccatcatcaatacaaaagataaggcagaaagaatggcgattgtcaccattttacgtgtatttgtcataaaaaaattcctccaatttaaataaattgaaagaagctccaaaggtaagcgtatgtacgcgaaaaaacctttgtcttctcccatccagactttactgtcggttgtggaatctcaccacatcagctttcgctcgcggactgatgcttcacaactgacaaataagttggaagcgattaccgccggtcgggaattacaccctgccctgaagacacctatagcataacaaaaaaaacttgcaattgcaagttttttaattactaattagtagtagtgattaaaaatcatattaataccaaattactatactgtatcgtttctttcagatttgctatttttagtttttcttaaaaagataaacaaaattcccaaaataatacaaccaagaattgtcagtcctccaccaataatcattcctgttttaggaagaaatgattgtggaaaaagcggttgtgatggtttaggatttgttggtggaggagtttctttttcgttttctacctctacttcctgtgttttattagcaactacagcaactacagcatccttcatagatatacggtaaccagttagtgcttttgcttctcgaaaaatatacttaccaggtaataaaccttcaacctcaatttctcccttatcatcagttactaatgaagtaatcccatcttgatcggtcgtaaatcgtccatttttaaagcgaactggctgattctggttatcgtataatacaaatattactccggatagccttttctttatctttccttcttttgtatatttaataagttttaatcggcctgtttcaacttttcgcttaggatttatctgtaattgatttgataacttatcatctggtaattcaatataaaaaggtactattgttgaaacgctttgatcagctttataagcacgaccaaagtacgaaccatttgggagtgctatctttgtctgaccattagtatcagtaggagaagtcaagatactcttatacttctggttcaattcgctatctgtcatttggctcaataaatcaacttttaagttgtcagtcacagtccataaacgataagaaatcccctcctctgtagtatttggctgaagtcctatctgtgtgattgttagttgattaggggtatcagcatttacactggctaccgaaaaaaacgctaattgtaccaatcctaaaaagcaacatagtagaagtcctaaactttttctaatctttttcatttttgatttccctttctctttctctctttaaattttcgttttaaatataatagtaaagcgactaatataagaataactaggattgataagaggaaataaagtttatagtgtgtttgcaattctttcattaaatagttcttttctttaacaggaggtacatacttgattcgatgccctctaactagtaaacgatgtgaattaatcgaataaggtgtacatgttagcaaagtcgcataatccttacctttaacaaccaataatttagaaaaattatctggctttacaacacttatttgatcaaccttataggctaaaacttctttgatattatgaatataaaaaatttttccttttttaagtttatctaaatctgtaaataacttagctttaggtaagccgcgatgagctgtgataacagtatgtgaactttttccaccaattggcaaggaggttccttcaaggtgtcctgctcctttttcaagaacactactggtagtccccgcatagataggtaatttttgcttgatagacggtatatcaatatatccaatcatttcagcaatctcaagcatgtgggcgtattcagcaataccttttttttctttttcagtatagggatctgataggcggcttgggtccagtgttctattataagcttttgctaactcaaatcgtctattaatctctttagtatttaatttttgggtttgattatcaaagttagttacttgattattagctttaatattatagtaccaatttgaaataaaaggatatgaggttatcaaaagaccaactaagaacaatagtatcaggcctacattcatccatcgatttaaaacgaccgatttcttaaggtttttctgaaattttcctcccattatgattcaattccttttctaacacttgctaaacgatttttttgacgttgacgttttattaaccaaagtaaccaagcaataataactaaagatatatagaaaagatatctataaatcgtgtttaaatgaccttctttcattaatttttcatcaataagacctttataaggaatacgatgtccccttactaaaagtctgtgtgtattgaccataatcggggtgcaagttaataaggttgcataatcatgtccaggaacaaccaacaaatctgaaaagttatcgggtgtaacgacttttatctgatctacttgatatgctatcgtttcttttatgttttgaatataaaacttatctcctttttttaactttttaaggttagaaaagagttctttatctggaattcctgagtgcgctgttataacggtatgtgtgctatttcctccaattggaagagaagtaccttctaaatgccctgctcctttagatagaactttttgacttgaacctgcaaatatagggagtttttgacctatcttaggaactgaaattgtgccgattttttcacttacctctaacatacgggcgtactctgctacccccttttgaattcgtttcttctcataaggatcttcaagatggacattatttaaagaatcattataagcttgtgctagagtcatacgacgattgatttctttctgactaagttttttagcagctctctcaaaatcctgtgtttgattattagattctatcgtatagtaaaaacgtgataccactggatacaataaaatagatagacctattagaaaaagaatgataaaaggaagatttgacttcttctttttagtttttttgttgatatttttagtcttcacgtcatctcctaaataatggctcttgcttatgatctaagagtacttctactgaaatacccttagatcataagcacagctttaactgtgcttatacatcatcaaagactagccttaagcttcctctgattgacgttttttcatgataactactgctccaagcataatgcttaaaccaataattgtgaaaagaattgtaccaataccacctgtttgtgggatggttacttttttgttttgaacttgttgggcatctttttttacagagcctttatcatatgcgatgtcagttgtagcccctttgctatatgatgtggcagttacttcaaagtttacatcacctgacaatgtcgcataacctgctggtgcttgagtttcttccaagccataagtgcctttatccaaaccagtaatttcaaattgaccaccggcgttagagatcaatttaacaacattatcagcctttttatctgcaacccattcatatgagtagttagctttaacaaaagcgtcattgtaagctttttgtttttgatcaacagtagccaatgctgttttaccttcttggccttcttgtttttctttagtcaagtcgttataagctttaacagcttcatccaatgctagtttagcagtttttacagctgcctttgcttcagcagttgctgcacctgctttacgtgccaagtatttgccttctttcttaacgaggaaggtagctcctgccaagcgttcagtgttagcttgatttgttttcacaaatttacgtccataagtcaccacttttggttctgatgggttgattggagttggatcatttgagtttttgttgttcttgatagtcacaacaccatttttaaatgatacgtattctggagtgtagccgctaacacgttcgacaacgcggtaagttttagcattatccaaacctgtgaaagtatgttcaaagcgtgatggttttgttgcttcgtgtgaagcaacgttcacccatgtaccatccgtttgtttttcttgcaaggtaaagatagctttaactgcaacattagcatcagtaattgtaccatctactgcccagtctttaatgactttaatttcttggttagctggagtaccttcttgtggttcactttcttccgttgggttattaccatagtccaatttaacatcattggtttctggaatttcaacagtagtggagccgttcaccgtagctgagtaagtgatcttgatttcaacatctttgtcttttgcagctgctgctactgctgcaagacctgttgcattcaaggcaagacggaaaccttggtcatctgttacgagtttgtagtttaaaacaggaaaatcttcaccatccaatgttactttaacgttgttgttgaacgtcaaacctttagtcatgctatcagtccaaaccagtttcttatagtctgagcctttaagaatttttgttccaactatgtattcttttttgtcaccaactgtcgctgagacaacacctttgtcttttcggttgtcagtataatcaagatctttatctgcaaagttcttatctacttgtggttttgtttcagtattctttggataaatgtgagcatctttaacaacaccttggttgtttaccaatggcagagtgattttaactggaactgcttttgaatcagccaagatagaaccgttgttatcgtagtttgatttttctttcaattcaacgatttggtaaattccttttaacttagcagtgttaaaaacaaaaccattgtcttttgttaaccctgaaagaacagcaccaccttcagcatctttagcttccaaagtatcgacttccttaccattttcagtaatgaattttgtaccagtttcatttttgaaaacaaagaaagcacccttgatttctttagcatcggttgagccaaaataagatttaaggtcattaatttgtttaccaacataatcgctatcattcttaccttttgtaccttcagtaaagttatcaaatgcagcttgtggcatgacaatcttgtgcaaggtcacagtatcagttgttgcgtcgtccgcaaacgctggtgcaactgagaatagtgacgttaagatcaatagcagtgtcgagaacattgtaagacatttgttgatttttttcatttctatctccttcttattctagttaatcaacatagataataatatacggattataatattaccgcagcaccactcctttcgaattatatttaattaattaagaatactaaaacacatgattcttaatctttttctctagatatatcactagatttcttatatcttttccaaatataaattccacctgcaatagacatcatagatccacctattaaaatgaaagatagaattcctttcccacctgtcatcggaataattccttttggtggaatatgcgtgttggtaattaaatgcttgtcaccttcctcatgatattcagaaatctgtttattaacagctattatattttgtatcgatcctttaacaacttcaaaagttaaaattggtttattagtaattttttgataatccttcggcgaaactgcttctattaactgatatttgccatctttcaaatctttgtaagaaattttgccgttttctcccgtcactacttttgaattattattttttattggtaaataaagtttataatcttcattaaattcttgaagttcaaacgtagctcctttgagaagcaacttattattatctttatcaacttttgtaaattcaatttcacctaacttcttctcgtttttaatcgttattgtaggatattctctcacatcacgaattttagggattggaaaatctctaagtgtattaggatcctctgatttaggattcaatgttgttctaccattagtgtcatagaatttgttacttataaaactgtcatctagtttcacatcatatgtgagtgttactttttgtccctcccctaagttcaaacctctaacgtagagtttatttttgatgtattctaatttaacccctttaagtattccaccatcattattaggcccaccagttgcaatgctatctttcattatacttccatcatttccctgtaaagtataatcacttggttgcaatgtttgtccgttgccaagctgtaaattgattttgtcacccataggatcttctatagttccattaacaattgagttttcttttgttaaaatcttttcaaattgttgctgaattttagataaaatttcattgttagatgcatcggatgaagttactatcggggtataatactcaggtttagaagagaatgacttcattagttctgttatttccccatctgaaagttcaaaagcttcctctttcaatttttgaaaagtaccatcttgatttttcttataatcctcattataaacttgtctaaaaccagatatatctataccaaaattaaagatgtcataatttttctgttttaaactatttatataaagtttggttggtgttccatgttctcttactggtccatttcgataaaatgtacctttagggtaattaagatttaaatctaaataatgaagtttttgtaagtttccagagattatctgtgtttgataactatctaagggaaacaaaaagtaactctccccatttccttttatatcctcgggcttatcagtaagtagaaaattacttttatttagatatccattttttttcatttgttcaaattggctttcatatgatgcacccagtttaaaattattaatagcatatgatctcgtaggaacaccatcagttacatgaacaataattttttgactatttcgatttacttgactcaaaatatcatctgcctccatgaaggctttcatagtaaatgtttctcctactttactaagatagtactccttttgttgctctggagttaatccattggtagtagatccccacttagctttaggagcttctgtcggaatcctttttataatctcttcagcattatttgttaattgtttatgactataattctctgtctgaattgtgaacttagtttgaaggccataatatttatcatcttctttaaatccttttacgacatctacactcctaccatcaaaaatatctgaaccataggtaactaatgcaaccctattatcactgtttgctcctaaaatatcttttactgcggtcccaagagcttcggcagctttcttggctttattatgcctttgaaaatttgggccatcgttattcattgagttagaattatcgagtacgaagacaacatctaacggcttttgtttgtccactggttttactatggtttttccactgacagttaactcaattttatatttattatgagctaaatcacctacttctgaaatacgtttagataatgttccctctggaatttctcttatatgctcaccttcacttgaatatgggttaactgcttttgcctctgactttccatttggaactgaacctttaacatgctcaagtttataagattcctttgtatcttcataaattcctgtggggggatactgcttatctagttcttcctgattttgtccaattgtggaatttttatcaccactattttgtatcgtagtttttccattactctcaaccttaacttgccaagtctggttagtctttttataaccttcgggcgctgtttcttctgataaagtataatctccaggtatgagattatcaaaagtagcttcacctgttagctcagcagttactttttctattttactttctggatgagcagtagtttttaaaacaaaggtagcttttgaaagtggtttgttctggtcatctgtctttttaacaactaactttcctttagcaccattttccggtacggtactttcccctaaaacattggtattaagcggtatttgcgacaaacaaaaaagacttaacgtcaatattttagaaaatttttggtattttctcattttacaactcctattgtgccgaaatgtcgtttctaaatctaagatcagatacagaatatcctagaatatacaaactatcacttattatgatatcaataatttcttattataaggtatggaattttaatgttttttcccaatttttgaataatttttctttttatttgataatcttattttttattatcttagaaatatttcaatgagcttaagtagttgatttttctttttttatgttttaaaatattgcttaaaaataatgtttgagagagtttactgaattgattgaaaattatttagaaaaagacatccttaatcaaataaaacttctaactttatgctatgattactacccttccattactctagacaaatcatgtcatcaacttggtttatctgaactacttattaggaaatattgtcatgatttaacaactttatttaacagtcaactctctctgaatatcgaaaagagtacaatagtctaccaatctaatggtgtaactagagaacaagctttcaaatatatttatcatcaatcacacgttttacaacttttaaaatttttgatcacgaatgattcaggcaggttacctttaacttactttagtgaaaaatttggactatcttgtgcaactgcttatcgcatacgaaaacatattagtccattactagaaaaacttggatttcagattgtcaaaaatactattaccggtgacgagtatcgaattcgctatttaatcgcatttttaaatgctcaatttggtatagaagtttatcccatgtctaagatggataaattgctcatcaaacgattgttattagaacactcaactacttttactgcttctcattacttcccaaatacatttattttctttgatacattgttgtctctatcatggaaacgtattaattataatgtagttgtcccttactcatcccttttcactgaactacaaaatatatttatctatgatacattacaatattgtgtcaaaaatgttattatagattcctttaaaattaatttaaaaaaagacgatatagactatatttttcttgcttaccttacttcccataactctttttctaatccaaattggactgagaagcgtatcgataatgtaatagctattttcgaaaattatcccaaattccaaaaattattacagccactcaaagatgctcttcccttatctggctcctatcatgatgagttggtaaaagttgctatcttttttttccgaacatttattttaggattaaatcaattaatccctgaaacaatttcatttccttcatggaactatcatagacatgataaattaactactattctccgaccgataattacaaattggttaagtaaaattggagaatacacgtttaaagaacaacattttcttctcctttgtactcatctagaaagaatcatcaaaaatcatattcctccgatacagatagccgtactaactacagactttattaataaccaaattttaacagaatgcttattacagagattttcttctaaaaagattcatttccacccttactatttattaactgatgatctttccaatattactaatcttaatccagacattattattaccaataaaaagctttctccctttatcaaacatgagatttcttcagagagtttaattacatatattgatctgattaatacttcagaccaaatcaatcaaatccaaaaaattatttcatcaatacaggaagaaaaatattgcaaactttttgcaaaaactaatgaaataactaatcgtagctcctataactcttaaaaattaacattaaaaagctagagcattgtgtaatgctctagctttttaatgttaatttttttgaataatataatccaacttttcaactgttttttcccatgtgaaatgttctttaattcttttagcaatattctgttgtagtttctctcttaatgccttatcttttactaataaatcaagagattcatggagtgactgagtattttcttccatgatgattcctaactcagggctatcaataacttcaactgttccaccgcgatctgttgcaataatagcacttgaaagtagaccagcttctaaaatagaggttggtaatccctctggatacattgaagggtaaacaaagatatcagtctgtgccattaaagacatagtctgttcaaagtttaatttccccaaaaagttaatctgtttggactgatatttctctttcaaatgtgctaattcaggtccgtctcctgcaatctgtaaataaacattttcagagtactgtgacatcgaaaatgcttctaagagcaattcaatgcctttttctttaataattctaccagcataagtgatgaaaatatcatcagcagatttttcaaggtaagccgtaccagcaaaatcagagcctagactttcagataccgaattataaataactcctttagcttctatattaaaatgttttaaccattcaacgcttctcttggataccgcataaaaatctggacgataatgcttaacacgcgctgtgagaagatgttcatagatagctccaaagaaatctaaaaaacgattattgacagaaaaatgacttgacccatggtctaaaacaatactaggtaaatggtgattctttgcaaaagatagcccttctagcgttgttaactgaaaacgtgtattacaaatcacaaaatcaatattttcatctgaaacatatttcatcagcgtgttgtattctcgatttttgttaataataggatagcgctgcttgacaatatttttggtcggtaaacggtaaatttttctacccttgtcttcatctataatcggtaaatcaccatgattagttgttacaataacaacacggtagccacgcttaaccaaatctgctgtcattttatctgtataacgttcaatacctccgaggaagggtagataatatcctgagaaaacagcaactgtttttaccttattttccatatttatccactttcatcaataagccatcttttaagcctttaatcatagcaactatttttttgctcttttgctcttctgctaccaacactcgaacaaattcatttcgcataaatactaaatatttgtatcgcttcttcttaccatatttttttataatatagatcgcattgcgtatcatgtaatattttcgaaatggtgaatgattcaatacatgaaaaacatggccaaattttttaactcgtgaagagtgtccaatttcgtgtaacagaccaataaaattaacctgataagtcttatatcccatctctgacagacgataattcatttcagagtcaacaaaatcaataaacatctcttctgcaaagccagatgtttcttcgaaaacgctcgttttcattaaagcagccgaagtaatacactcttcaatttctttatagtcaaattcttgcatcactaaattttcacggttcatatcttgatacaaacaagataacataccgaccttaggtaaatgaaggtaattttcataattatctatcaaatcacctaggacaaccgaatcttgatctaaagtcaagaaccaatcaaattcttgtgctactgcaaattgaccaatacagttcaaagcatatgcaattcctttattttctgttaaataatcaacagttaggtgcccctcttcattataatcggccactaattgagaaatttcctccttatttttcgagccattatctacgatgtagatatggcttacttgaggataaattgctcgaatgttctgatctaagcgttcaatattggggttaaaggtgacaatacccgctaaatatttcatgttctatgctcttttctaaaatctctaaataactgaatgactggtgctttggttataaaaacgataccgacatagatagttactgctactaaactttgaatgacataatttaccaatgatactgacatttgagtattgatataatagagtacagctccactaagagtagcagcaattaaatagcgcagcattcctcttgttaattctttaaaagtaaatacatctcttaaagagatagcttgatatagagagacaataaattcagtaataactgtagagataatagctcccatagcacctaaaattggtattaaaagtatattaagcacaacatttgccacaagtccaataactgcagacattgtgtaagcttttgtacgtcttgaagccagtagatactgtgtccctaaagcgttaccataagaaatgcaaatgatcatcaaagactcaacagccattagcggaccgacaacttcataccctttcccaaaaaagaagacagcaaatgtcgacgaaactcctaccactcccgcaatcattaacatt

SEQ ID NO: 308 - DNA, 14000 bp, S. agalactiae
ggccttgttccgatgttgatcccgataactcctggctcattaatagcctgttcgtaacgctctttaattatctctaacttagcatgggtattggtaaaattttgaaaatagactaagtatttattaacctcaggccactttctatgcatgaaatcaatttctttatagaattgttcacgaataggagcttctggagcaactatagcatcccctgaaccagaaactgtgcaaaaagtgcaccctcctctagcaactgttccgtctctgttaggacagtcaaaaccagcatctataggtaatttaaatattttttctccaaagagttctcgataataatcattaatcgcacgataacgttttttcataggataattgtatcacaattttaactaaaataacctcactactacaataaaactaaaaaagattggaacgtcagttagtcccaatcttttatttacttcactttctttaaccaatccttggctaaaaagatatacgcagttagattcaaaataccataagcaagtataaaaccagctaaaacatctgtcggaaaatgaacccctaggtaaatacgagataacccaattaaaaaaatgagcaaacccaaagtaccttggcacaacagtttccatatactcttaggcatatagtactgcaataaaataataatactcccaaatatcataaatgttcccatcgagtgcccactgggaaacgaatagccacctgcaaatactaaatgggttaaagttggtcttactctttgaaaaataagttttaaagaaagtatacatataccagagataatagcatttactgcgataaatctagcttgaggataccacttcttaaggtaacagaaagtgacgctcataatcgcaatagctatctggcttacagtattaccaatcacagtgattaacttgaaaaatcttgtagaaagatttggcaactgtcctctaacactttcttgaatagtttggtcaaatgaaattacagtgtcgggccaatatttgatgaccaatcctaaactgaaaaataagataatagcaataaatgcttgaataagtttactattttgacgagataacattagtctttttatatctttctaatattggcaaacaagccacgtaagttagatagaaaacaatcgaaattaaaattccctcaacgatattaaatggaataaccattgttaaaaggtaattgcctacaccaataaatgttctgatatcaaagttagcaaatatagcatacaaaggaatcgcaaagacatagttgagagctaccatagatacggtcaagctaactgtaccaaatagactagctttaataaaatcttttgcactctctctatttttccagaaaatagcgaaacttgctaaaaataaagctagagcaaccatattcatcggtaaaccaataaacgtttctggaccacgattagcaagtataacttttaaaagtgatcttaataagagtacaccataacttgatttcaaatcaaataaaataaaagcaactaacatcggaaggattgaaaaatcaacctttaaaaattctgctcctggtattaatggaaatgaaaccatcatcaatacaaaagataaggcagaaagaatggcgattgtcaccattttacgtgtatttgtcataaaaaaattcctccaatttaaataaattgaaagaagctccaaaggtaagcgtatgtacgcgaaaaaacctttgtcttctcccatccagactttactgtcggttgtggaatctcaccacatcagctttcgctcgcggactgatgcttcacaactgacaaataagttggaagcgattaccgccggtcgggaattacaccctgccctgaagacacctatagcataacaaaaaaaacttgcaattgcaagttttttaattactaattagtagtagtgattaaaaatcatattaataccaaattactatactgtatcgtttctttcagatttgctatttttagtttttcttaaaaagataaacaaaattcccaaaataatacaaccaagaattgtcagtcctccgccaataatcattcctgttttaggaagaaatgattgtggaaaaagcggttgtgatggtttaggatttgttggtggaggagtttctttttcgttttctacctctacttcctgtgttttattagcaactacagcaactacagcatccttcatagatatacggtaaccagttagtgcttttgcttctcgaaaaatatacttaccaggtaataaaccttcaacctcaatttctcccttatcatcagttactaatgaagtaatcccatcttgatcggtcgtaaatcgtccatttttaaagcgaactggctgattctggttatcgtataatacaaatattactccggatagccytttctttatctttccttcttttgkatatttaataagttttaatcggcctgtttcaacttttcgcttaggatttatctgtaattgatttgataacttatcatctggtaattcaatataaaaaggtactattgttgaaacgctttgatcagctttataagcacgaccaaagtacgaaccatttgggagtgctatctttgtctgaccattagtatcagtaggagaagtcaagatactcttatacttctggttcaattcgctatctgtcatttggctcaataaatcaacttttaagttgtcagtcacagtccataaacgataagaaatcccctcctctgtagtatttggctgaagtcctatctgtgtgattgttagttgattaggggtatcagcatttacactggctaccgaaaaaaacgctaattgtaccaatcctaaaaagcaacatagtagaagtcctaaactttttctaatctttttcatttttgatttccctttctttttctctctttaaattttcgttttaaatataatagtaaagcgactaatataagaataactaggattgataagaggaaataaagtttatagtgtgtttgcaattctttcattaaatagttcttttctttaacaggaggtacatacttgattcgatgccctctaactagtaaacgatgtgaattaatcgaataaggtgtacatgttagcaaagtcgcataatccttacctttaacaaccaataatttagaaaaattatctggctttacaacacttatttgatcaaccttataggctaaaacttctttgatattatgaatataaaaaatttttccttttttaagtttatctaaatctgtaaataacttagctttaggtaagccgcgatgagctgtgataacagtatgtgaactttttccaccaattggcaaagaagttccttcaaggtgtcctgctcctttttcaagaacactactggtagtccccgcatagataggtaatttttgcttgatagacggtatatcaatatatccaatcatttcagcaatctcaagcatgtgggcgtattcagcaataccttttttttctttttcagtatagggatctgataggcggcttgggtccagtgttctattataagcttttgctaactcaaatcgtctattaatctctttagcatttaatttttgggtttgattatcaaagttagttacttgattattagctttaatattatagtaccaatttgaaataaaaggatatgaggttatcaaaagaccaactaagaacaatagtatcaagcctacattcatccatcgatttaaaacgaccgatttcttaaggtttttctgaaatcttcctcccattatgattcaattccttttctaacacttgctaaacgatttttttgacgttgacgttttattaaccaaagtaaccaagcaataataactaaagatatatagaaaagatatctataaatcgtgtttaaatgaccttctttcattaatttttcatcaataggacctttataaggaatacgatgtccccttactaaaagtctgtgtgtattgaccataatcggggtgcaagtcaataaggttgcataatcatgtccaggaacaaccaataaatctgaaaagttatcgggtgtaacgacttttatctgatctacttgatatgctatcgtttcttttatgttttgaatataaaacttatctcctttttttaactttttaaggttagaaaagagttctttatctggaattcctgaatgtgctgttataacagtatgtgtactattgcctccaattggaagagaggtgccttctaaatgccctgctcctttagatagaacttcttgacttgaacctgcaaatatagggagtttttgacctatcttaggaactgaaattgtgccgattttttcacttacctctaacatacgggcgtactctgctacccctttttgaattcgttttttctcataaggatcttcaaaatggacattatttaaagaatcattataagcttgtgctagagccatacgtcgattgatttctttctgactaagttttttagcagctctctcaaaatcctgtgtttgattattggattctatcgtatagtaaaaacgtgataccactggatacaataaaatagatagacctattagaaaaagaatgataaaaggaagatttgacttcttctttttagtttttttgatgatatttttagtcttcacgtcatctcctaaataatggctcttgcttatgatctaagagtacttctactgaaatacccttagatcataagcacagctttaactgtgcttatacatcatcaaagactagccttaagcttcctctgattgacgtcttttcatgataattaccgctccaagcataatgcttaaaccaataattgtgaaaagaattgtaccaataccacctgtttgtggaatagtcacttttttgttttctatgcgttgagcgtcttttttattgctgctagcagtgtaatcaatgttacctgagtcgtctgcttttgagctgtttccaactttgaaatcaacatcacctgctaatttagcgtaaccagctggagcttgtgtttcttcaagtttataatcaccagttgcaagaccgctaacttcaaattgaccgtcagcgtttgaagtcactttaacaacgttagcatcttctttattagttacccactcgtaagctgtacgagctacgatgaaggctgcattgtaagcgtcttgagcagttttgatttctgctttagctgtttcacctttagtacctttttgatcgtctgctgaaagtttgttgtaagctgcgattttagcgtcaagagcagttttagcatttgtgtaagctgttgtttgagctgatattgtcgcagatgatttcaatgcaaggtatttaccagctgaatctttaacaacgaactgtgcaccttgcaagcgttctgtttcagtcgaacttgttttgacgaattttttaccgtgtgtcacaacttttggttcagttggattaagtggtgttgggttgtctgaatctggagtattggtgatagctgcactaccagcaccagtagtgattgtattaccataaccagcgatacgttctgagatcatgtatgttttactatcagtcagaccactgaatttaccagcaaacgctccagtaactgtaaatttaataccattacctaagttgatttcgccatttggtgttgtttttgtcaatgaaactgaggcaacagctgttccaccatctttaagggtataaacaacattcgcattctctaaatctgaacctttgtcccaagttttgctaacagtgatttcgccatttgacggtgttactgggatttcttttacttttttacctggtttgttaccgtattgaagtttgatatcattgctttctggcttgtcatcaatagccgcaccgttaactgttgcgctatatgtcaatgtgaattcaacagcttgtgtttccgcttctttttgtagcttagtcaaacctgtatctgtgaatttcaaagtgaaaccacggtcatcacgttcaacattgtaatctgtaccttctacaaaagagcctgacgatgcttctaagttaacagtgttacccattgtcaaaccatttgacatggtatcgacccaagcaaggtttttgtatttagaccctttttggatttttgttttaacttcgtaagggatttcttgaccgatttcagcagtagcttttgctttttctgcctgatatttgtcgtagtctgccccacctgcaatagctgaattatcactgtcattcaacaatttatttgctttagcaaagtttttgtcgatttgtggtgcttcttctgtattctttggatacacttcagcgtccacgacaattccttcttcgttatacaaaggaagagtgattttcactgggacagcttttgagtcagcaagaactttgtcaccatttttataattagatttgtcaagcaactcaacgatttggtatgttccttttaagtttgcagtattaaatgtaatgccgttttcagttgtcaaacctttaaggacacctgctgcatcgatactttctacttcagtaccactttctgtgatatattttgtctgactttcattcataaccgcaaagaaagcaccggcgatttctttagaaccttgcccaaaatatcctgaaatgtcagtaagtttttgacccatatacttcgttccattcaatccatttattcctgggaaatttggcttagccaaattatcggatgtttgaacaattttgtgtaaggttactgttttagtgatatttcccatctcagcagcaaataccggagctaccgataacaacgatgttaaaattaataacaatgccgagaacattgcaaaatatttgttgattcttttcatttctatctccttcttattttagttaatcaacataaataataatatacggattataatactaccgcagcaccactcctttcaaaatatatttaattaataatgctaaagcacatagttcttaatctttctcgattgatgcatcactagatttcttatgtcttttccaaatataaattccacctgcaatagacatcatagctccacctattaaaatgaaagatagaattcctttcccacctgtcatcggaataattccttttggtggaatatgcgtgttggtaattaaatgcttgtcaccttcctcatgatattcagaaatctgtttattaacagctattatattttgtatcgatcctttaacaacttcaaaagttaaaattggtttattagtaattttttgataatccttcggcgaaactgcttctattaactgatatttgccatctttcaaatctttgtaagaaattttgccgttttctcccgtcactacttttgaattattattttttattggtaaataaagtttataatcttcattaaattcttgaagttcaaatgtagctcctttgagaagcaacttattattatctttatcaacttttgtaaattcaatttcacctaacttcttctcgtttttaatcgttattgtaggatattctctcacatcacgaattttagggattggaaaatctctaagtgtatcgggttcctctgatttaggattcaatgttgttctaccattagtgtcatagaatttgttactaataaaactgtcatctagtttcacatcatatgtgagtgttactttttgcccctcccctaagttcaaacctctaacgtagagtttatttttgatgtattctaatttaacccctttaagtatcccaccatcattattaggccctccagttgcaatgctatctttcattatacttccatcatttccctgtaaagtataatcacttggttgcaatgtttgtccgttgccaagatgtaaattgattttatcacccataggatcttctatagttccattaacaattgagttttcctttgttaaaatcttttcaaattgttgctgaattttagataaaatttcattattagatacatcagctgaagttactatcggggtataatactcaggtttagaagagaatgaattcattagttctgttatttccccatctgaaagttcaaaagcttcctccttcaatttttgaaaagtaccatcttgatttttcttataatcctcattataaacttgtctaaaaccagatatatctataccaaaattaaagatgtcataatttttctgttttaaactatttatataaagtttggttggtgttccatgttctcttactggtccatttctataaattgtacctttagggtaattaagatttaaatctaaataatgaagtttttgtaagtttccagaaattatctgtgtttgataactatctaagggaaacaaaaagtaactctccccattgcctttgatcttttctggatcatcagttataaaataattatttttgtctaaataacctttttcttttattctctcaaattgatttgcgtatgttgaaccttttacaaaactattaatggcatatgatcttgttggaacaccgtcagttagatgaacaataatctttctactcttacgctgtatactacttaacaaggtatctgcctccataaaagctttcattgtaaaggtctcacctactttacttaaatcatattccctctttttttctggagttaatcctagacttgtccccccccacttagcttctggagcttctttagggatcttttttataatatcagcagcaatattagtgaactttttatagctataatcatttgtctgaactgtgaaactagtttcaagtccataataaggatcctctttaaaaccttttataactttaactgtccttccatcaaaaatatctgaaccataagtaactaaagctgctcggttttcaacatttgctcctaaaacatcttttataattgtttctactgcttcacctgccttttttgccttgttattttttccattattcttcatagaatttgaattatcaagaacaaaaacaacatccagaggttcatctttatttatagtttttattatggatttaccgctaacagttaactcaattttatatttattatgatccaaatcatttacttctgaaatacgtttagataatgttccctcttgaatttctcttatgtgctcaccttcacttgaatatggattaactgcttttgcctctaatttcccatttggaattgaatttttaacatgctcaagattataagattcttttgtatcttcataagctcctgtaaggggatactgcttatctagttcctcttgcctttgttcaattatagattttttatcatcactattttgtatcgtagtttttccattactctcaaccttaacttgccaagtctgggtagtctttttgtatccttcgggtgccgtttcttctgataaagtgtaatctccaggtgtgagattatcaaaagtagcttcacctgttacctcagtagttactttttctactttgctttctgagtgtgaagtaggttttaaaacaaaggtagcttttgaaagtggtttgttctggtcatctgtctttttaacaactaactttcctttagcaccattttccggtacggtactttcccctaaaacattggtattaagcggtatttgcgacaaacaaaaaagacttaacgtcaatattttagaaaatttttggtattttctcattttacaactcctattgtgccgaaatgtcgtttctaaatctaagatcagatacagaatatcctagaatatacaaactatcacttattatgatatcaataatttcttattataaggtatggaattttaaagttttttcccaatttttgaatgatttttctttttatttgataatcttattttttattatcttagaaatacttcaattagcttaagtagttgatttttctttttttatgttttaaaatattgcttaaaaataatgtttgagagagagtttactgaattgattgaaaattatttagaaaaagacatccttaatcaaataaaacttctaactttatgctatgattactacccttccattactctagacaaatcatgtcatcaacttggtttatctgaactacttattaggaaatattgtcatgatttaacaactttatttaacagtcaactctctctgaatatcgaaaagagtacaatagtctaccaatctaatggtgtaactagagaacaagctttcaaatatatttatcatcaatcacacgttttacaacttttaaaatttttgatcacgaatgattcaggcaggttacctttaacttactttagtgaaaaatttggactatcttgtgcaactgcttatcgcatacgaaaacatattagtccgttactagaaaaacttggatttcagattgtcaaaaatactattaccggtgacgagtatcgaattcgctatttaatcgcacatttaaatgctcgatttggtatagaagtttatcccttatctaagatggataaattgcttatcaaacgattgttattagaatactcaactacttttactgcttctcattacttcccmaatacatttattttctttgatacattattgtctctatcatggaaacgtattaattataatgtagttgtcccttactcaccccttttcattgaactacaaaatatatttatctatgatacattacaatattgtgtcaaaaatgttattatagattcctttaaaattaatttaaaaaaagacgatatagactatatttttcttgcttaccttacttcccataactctttttctaatccaaattggactgagaagcgtatcgataatgtaatagctattttcgaaaattatcccaaattccaaaaattattacagccactcaaagatgctcttcccttatctggctcctatcatgatgagttggtaaaagttgctatcttttttttccgaacatttattttaggattaaatcaattaatccctgaaacaatttcatttccttcatggaactatcatagacatgataaattaactactattctccgaccgataattacaaactggttaagtgaaattggagaatacacatttaaagaacaacattttcttctcctttgtactcatctagaaagaatcatcaaaaatcatattcctccgatacagatagccgtactaactacagactttattaataaccaaattttaacagaatgcttattacagagattttcttctaaaaagattcatttccacccttactatttattaactgatgatctttccaatattactaatcttaatccagacattattattaccaataaaaagctttctccctttatcaaacatgagatttcttcagagagtttaattacatatattgatctgattaatacttcagaccaaatcaatcaaatccaaaaaattatttcatcaatacaggaagaaaaatattgcaaactttttgcaaaaactaatgaaataactaatcgtagctcctataactcttaaaaattaacattaaaaagctagagcattgtgtaatgctctagctttttaatgttaatttttttgaataatataatccaacttttcaactgttttttcccatgtgaaatgttctttaattcttttagcaatattctgttgtagtttctctcttaatgccttatcttttactaataaatcaagagattcatggagtgactgagtattttcttccatgatgattcctaactcagggctatcaataacttcaactgttccaccgcgatctgttgcaataatagcacttgaaagtagaccagcttctaaaatagaggttggtaatccctctggatacattgaagggtaaacaaagatatcagtctgtgccattaaagacatagtctgttcaaagtttaatttccccaaaaagttaatctgtttggactgatatttctctttcaaatgtgctaattcaggtccgtctcctgcaatctgtaaataaacattttcagagtactgtgacatcgaaaatgcttctaagagcaattcaatgcctttttctttaataattctaccagcataagtgatgaaaatatcatcagcagatttttcaaggtaagccgtactagcaaaatcagagcctagactttcagataccgaattataaataactcctttagcttctatattaaaatgttttaaccattcaacgcttctcttggataccgcataaaaatctggacgataatgcttaacacgcgctgtgagaagatgttcatagatagctccaaagaaatctaaaaaacgattattgacagaaaaatgacttgacccatggtctaaaacaatactaggtaaatggtgcttctttgcaaaagatagcccttctagcgttgttaactgaaaacgtgtattacaaatcacaaaatcaatattttcatctgaaacatatttcatcagcgtgttgtattctcgatttttgttaataataggatagcgctgcttgacaatatttttggtcggtaaacggtaaatttttctacccttgtcttcatctataatcggtaaatcaccatgattagttgttacaataacaacacggtagccacgcttaaccaaatctgctgtcattttatctgtataacgttcaatacctccgaggaagggtagataatatcctgagaaaacagcaactgtttttaccttattttccatatttatccactttcatcaataagccatcttttaagcctttaatcatagcaactatttttttgctcttttgctcttctgctaccaacactcgaacaaattcatttcgcataaatactaaatatttgtatcgcttcttcttaccatatttttttataatatagatcgcattgcgtatcatgtaatattttcgaaatggtgaatgattcaatacatgaaaaacatggccaaattttttaactcgtgaagagtgtccaatttcgtgtaaaagaccaataaaattaacctgataagtcttatatcccatctctgacagacgataattcatttcagagtcaacaaaatcaataaacatctcttctgcaaagccagatgtttcttcaaaaacgctcgttttcattaaagcagccgaagtaatacactcttcaatttctttatagtcaaattcttgcataactaaatcttcacggttcatatcttgatacaaacaagataacataccgaccttaggtaaaagaaggtaattttcataattatctatcaaatcacctaggacaaccgaatcttgatctaaagtcaagaaccaatcaaattcttgtgctactgcaaattgaccgatacagttcaaagcatatgcaattcctttattttctgttaaataatcaacagttaggtgcccctcttcattataatcggccactaattgagaaatttcttccttatttttcgagccattatctacgatgtagatatggcttacttgaggataaattgctcgaatgttctgatctaagcgttcaatattggggttaaaggtgacaatacccgctaaatatttcatgttctgtgctcttttctaaaatctctaaataactgaatgactggtgctttggttataaaaacgataccgacatagatagttactgctactaaactttgaatgacataatttaccaatgatactgacatttgagtattgatataataaagtacagctccactaagagtagcagcaattaaatagcgcagcattcctcttgttaattctttaaaagtaaatacatctcttaaagagatagcttgatagagggagacaataaattcagtaataactgtagagataatagctcccatagcacctaaaattggtattaaaagtatattaagcacaacatttgccacaagtccaataactgcagacattgtgtaagcttttgtacgtcttgaagccagtagatactgtgtccctaaagcgttaccataagaaatgcaaatgatcatcaaagactcaacagccattagcggaccgacagcttcataccctttcccaaaaaagaagacggcaaa

SEQ ID NO: 309 - DNA, 14000 bp, S. agalactiae
gttgcttcataagttgtctgaaggcctaattctaaagtcacatgcattctttcagaaagttcagcgagatagtatatagtttcatcaggtaagcaatccggccttgttccgatgttgatcccgataactcctggctcattaatagcctgttcgtaacgctctttaattatctctaacttagcatgggtattggtaaaattttgaaaatagactaagtatttattaacctcgggccactttctatgcatgaaatcaatttctttatagaattgttcacgaataggagcttctggagcaactatagcatcccctgaaccagaaactgtgcaaaaagtgcatcctcctctagcaactgttccgtctctgttaggacagtcaaaaccagcatctataggtaatttaaatattttttctccaaagagttctcgataataatcattaatcgcacgataacgttttttcataggataattgtatcacaattttaactaaaataacctcactactacaataaaacttaaaaagattggaacgtcagttagtcccaatcttttatttacttcactttctttaaccaatccttggctaaaaagatatacgcagttagattcaaaataccataagcaagtataaaaccagctaaaacatctgtcggaaaatgaacccctaggtaaatacgagataacccaattaaaaaaatgagcaaacccaaaataccttggcacaacagtttccatatactcttaggcatatagtactgcaataaaataataatactcccaaatatcataaatgttcccatcgagtgcccactgggaaacgaatagccacctgcaaatactaaatgggttaaagttggtctcactctttgaaaaataagttttaaagaaagtatacatataccagagataatagcatttactgcgataaatctagcttgaggataccacttcttaaggtaacagaaagtgacgctcataatcgcaatagctatctggcttacagtattaccaatcacagtgattaacttgaaaaatcttgtagaaagatttggcaactgtcctctaacactttcttgaatgttttggtcaaatgcaattacagtgtcgggccaatatttgatgaccaatcctaaactgaaaaataagataatagcaataaatgcttgaataagtttactattttgacgagataacattagtctttttatatctttctaatattggcaaacaagccacgtaagttagatagaaaacaatcgaaattaaaattccctcaacgatattaaatggaataaccattgttaaaaggtaattgcctacaccaataaatgttctgatatcaaagttagcaaatatagcatacaaaggaatcgcaaagacatagttgagagctaccatagatacagtcaagctaactgtaccaaatagactagctttaataaaatcttttgcactctctctatttttccagaaaatagcgaaacttgctaaaaataaagctagagcaaccatattcatcggtaaaccgataaaggtttctggaccacgattagcaagtataacttttaaaagtgatcttaataagagtacaccataacttgatttcaaatcaaataaaataaaagcaactaacatcggaaggattgaaaaatcaacctttaaaaattctgctcctggtattaatggaaatgaaaccatcatcaatacaaaagataaggcagaaagaatggcgattgtcaccattttacgtgtatttgtcataaaaaaattcctccaatttaaataaattgaaagaagctccaaaggtaagcgtaggtacgcgaaaaaaacctttgtcttctcccatccagactttactgtcggttgtggaatctcaccacatcagctttcgctcgcggactgatgcttcacaactgacaaataagttggaagcgattaccgccggtcgggaattacaccctgccctgaagacacctatagcataacaaaaaaaacttgcaattgcaagttttttaattactaattagtagtagtgattaaaaatcatattaataccaaattactatgctgtatcgtttctttcagatttgctatttttagtttttcttaaaaagataaacaaaattcccaaaataatacaaccaagaattgtcagtcctccaccaataatcattcctgttttaggaagaaatgattgtggaaaaagcggttgtgatggtttaggatttgttggtggaggagtttctttttcgttttctacctctacttcctgtgttttattagcaactacagcaactacagcatccttcatagatatacggtaaccagttagtgcttttgcttctcgaaaaatatacttaccaggtaataaaccttcaacctcaatttctcccttatcatcagttactaatgaagtaatcccatcttgatcggtcgtaaatcgtccatttttaaagcgaactggctgattctggttatcgtataatacaaatattactcctgatagccttttctttatctttccttcttttgtatatttaataagttttaatcggcctgtttcaacttttcgcttaggatttatctgtaattgatttgataacttatcatctggtatttcaatataaaaaggtactattgttgaaacgctttgatcagctttataagcacgaccaaagtacgaaccatttgggagtgctatctttgtctgaccattagtatcagtaggagaagtcaagatactcttatacttctggttcaattcgctatctgtcatttggctcaataaatcaacttttaagttgtcagtcacagtccataaacgataagaaatcccctcctctgtagtatttggctgaagtcctatctgtgtgattgttagttgattaggggtatcagcatttacactggctaccgaaaaaaacgctaattgtaccaatcctaaaaagcaacatagtagaagtcctaaactttttctaatctttttcatttttgatttccctttctttttctctctttaaattttcgttttaaatataatagtaaagcgactaatataagaataactaggattgataagaggaaataaagtttatagtgtgtttgcaattctttcattaaatagttcttttctttaacaggaggtacatacttgattcgatgccctctaactagtaaacgatgtgaattaatcgaataaggtgtacatgttagcaaagtcgcataatccttacctttaacaaccaataatttagaaaaattatctggctttacaacacttatttgatcaaccttataggctaaaacttctttgatattatgaatataaaaaatttttccttttttaagtttatctaaatctgtaaataacttagctttaggtaagccgcgatgagctgtgataacagtatgtgaactttttccaccaattggcaaagaagttccttcaaggtgtcctgctcctttttcaagaacactactggtagtccccgcatagataggtaatttttgcttgatagacggtatatcaatatatccaatcatttcagtaatctcaagcatatgggcgtattcagcaataccttttttttctttttcagtatagggatctgataggcggcttgggtccagtgttctattataagcttttgctaactcaaatcgtctattaatctctttagcatttaatttttgggtttgattatcaaagttagttacttgattattagctttaatattatagtaccaatttgaaataaaaggatatgaggttatcaaaagaccaactaagaacaatagtatcaggcctacattcatccatcgatttaaaacgaccgatttcttaaggtttttctgaaattttcctcccattatgattcaattccttttctaacacttgctaaacgatttttttgacgttgacgttttattaaccaaagtaaccaagcaataataactaaagatatatagaaaagatatctataaatcgtgtttaaatgaccttctttcattaatttttcatcaataagacctttataaggaatacgatgtccccttactaaaagtctgtgtgtattgaccataatcggggtgcaagttaataaggttgcataatcatgtccaggaacaaccaacaaatctgaaaagttatcgggtgtaacgacttttatctgatctacttgatatgctatcgtttcttttatgttttgaatataaaacttatctcctttttttaactttttaaggttagaaaagagttctttatctggaattcctgagtgcgctgttataacggtatgtgtgctatttcctccaattggaagagaagtaccttctaaatgccctgctcctttagatagaacttcttgacttgaacctgcaaatatagggagtttttgacctatcttaggaactgaaattgtgccgattttttcacttacctctaacatacgggcgtactctgctacccccttttgaattcgttttttctcataaggatcttcaagatggacattatttaaagaatcattataagcttgtgctagagtcatacgacgattgatttctttctgactaagttttttagcagctctctcaaaatcctgtgtttgattattagattctatcgtatagtaaaaacgtgataccactggatacaataaaatagatagacctattagaaaaagaatgataaaaggaagatttgacttcttctttttagtttttttgttgatatttttagtcttcacgtcatctcctaaataatggctcttgcttatgatctaagagtacttctactgaaatacccttagatcataagcacagctttaactgtgcttatacaccatcaaagactagccttaagcttcctctgattgacgttttttcatgacaactactgctccaagcataatgcttaaaccaataattgtgaaaagaattgtaccaataccacctgtttgtgggatggttacttttttgttttgaacttgttgggcatctttttttacagatcctttatcatatgcgatgtcagttgtagcccctttgctatatgatgtggcagttacttcaaagtttacatcacctgacaatgtcgcataacctgctggtgcttgagtttcttccaagctataagtgcctttatccaaaccagtaatttcaaattgaccaccggcgttagagatcaatttaacaacattatcagcctttttatctgcaacccattcatatgagtagttagctttaacaaaagcgtcattgtaagctttttgtttttgatcaacagtagccaatgctgttttaccttcttggccttcttgtttttctttagtcaagtcgttataagctttaacagcttcatccaatgctagtttagcagtttttacagctgcctttgcttcagcagttgctgcacctgctttacgtgccaagtattttccttctttcttaacaaggaaggtagctcctgccaagcgttcagtgttagcttgatttgttttcacaaatttacgtccataagtcaccacttttggttctgatgggttgattggagttggatcatttgagtttttgttgttcttgatagtcacaacaccatttttaaatgatacatattctggagtgtagccgctaacacgttcgacaacgcggtaagttttagtattatccaaacctgtgaaagtatgttcaaagcgtgatggttttgttgcttcgtgtgaagcaacgttcacccatgtaccatccgtttgtttttcttgcaaggtaaagatagctttaactgcaacattaacatcagtaattgtaccatctactgcccagtctttaatgactttaatttcttggttagctggagtaccttcttgtggttcactttcttccgttgggttattaccatagtccaatttaacatcattggtttctggaacttcaacagtagtggagccgttcaccgtagctgagtaagtgatcttgatttcaacatctttgtcttttgcagcagctgctactgctgcaagacctgttgcattcaaggcaagacggaaaccttggtcatctgttacgagtttgtagtttaaaacaggaaaatctttaccatccaatgttactttaacgttgttgttgaacgtcaaacctttagtcatgctatcagtccaaaccagtttcttatagtctgagcctttaagaatttttgttccaactatgtattcttttttgtcaccaactgtcgctgagacaacacctttgtcttttcggttgtcagtataatcaagatctttatctgcaaagttcttatctacttgtggttttgtttcagtattctttggataaatgtgagcatctttaacaacaccttggttgtttaccaatggcagagtgattttaactggaactgcttttgaatcagccaagatagaaccgttgttatcgtagtttgatttttctttcaattcaacgatttggtaagttccttttaacttagcagtgttaaaagcaaaaccagtgtcttttgttaaccctgaaagaacagcaccaccttcagcatctttagcttccaaagtatcgacttccttaccattttcagtaatgaattttgtaccagtttcatttttgaaaacaaagaaagcacccttaatttctttagcatcggttgagccaaaataagatttaaggtcattaatttgtttaccaacataatcgctatcattcttaccttttgtaccttcagtaaagttatcaaatgcagcttgtggcatgacaatcttgtgcaaggtcacagtatcagttgttacgtcgtccgcaaacgctggtgcaactgagaatagtgacgttaagatcaatagcagtgtcgagaacactgtaagacatttgttgatttttttcatttctatctccttcttattctagttaatcaacatagataataatatacggattataatattaccgcagcaccactcctttcgaattatatttaattaattaagaatactaaaacacatgattcttaatctttttctctagatatatcactagatttcttatatcttttccaaatataaattccacctgcaatagacatcatagatccacctattaaaatgaaagatagaattcctttcccacctgtcatcggaataattccttttggtggaatatgcgtgttggtaattaaatgcttgtcaccttcctcatgatattcagaaatctgtttattaacagctattatattttgtatcgatcctttaacaacttcaaaagttaaaattggtttattagtaattttttgataatccttcggcgaaactgcttctattaactgatatttgccatctttcaaatctttgtaagaaattttgccgttttctcccgtcactacttttgaattattattttttattggtaaataaagtttataatcttcattaaattcttgaagttcaaacgtagctcctttgagaagcaacttattattatctttatcaacttttgtaaattcaatttcacctaacttcttctcgtttttaatcgttattgtaggatattctctcacatcacgaattttagggattggaaaatctctaagtgtattaggatcctctgatttaggattcaatgttgttctaccattagtgtcatagaatttgttacttataaaactgtcatctagtttcacatcatatgtgagtgttactttttgtccctcccctaagttcaaacctctaacgtagagtttatttttgatgtattctaatttaacccctttaagtattccaccatcattattaggcccaccagttgcaatgctatctttcattatacttccatcatttccctgtaaagtataatcacttggttgcaatgtttgtccgttgccaagctgtaaattgattttgtcacccataggatcttctatagttccattaacaattgagttttcttttgttaaaaccttttcaaattgttgctgaattttagataaaatttcattgttagatgcatcggatgaagttactatcggggtataatactcaggtttagaagagaatgacttcattagttctgttatttccccatctgaaagttcaaaagcttcctctttcaatttttgaaaagtaccatcttgatttttcttataatcctcattataaacttgtctaaaagcagatatatctataccaaaattaaagatgtcataatttttctgttttaaactatttatataaagtttggttggtgttccatgttctcttactggtccatttcgataaattgtacctttagggtaattaagatttaaatctaaataatgaagtttttgtaagtttccagagattatctgtgtttgataactatctaagggaaacaaaaagtaactctccccatttccttttatatcctcgggcttatcagtaagtagaaaattacttttatttagatatccattttttttcatttgttcaaattggctttcatatgatgcacccaatttaaaattattaatagcatatgatcttgttggaacaccatcagttatatgaacaataattttttgactatttcgatctacttgactcaaaatatcatctgcctccatgaaggctttcatagtaaatgtttcccctactttactaagatagtactgcttttgttgctctggagtaagtccgtttgtagttgatccccatttagctctaggagcttctgtaggaatcctttttataatctcttcagcattatttgttaattgtttatgactataattctctgtctgaattgtgaacttagtttgaaggccataatatttatcatcttctttaaatccttttacgacatctacactcctaccatcaaaaatatctgaaccataggtaactaatgcaaccctattatcactgtttgctcctaaaatatcttttactgcggtcccaagagcttcggcagctttcttggctttattatgcctttgaaaatttgggccatcgttattcattgagttagaattatcgagtacgaagacaacatctaacggcttttgtttgtccactggttttactatggtttttccactgacagttaactcaattttatatttattatgagctaaatcacctacttctgaaatacgtttagataatgttccctctggaatttctcttatatgctcaccttcacttgaatatgggttaactgcttttgcctctgactttccatttggaactgaacctttaacatgctcaagtttataagattcctttgtatcttcataaattcctgtggggggatactgcttatctagttcttcgtgattttgtccaattgtggaatttttatcaccactattttgtatcgtagtttttccattactctcaaccttaacttgccaagtctggttagtctttttataaccttcgggcgctgtttcttctgataaagtataatctccaggtatgagattatcaaaagtagcttcacctgttagctcagcagttactttttctattttactttctggatgagcagtagtttttaaaacaaaggtagcttttgaaagtggtttgttctggtcatctgtctttttaacaactaactttcctttagcaccattttccggtacggtactttcccctaaaacattggtattaagcggtatttgcgacaaacaaaaaagacttaacgtcaatattttagaaaatttttggtattttctcattttacaactcctattgtgccgaaatgtcgtttctaaatctaagatcagatacagaatatcctagaatatacaaactatcacttattatgatatcaataatttcttattataaggtatggaattttaaagttttttcccaatttttgaatgatttttctttttatttgataatcttattttttattatcttagaaatacttcaattagcttaagtagttgatttttctttttttatgttttaaaatattgcttaaaaataatgtttgagagagagtttactgaattgattgaaaattatttagaaaaagacatccttaatcaaataaaacttctaactttatgctatgattactacccttccattactctagacaaatcatgtcatcaacttggtttatctgaactacttattaggaaatattgtcatgatttaacaactttatttaacagtcaactctctctgaatatcgaaaagagtacaatagtctaccaatctaatggtgtaactagagaacaagctttcaaatatatttatcatcaatcacacgttttacaacttttaaaatttttgatcacgaatgattcaggcaggttacctttaacttactttagtgaaaaatttggactatcttgtgcaactgcttatcgcatacgaaaacatattagtccgttactagaaaaacttggatttaagattttcaaaaatactattaccggtgacgagtatcgaattcgctatttaatcgcacatttaaatgctcgatttggtatagaagtttatcccttatctaagatggataaattgcttatcaaacgattgttattagaatactcaactacttttactgcttctcattacttcccaaatacatttattttctttgatacattattgtctctatcatggaaacgtattaattataatgtagttgtcccttactcaccccttttcattgaactacaaaatatatttatctatgatacattacaatattgtgtcaaaaatgttattatagattcctttaaaattaatttaaaaaaagacgatatagactatatttttcttgcttaccttacttcccataactctttttctaatccaaattggactgagaagcgtatcgataatgtaatagctattttcgaaaattatcccaaattccaaaaattattacagccactcaaagatgcccttcccttatctgactcctatcatgacgagttggtaaaagttgctatcattttttcccgaacatttattttaggattaaatcaattaatccctgaaacaatttcatttccttcatggaactatcatagacatgataaattaactactattctccgaccgataattacaaattggttaagtgaaattggagaatacacgtttaaggaacaacattttcttctcctttgtgctcacctagaaagaattatcaaaaatcacattcctccgatacaaatagccgtactaactacagactttattaataacaaaattttaacagaatgtttatcacagaggttttcttctaaacagattcatttccacccttactatttattaactgatgatctttccaatattactaatcttaatccagatattattattaccaacccaaagctttcttcctttataaaacatgagatttcttcagagagtttaattacatatattgatttgattcatactccagaccagatcaatcaaatccaagaaattatttcatcaatacaagaagaaaaatattgtaaactttttgcaaaaaacaatgaaataactacccgtagctcctataactcttaaaaattaacattaaaaagctagagcattgtgtaatgctctagctttttaatgttaatttttttgaataatataatccaacttttcaactgttttttcccatgtgaaatgttctttaattcttttagcaatattctgttgtagtttctctcttaatgccttatcttttactaataaatcaagagattcatggagtgactgagtattttcttccatgatgattcctaactcagggctatcaataacttcaactgttccaccgcgatctgttgcaataatagcacttgaaagtagaccagcttctaaaatagaggttggtaatccctctggatacattgaagggtaaacaaagatatcagtctgtgccattaaagacatagtctgttcaaagtttaatttccccaaaaagttaatctgtttggactgatatttctctttcaaatgtgctaattcaggtccgtctcctgcaatctgtaaataaacattttcagagtactgtgacatcgaaaatgcttctaagagcaattcaatgcctttttctttaataattctaccagcataagtgatgaaaatatcatcagcagatttttcaaggtaagccgtaccagcaaaatcagagcctagactttcagataccgaattataaataactcctttagcttctatattaaaatgttttaaccattcaacgcttctcttggataccgcataaaaatctggacgataatgcttaacacgcgctgtgagaagatgttcatagatagctccaaagaaatctaaaaaacgattattgacagaaaaatgacttgacccatggtctaaaacaatactaggtaaatggtgattctttgcaaaagatagcccttctagcgttgttaactgaaaacgtgtattacaaatcacaaaatcaatattttcatctgaaacatatttcatcagcgtgttgtattctcgatttttgttaataataggatagcgctgcttgacaatatttttggtcggtaaacggtaaatttttctacccttgtcttcatctataatcggtaaatcaccatgattagttgttacaataacaacacggtagccacgcttaaccaaatctgctgtcattttatctgtataacgttcaatacctccgaggaagggtagataatatcctgagaaaacagcaactgtttttaccttattttccatatttatccactttcatcaataagccatcttttaagcctttaatcatagcaactatttttttgctcttttgctcttctgctaccaacactcgaacaaattcatttcgcataaatactaaatatttgtatcgcttcttcttaccatatttttttataatatagatcgcattgcgtatcatgtaatattttcgaaatggtgaatgattcaatacatgaaaaacatggccaaattttttaactcgtgaagagtgtccaatttcgtgtaacagaccaataaaattaacctgataagtcttatatcccatctctgacagacgataattcatttcagagtcaacaaaatcaataaacatctcttctgcaaagccagatgtttcttcgaaaacgctcgttttcattaaagcagccgaagtaatacactcttcaatttctttatagtcaaattcttgcatcactaaattttcacggttcatatcttgatacaaacaagataacataccgaccttaggtaaatgaaggtaattttcataattatctatcaaatcacctaggacaaccgaatcttgatctaaagtcaagaaccaatcaaattcttgtgctactgcaaattgaccgatacagttcaaagcatatgcaatccctttattttctgttaaataatcaacagttaggtgcccctcttcattataatcggctactaattgagaaatttcttccttatttttcgagccattatctacgatatagatgtggcttacttgaggataaattgctcgaatgttctgatctaagcgttcaatattggggttaaaggtgacaatacccgctaaatatttcatgttctatgctcttttctaaaatctctaaataactgaatgactggtgctttggttataaaaacgataccgacatagatagttactgctactaaactttgaatgacataatttaccaatgatactgacatttgagtattgatataatagagtacagctccactaagagtagcagcaattaaatagcgcagcattcctcttgttaattctttaaaagtaaatacatctcttaaagagatagcttgatatagggagacaataaattcagtaataactgtagagataatagctcccatagcacctaaaattggtattaaaagtatattaagcacaacatttgccacaagtccaataactgcagacattgtgtaagcttttgtacgtcttgaagccagtagatactgtgtccctaaagcgttaccataagaaatgcaaatgatcatcaaa

SEQ ID NO: 310 - DNA, 5327 bp, S. agalactiae
ttttgcaaattttattgtgatgagttttctatcataataaacattaacgacacttgaaccatcgtcttttatcatgacagaagtttctgtcctcgtattattaactttaaagccagtcggtagtttttcattaatatcttgttgtgttagcgtctgattagataaagataggcctgatcgtgttacttgccctgcgtactcatatgtcttttgcgcatcagtagcatttttattatccgttgctgattgttgccagtagtttatcgtgtaggttgtttgtgcgggcgaccaatgtgcatatagcgtcgtatccttggtcaagacttgattaaaatcaaaggctgtcccaccactagcagctgtgtaccaccctgcaaaagtataacctggccttgttggatcattaggcttaattgtcgaagcaggttggtctgttaacacacgacgaggtgcaatataggtaactcctgttgataagtcgcctgtgttgaattcaacaccgtacgattctttaaagacaggataaagacttatgtctgaagatacaggtaatgcttgaatttctgattcagaaagtggagctccattttgagttttagaccaacctacaaataataatgttgaagtgggtggtgaaactttaaatgaacttagatccgcggttccgtttcctgaactatccaatggtacttgataacgctccaaaatacttttaccagcagaatcatcatataaagttactgtcgccactttactcataaatggacgaacataaatttcttttgtctcagttacagttattggctcaccaaatttaacagggtcaccatactttccagtagtaggatcataggtataccaaccattaaaatgctctcctgctttaatcgtcggaatcccaacttctcctagagattctccatcttttataatttgatgatgaacttgcatacctgaagctgtcaggaaattataatcagttccgtcattattttgaaaatggtaagttaacctaggaacttctgtattatcctcttgaacaattgcataaatggagaatgaatctgttttaaaagcaacatcactgctagtgttcttagtttctgcagtatctttagattttaatacttctgtttgaccatcatctttaaagtgaacaactttaaggttttcatctgaagcttctaatggcttatcatagttgacctctacttttactggggcttggggttctgcttctttaccatttgactcaatagtaatgtcatagagtttgaagtttttgatttcactatcttgtttagcaacttctgtcaatgcttttttcttatagtctttaaaagtagctgaattgtcttttaattccgtcacctttaaatcagcatttttaggaatcttagcttctttggtcaaagtcactgttacagtatagtctgcacctctaaacatcaatggttcttcacggtaagcagcttcctcagaagatgatgtttctgttacactagaagcaggagtctgtggcttgctctgctcaacacttgattgagaactagatgttgatgaagttacctggctagaatttttattttctaaagtaatccccacatcatctgtcttagtttcttcaactgttattgctggtagaattaaaaaataagtcgttaaaaaagttgttaggatcatcaatgaccacatgataattttccactctttagggtgttttttcttttttaatgattcgattataaaagtttgacacttctttagcatttttgcatcctccctaaccttaattgatactactaatcttacctagaggccatattctgaaagaaattttacctacaatttgttcttctgaaacatctcctacagaagtatttcgagaatcaattgaagtttttcggttgtctcctaatacaaaaatttttttatcaggtacttgatatgggtattttatattactattaccgagtgctttatgaataacatatggttctttcaacttatgttgattcacgtaaacatccccttgagaatcaatattaacccagtctcctgactctgcaataacccgcttgactaggaccttattattgtagtaaaacgcgacaacgtctccagttttaaaatttgaaccttttactgtaaagactacatcacctgcacttaaagtcttattcattgaatgtccgtagattcttaatacaggcaaccataaaaccgcaattaaaatggctgttgaggcaaccgccatcaagatgtatatggtatttttaatgacactccaaaagcgtttctgataagttacgcgatccagttcttgagataatttatctgaactaatctgtcttttcattgtctacgcctctcttatctactaaattctttacgttttctaaataggtatctgcagctaactgagcagtctcaaaaataccactaagcattaaggaagcttcggcaatagaaccagctttgctaattttgatttttttatcatctagcgcttctttaagttgctgaatctctttctcttgtttttcaataagaagttgctgttctaacataatttctagcaagtcttttctttttaatttttttaaatcttccatcgcgattacttccttaactgaaccttaaattatcgtttagatattatatcaaagttctaacctttaaactcattttttgtcctgtgttttttctcaaaaaagtctatgctaaattaacatttttgataattttttgaaaaatctcatcgaagtcattttctttttgaaagctcgaattctaggcattaaaaagccatatatcaaattgatatatggctttttttattatttaaaacaaaagaatcaataggacaatagcgtcaatttagtgacataatctattacagattaagttctttttgaataatataatccaacttttcaactgttttttcccatgtgaaatgttctttaattcttttagcaatattctgttgtagtttctctcttaatgccttatcttttactaataaatcaagagattcatggagtgactgagtattttcttccatgatgattcctaactcagggctatcaataacttcaactgttccaccgcgatctgttgcaataatagcactcgaaagtagaccagcttctaaaatagaggttggtaatccctctggatacattgatgggtaaacaaagatatctgtctgtgccattaaagacatagtctgttcaaagtttaatttccccaaaaagttaatctgtttggactgatatttctctttcaaatgtgctaattcaggtccgtctcctgcaatctgtaaataaacattttcagagtactgtgacatcgaaaatgcttctaagagcaattcaatgcctttttctttaataattctaccagcataagtgatgaaaatatcatcagcagatttttcaaggtaagccgtgtcagcaaaatcagagcctagactttcagataccgaattataaataactcctttagcttctatattaaaatgttttaaccattcaacgcttctcttggataccgcataaaaatctggacgatagtgcttaacacgcgctgtgagaagatgttcatagatagctccaaagaaatctaaaaaacgattattgacagaaaaatgacttgacccatggtctaaaacaatactaggtaaacggtgcttctttgcaaaagatagcccttctagcgttgttaactgaaaacgtgtattacaaatcacaaaatcaatattttcatctgaaacatgtttcatcagcgtgttgtattctcgatttttgttaataataggatagcgctgcttgacaatgtttttggtcggtaaacggtaaatttttctacccttgtcttcatctataatcggtaaatcatcatgattagttgttacaataacaacacggtagccacgcttaaccaaatctgctgtcattttatctgtataacgttcaatacctccgaggaagggtagataatatcctgagaaaacagcaactgtttttaccttattttccatatttatccactttcatcaataagccatcttttaagcctttaatcatagcaactaattttttgctcttttgctcttctgctaccaacactcgaacaaattcatttcgcataaatactaaatatttgtgccgcttcttcttaccatatttttttataatataaatcgcattgcgtatcatgtaatattttcgaaatggtgaatgattcaatacatgaaaaacatggccaaattttttaactcgtgaagagtgtccaatttcgtgtaaaagaccaataaaattaacctgataagtcttatatcccatctctgacagacgataattcatttcagagtcaacaaaatcaataaacatctcttctgcaaagccagatgtttcttcaaaaacgctcgttttcattaaagcagccgaagtaatacactcttcaatttctttatagtcaaattcttgcatcactaaatcttcacggttcatatcttgatacaaacaagataacataccgaccttaggtaaatgaaggtaattttcataattatctatcaaatcacctaggacaaccgaatcttgatctaaagtcaagaaccaatcaaattcttgtgctactgcaaattgaccgatacagttcaaagcatatgcaattcctttattttctgttaaataatcaacagttaggtgcccctcttcattataatcggccactaattgagaaatttcttccttatttttcgagccattatctacgatgtagatatggcttacttgaggataaattgctcgaatgttctgatctaagcgttcaatattggggttaaaggtgacaatacccgctaaatatttcatgttctatgctcttttctaaaatctctaaataactgaatgactggtgctttggttataaaaacgataccgacatagatagttactgctactaaactttgaatgacataatttaccaatgatactgacatttgagtattgatataatagagtacagctccactaagagtagcagcaattaaatagcgcagcattcctcttgttaattctttaaaagtaaatacatctcttaaagagatagcttgatatagggagacaataaattcagtaataactgtagagataatagctcccatagcacctaaaattggtattaaaagtatattaagcacaacatttgccacaagtccaataactgcagacattgtgtaagcttttgtacgtcttgaagccagtagatactgtgtccctaaagcgttaccataagaaatgcaaatgatcatcaaa

SEQ ID NO: 311 - DNA, 13954 bp, S. agalactiae
tccacatcggtccaattaacatatgacgtggcgcatcaccagtaattcggtgaataacaatatgttttggaataatctccagttggtcacaaataatcgaaatatagtcttcttgacttaacaaacgtaaacgaccttcatggtaatctctctgcattcttgtattatgcataagatgcagaaggtgtaattttataccctgaatatcattatccgtaacacatcgacgaacattttccaccatcatatcatgtgtctcccctgggagaccatttattaggtgagaaacgatttctactttaggagctaattctcgtattctcttaacagtttttttgtaaaggtcatatgaatgtgctctatttattaatgcagaagttgcttcataagttgtctgaaggcctaattctaaagtcacatgcattctttcagaaagttcagcgagatagtatatagtttcatcaggtaagcaatccggccttgttccgatgttgatcccgataactcctggctcattaatagcctgttcgtaacgctctttaattatctctaacttagcatgggtattggtaaaattttgaaaatagactaagtatttattaacctcaggccactttctatgcatgaaatcaatttctttatagaattgttcacgaataggagcttctggagcaactatagcatcccctgaaccagaaactgtgcaaaaagtgcaccctcctctagcaactgttccatctctgttaggacagtcaaaaccagcatctataggtaatttaaatattttttctccaaagagttctcgataataatcattaatcgcacgataacgttttttcataggataattgtatcacaattttaactaaaataacctcactactacaataaaactaaaaaagattggaacgtcagttagttccaatcttttatttacttcactttctttaaccaatccttggctaaaaagatatacgcagttagattcaaaataccataagcaagtataaaaccagctaaaacatctgtcggaaaatgaacccctaggtaaatacgagataacccaattaaaaaaatgagcaaacccaaaataccttggcacaacagtttccatatactcttaggcatatagtactgcaataaaataataatactcccaaatatcataaatgttcccatcgagtgcccactgggaaacgaatagccacctgcaaatactaaatgggttaaagttggtctcactctttgaaaaataagttttaaagaaagtatacatataccagagataatagcatttactgcgataaatctagcttgaggataccacttcttaaggtaacagaaagtgacgctcataatcgcaatagctatctggcttacagtattaccaaccacagtgattaacttgaaaaatcttgtagaaagatttggcaactgtcctctaacactttcttgaatagtttggtcaaatgcgattacagtgtcgggccaatatttgatgaccaatcctaaactgaaaaataagataatagcaataaatgcttgaataagtttactattttgacgagataacattagtctttttatatctttctaatattggcaaacaagccacgtaagttagatagaaaacaatcgaaattaaaattccctcaacgatattaaatggaataaccattgttaaaaggtaattgcctacaccaataaatgttctgatatcaaagttagcaaatatagcatacaaaggaatcgcaaagacatagttgagagctaccatagatacagtcaagctaactgtaccaaataaactagctttaataaaatcttttgcactctctctatttttccagaaaatagcgaaacttgctaaaaatagagctagagcaaccatattcatcggtaaaccgataaaggtttctggaccacgattagcaagtataacttttaaaagtgatcttaataagagtacaccataacttgatttcaaatcaaataaaataaaagcaactaacatcggaaggattgaaaaatcaacctttaaaaattctgctcctggtattaatggaaatgaaaccatcatcaatacaaaagataaggcagaaagaatggcgattgtcaccattttacgtgtatttgtcataaaaaaattcctccaatttaaataaattgaaagaagctccaaaggtaagcgtaggtacgcgaaaaaaacctttgtcttctcccatccagactttactgtcggttgtggaatctcaccacatcagctttcgctcgcggactgatgcttcacaactgacaaataagttggaagcgattaccgccggtcgggaattacaccctgccctgaagacacctatagcataacaaaaaaaacttgcaattgcaagttttttaatcactaattagtagtagattgtataatattaatttttaacatcaattaattgacagcgcactaatactctagctactcctgcctttgtacaagtaaacaagcttaagtcccaatcattgtctgatgtggcagttttataaactttttcaatcgctgttggttcaataatttctctattactgattttgtagtgatagatttgccctgttgtagttgtaaaataaacatccgttcccatatctacattttttaaagcatcaaaatgataaggaaaattatgcgcacaaatcaccatgttattagttaaataagaaccataataccttgtaggcgttttagacagttgttcaaaactataattagcagctaccggtaaatgcagttttaagttcggaatatccagagttcccaagtaatctgttttatccaacttttttacaggtaattctccattttctgaaccctttacttgatgcgtaatagatttatcaagcgccttgacaatatactgagaagttaaatcagcttgatgcgcctgattaatattataccaaccccaatagattccagaacttaccagaatgattccaagtatcgctaaaaaatttgctgaatatcttctaatcacgtcttcttctccattttaaggctattattaaacacagaagtcctgacataattagtataggtattggccaccatacttgtccagtaaacgggagctttccctttgtctgatgtgctactgtaggagtaatcgtctcttcttttttaggtttagcatttaaagggctcattttctcaaatgctgtaatatcgtacttcccatccttaggtattgatagtataaagggagacattagttcataaccttgagctgttttagtctgaataaatagataaatcccttgaggaagattgttcgcaacaataccttcagccggtaaattatcaaacgtttgtaaaggttgaattttatgaacagcttttgttagtagattgacatatttggcttggttactatcaaggtttacttgtgttaaatcatcgtcttttattccaataccttgaaatggggtagttagagtaaaaacttggttaccatcaacatctttagcttgtgctacttggtaaacaagtaaattaccgccagcgataccttgattattatacttattttgtatagtaatagaacccgttttcatctgatcattggtatcagcagacacaagttgagtacttagactaaataataagagaagagttatatttaggatctttttataaatcattgttctcttcctttctcattgcttgttttaaaattttcttacgttgacgtgctctcctagttacttctaaaaagattaaaagtaaaatcaaagtaaggaaaatagcgataaatggtgcgatataaataggctctatttgtattgcctctgctaccaccaaagcgttaccattatcgtttggtacacgatgtcctctcactagtaaccgatgggtattaacaccatatggtgtacacgtcaccaaagtttggtagtctttacctttaacaatttgtaaatccctcaaatcatccggtttaactgttctgatttgatccacttgataagtatatgtttcatttaagatactgactgtccagtggtctccagcttttaacttatccaaatcagaaaaaagccttgaagagggtaaacctctatgtcctgataaaatagaatgagttgagtctcctccaattggaagactacttccttctaaatgaccaatagaagtttgaagcaccttttcacttgtaccatgataaagtggtaattttatatttatctttggaattgaaatataacccatattacccgttttatcgatagccagttgtgaattataatccaaacgctcttggtcagtcatgtgccacttcattcctgaagttttaaattgcttattatattctttggctcggttaataatttttttatagtcgttttcatccatatgcgttacgcggtcttggtaatccataatcgctcgagattggtgaaatgaattccaataattagcaagtgaaggataagccattaagcctacccccactgcaattatagtgacaagcaaaatggatactaaatgttgtcttatttttttcatatattttaaatctgtaccactttgctagcccatcttattaagaacgtaaacgacgacgagcaacaagcacgatacctgctcctattactaaaattgcacctataatgtagaaaattgttgtaccaataccacctgttgaaggcaactcagtacctttgttattttcaacagttgggttaactaaaaggttatctgaattagtcgtatcagtggctccatctcctaaaataaccttctgagagttatctaacaaattgtaacctaagggagcctttttctcaactagatagtatgtaccttctttcaagcctgtaatggtaattataccatctgctcctgttgtatattctgttgcattagcttctgtgccccattcaacgttatttgtatcgttaaagtttagaaattgacccgtagcattctttaaaacaaatatagcaccttgtaatgaagcttttgtggaaccatcaattttttttatagtaatttgaccatccctcactgttactttttgacctgggtcatcattgctagtattggggttgatggtcgcaatgtttgtattttctggtaaatcagctgaacctggtttagctccactctttaatactcctgtataagtgactgtgattgtatttattcccttataaaaaaagtcatcattagctccattttgagtatttccggttggagtattggtagctgcccacggaatagtaatcgtgaaattattattttcctctaacaggttatacttcccagttgctttttccgaaccttgagttagagttgtaatattccctgatccatcagtaatagttacttcataagatccttcgttcaaatcaactacagaagcagatggcatagtatcctttataacatattgatacactttttctgtaccatgataattgactgcattcttataagtaatagtatatttgactgtatcaccaaccgagtacgttttttgatctacagtttttccaccaccatctccccatgtcgcatcagtattcttttcatgaatagtagcatttggagttacagatgtaaccataattacagctccattattaacagtgctagaaacataataatatccatattgggaaacattaataacctcagtaccatcattatttgactcagtaacagtggaaactggtgtagtattagctgatatagatttagcccatgtcgcaatctcatttgctgacgcagtatcttttttagttacatatgttctccctccattagtagttgtcgtaaaaagagaattaaaatcagttgaagctttatactcagcttctttaccttgaggaattaaataagaagctccatctttattcgaatcagatacatttgcattatctatttctgcatcaaaaactttgtatgctttataggttgcgcctttttgagtatcttgaactgtaattgtccctgtctcagcggcaaaagctatcggcgtaactggtgatacagccataccaaatgctaaactcgccactaacagcgattgaatcattttctttttcattgaaatctttctcctaaaatcatattgatgaatgattaattcatattttttttcgatagtataatattaatcctgatggtagagctaaagctaaaccaactaggatataaatgtgtgttccaatacctccagtactaggcaattctgttcctttactgttagtaattttaaaagtatatactgtacttccatctactaaattctcttttattggtgtcgcattattaccattttgttcaaaggtaactcccgtagaaatcactaatactgacatatcatttttaggtagtaggtaccctggaggggcctttgtctctgttaggtagtattttcctactggcaaactgaggtagttattagcatccactaataacaagcctttatcgtttgtcaccagccctgaatacataggatgtgaagctttattcccattagcatctgattcataaatatcaaaaactgcacctgctaaaaaattattatcattttcgacattaactttctgtagtcgtactttttgcttgatacgtgtattggtaaagctaatatctacgtctcctgaaactgtaagggattgtaagccggtagcatcataagttttatcagcttcaccagttgctagatttttttctgtaattgactcagatactttaaattcatcgtaggcttgttcatctattgatatagaagttccataaggtactttaaattccttagtctgaccatctctcagcggaaaattctcttgttgcaacgtttcacttggattaaacaagaagtctttcgtcttatcttcatctagtccaacgacagttttacttactctgacggtgtattctttaggttgccaaacagcatataaggtatttgttgcatcagggttgttatcaatacctattgattgacctgctgtaaattccacacgtcctgtatcagctaaatccttatcatgatgccaaccaataaggttgtaacctgtccttgtaaagtattggttttcaggaattgtagttgtgctattcaactccatacgcggtgtctctacttgtgttaccacattaccattttctactctagtaccaccgttaccattatatttgattgaggtatcttctaatttgatatctcctactggaataatgacaggttttatggtgatatttttattagcatctgctaaatgggcgtcaatatcaatggaatcatatgggttataaattttaccattgtaccaccagccacggaaacgatagccatctggcattgtcggacgtctcagtaaggctgaatgggagccatcgtcataggaatcagggtcagtaggctcattacttgtttgtaattgctgaccagaagcatccaatgctggctttccatctgtaccaacagcatcattgctgtatataatatgataatctccagcctttcgccaaatagctcttaaattgatatcttgagttacagcacctgaaaagttataaggtctaatactaccatctggattaacataataccaaccgactaatttgtaagcgtcttttacgtacttgtacttagttgttgtatcaacatttgagagactagtatctgtcgtataataggcatctttagttgagtcgggatctttatctcgtgaatcatacttataataatatgtacctgaaggatcttggatataatcccttgtaatatctgtataatccggaatacgatcaccataatgcaagtctaaataggtatcatctgtttttgataattggcctccgtttggatcaatattgacacgatatgttaccttttgccaacctgcatagactttaacatcatgaggaggcatagtcgtgttaaagtcaaatacttgtgtttgtgcttggtctttataccatttaccatcccaaacataccctggtcgactaggtttaggttgaaccgttgtcgtatcgggggcataagaggacaaattttgctcatatagaacatcctttactggaaaattaggaagctctgtattatcaagcggatctaaatatttaatcttgtatgaattacgttcataccataccactaagtccaaataatctttgtgataatatccatactgatcgtaatattcatcagcgactggcacagttgtattagcactagtttgtagtggcttagcatcaaataagtaattatctggatacaagctttgatagtatttaacattaaatcctaagtatttttctgtaaaggtaaactcgtctgctccagcacctccccctacgtctgataaaaagtatttgccatctagtccttgtttatagaaagcataattttgaaattcgctgaccaacaggatacaattttatttcataaggatttgctccacgtactccactgggaagtataaactcacccaaataactcattcctgatactccagttgaagttaggtaacgccacgcacctgtcttccactgatagccattcgcagctaaagtcgtaccatatagtccagtataggtgtcggcatatgatgcactagtccaaggaaacgaagaactttgataataaacctcagagtagcccgtcttcgcaaatctcatagtcacaagttttctatcataataaacattaacgacacttgaaccatcgtcttttatcatgacagaagtttctgtcctcgtattattaactttaaagccagtcggcaattttgcattaatatcttgttgtgttagcgtctgattagataaagataggcctgatcgtgttacttgccctgcgtactcatatgtcttttgcgcatcagtagcatttttattatccgttgctgattgttgccagtagtttatcgtgtaggttgtttgtgcgggcgaccaatgtgcatatagcgtcgtatccttggtcaagacttgattaaaatcaaaggctgtcccaccactagcagctgtgtaccaccctgcaaaagtataacctggccttgttggatcattaggcttaattgtcgaagcaggttggtctgttaacacacgacgaggtgcaatataggtaactcctgttgataagtcgcctgtgttgaattcaacaccgtacgattctttaaagacaggataaagacttatgtctgaagatacaggtaatgcttgaatttctgattcagaaagtggagctccattttgagttttagaccaacctacaaataataatgttgaagtgggtggtgaaactttaaatgaacttagatccgcggttccgtttcctgaactatccaatggtacttgataacgctccaaaatacttttaccagcagaatcatcatataaagttactgtcgccactttactcataaatggacgaacataaatttcttttgtctcagttacagttattggctcaccaaatttaacagggtcaccatactttccagtagtaggatcataggtataccaaccattaaaatgctctcctgctttaatcgtcggaatcccaacttctcctagagattctccatcttttataatttgatgatgaacttgcatacctgaagctgtcaggaaattataatcagttccgtcattattttgaaaatggtaagttaacctaggaacttctgtattatcctcttgaacaattgcataaatggagaatgaatctgttttaaaagcaacatcactgctagtgttcttagtttctgcagtatctttagattttaatacttctgtttgaccatcatctttaaagtgaacaactttaaggttttcatctgaagcttctaatggcttatcatagttgacctctacttttactggggcttggggttctgcttctttaccatttgactcaatagtaatgtcatagagtttgaagtttttgatttcactatcttgtttagcaacttctgtcaatgcttttttcttatagtctttaaaagtagctgaattgtcttttaattccgtcacctttaaatcagcatttttaggaatcttagcttctttggtcaaagtcactgttacagtatagtctgcacctctaaacatcaatggttcttcacggtaagcagcttcctcagaagatgatgtttctgttacactagaagcaggagtctgtggcttgctctgctcaacacttgattgagaactagatgttgatgaagttacctggctagaatttttattttctaaagtaatccccacatcatctgtcttagtttcttcaactgttattgctggtagaattaaaaaataagtcgttaaaaaagttgttaggatcatcaatgaccacatgataattttccactctttagggtgttttttcttttttaatgattcgattataaaagtttgacacttctttagcatttttcatcctccctaaccttaattgatactactaatcttacctagaggccatattctgaaagaaattttacctacaatttgttcttctgaaacatctcctacagaagtatttcgagaatcaattgaagtttttcggttgtctcctaatacaaaaatttttttatcaggtacttgatatgggtattttatattactattaccgagtgctttatgaataacatatggttctttcaacttatgttgattcacgtaaacatccccttgagaatcaatattaacccagtctcctgactctgcaataacccgcttgactaggaccttattattgtagtaaaacgcaacaacgtctccagttttaaaatttgaaccttttactgtaaagactacatcacctgcacttaaagtcttattcattgaatgtccgtagattcttaatacaggcaaccataaaaccgcaattaaaatggctgttgaggcaaccgccatcaagatgtatatggtatttttaatgacactccaaaagcgtttctgataagttacgcgatccagttcttgagataatttatctgaactaatctgtcttttcattgtctacgcctctcttatctactaaattctttacgttttctaaataggtatctgcagctaactgagcagtctcaaaaataccactaagcattaaggaagcttcggcaatagaaccagctttgctaattttgatttttttatcatctagcgcttctttaagttgctgaatctctttctcttgtttttcaataagaagttgctgttctaacataatttctagcaagtcttttctttttaatttttttaaatcttccatcgcgattacttccttaactgaaccttaaattatcgtttagatattatatcaaagttctaacctttaaactcattttttgtcctgtgttttttctcaaaaaagtctatgctaaattaacatttttgataattttttgaaaaatctcatcgaagtcattttctttttgaaagctcgaattctaggcattaaaaacaaaagaatcaataggacaatagcatcaatttagtgacacaatctattacagattaagttctttttgaataatataatccaacttttcaactgttttttcccaggtgaaatgttctttaattcttttagcaatattctgttgtaatttctctcttaatgccttatcttttactaataaatcaagagattcatggagtgactgagtattttcttccatgatgattcctaactcagggctatcaataacttcaactgttccaccgcgatctgttgcaataatagcactcgaaagtagaccagcttctaaaatagaggttggtaatccctctggatacattgatgggtaaacaaagatatctgtctgtgccattaaagacatagtctgttcaaagtttaatttccccaaaaagttaatctgtttggactgatatttctctttcaaatgtgctaattcaggtccgtctcctgcaatctgtaaataaacattttcagagtactgtgacatcgaaaatgcttctaagagcaattcaatgcctttttctttaataattctaccagcataagtgatgaaaatatcatcagcagatttttcaaggtaagccgtaccagcaaaatcagagcctagactttcagataccgaattataaataactcctttagcttctatattaaaatgttttaaccattcaacgcttctcttggataccgcataaaaatctggacgatagtgcttaacacgcgctgtgagaagatgttcatagatagctccaaagaaatctaaaaaacgattattgacagaaaaatgacttgacccatggtctaaaacaatactaggtaaacggtgcttctttgcaaaagatagcccttctagcgttgttaactgaaaacgtgtattacaaatcacaaaatcaatattttcatctgaaacatgtttcatcagcgtgttgtattctcgatttttgttaataataggatagcgctgcttgacaatgtttttggtcggtaaacggtaaatttttctacccttgtcttcatctataatcggtaaatcaccatgattagttgttacaataacaacacggtagccacgcttaaccaaatctgctgtcattttatctgtataacgttcaatacctccgaggaagggtagataatatcctgagaaaacagcaactgtttttaccttattttccatatttatccactttcatcaataagccatcttttaagcctttaatcatagcaactaattttttgctcttttgctcttctgctaccaacactcgaacaaattcatttcgcataaatactaaatatttgtgccgcttcttcttaccatatttttttataatataaatcgcattgcgtatcatgtaatattttcgaaatggtgaatgattcaatacatgaaaaacatggccaaattttttaactcgtgaagagtgtccaatttcgtgtaaaagaccaataaaattaacctgataagtcttatatcccatctctgacagacgataattcatttcagagtcaacaaaatcaataaacatctcttctgcaaagccagatgtttcttcaaaaacgctcgttttcattaaagcagccgaagtaatacactcttcaatttctttatagtcaaattcttgcatcactaaatcttcacggttcatatcttgatacaaacaagataacataccgaccttaggtaaatgaaggtaattttcataattatctatcaaatcacctaggacaaccgaatcttgatctaaagtcaagaaccaatcaaattcttgtgctactgcaaattgaccaatacagttcaaagcatatgcaattcctttattttctgttaaataatcaacagttaggtgcccctcttcattataatcggccactaattgagaaatttcctccttatttttcgagccattatctacgatgtagatatggcttacttgaggataaattgctcgaatgttctgatctaagcgttcaatattggggttaaaggtgacaatacccgctaaatatttcatgttctatgctcttttctaaaatctctaaataactgaatgactggtgctttggttataaaaacgataccgacatagatagttactgctactaaactttgaatgacataatttaccaatgatactgacatttgagtattgatataatagagtacagctccactaagagtagcagcaattaaatagcgcagcattcctcttgttaattctttaaaagtaaatacatctcttaaagagatagcttgatatagagagacaataaattcagtaataactgtagagataatagctcccatagcacctaaaattggtattaaaagtatattaagcacaacatttgccacaagtccaataactgcagacattgtgtaagcttttgtacgtcttgaagccagtagatactgtgtccctaaagcgttaccataagaaatgcaaatgatcatcaaa

SEQ ID NO: 312 - protein, 554 aa, S. agalactiae
MKLSKKLLFSAAVLTIVAGSTVEPVAQFATGMSIVRAAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPSIPNTGGIGTAIFVAIGAAVMAFAVKGMKRRTKDN

SEQ ID NO: 313 - protein, 890 aa, S. agalactiae; identical to SEQ ID NO: 11

SEQ ID NO: 314 - protein, 890 aa, S. agalactiae
MKKRQKIWRGLSVTLLILSQIPFGILVQGETQDTNQALGKVIVKKTGDNATPLGKATFVLKNDNDKSETSHETVEGSGEATFENIKPGDYTLREETAPIGYKKTDKTWKVKVADNGATIIEGMDADKAEKRKEVLNAQYPKSAIYEDTKENYPLVNVEGSKVGEQYKALNPINGKDGRREIAEGWLSKKNTGVNDLDKNKYKIELTVEGKTTVETKELNQPLDVVVLLDNSNSMNNERANNSQRALKAGEAVEKLIDKITSNKDNRVALVTYASTIFDGTEATVSKGVADQNGKALNDSVSWDYHKTTFTATTHNYSYLNLTNDANEVNILKSRIPKEAEHINGDRTLYQFGATFTQKALMKANEILETQSSNARKKLIFHVTDGVPTMSYAINFNPYISTSYQNQFNSFLNKIPDRSGILQEDFIINGDDYQIVKGDGESFKLFSDRKVPVTGGTTQAAYRVPQNQLSVMSNEGYAINSGYIYLYWRDYNWVYPFDPKTKKVSATKQIKTHGEPTTLYFNGNIRPKGYDIFTVGIGVNGDPGATPLEAEKFMQSISSKTENYTNVDDTNKIYDELNKYFKTIVEEKHSIVDGNVTDPMGEMIEFQLKNGQSFTHDDYVLVGNDGSQLKNGVALGGPNSDGGILKDVTVTYDKTSQTIKINHLNLGSGQKVVLTYDVRLKDNYISNKFYNTNNRTTLSPKSEKEPNTIRDFPIPKIRDVREFPVLTISNQKKMGEVEFIKVNKDKHSESLLGAKFQLQIEKDFSGYKQFVPEGSDVTTKNDGKIYFKALQDGNYKLYEISSPDGYIEVKTKPVVTFTIQNGEVTNLKADPNANKNQIGYLEGNGKHLITNTPKRPPGVFPKTGGIGTIVYILVGSTFMILTICSFRRKQL

SEQ ID NO: 315 - protein, 901 aa, S. agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEDYKKNQDGTFQKLKEEAFELSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIQNIIAVNKQISEYHEEGDKHLITNTHIPPKGIIPMTGGKGILSFILIGGAMMSIAGGIYIWKRYKKSSDMSIEKD

SEQ ID NO: 316 - protein, 901 aa, S. agalactiae; identical to SEQ ID NO: 16

SEQ ID NO: 317 - protein, 901 aa, S. agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPDDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQILQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPKTGGKGILSFILIGGAMMSIAGGIYIWKRYKKSSDMSIKKD

SEQ ID NO: 318 - protein, 901 aa, S. agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTYGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKGILSFILIGGAMMSIAGGIYIWKRYKKSSDMSIKKD

SEQ ID NO: 319 - protein, 901 aa, S. agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTFYRNGPVREHGTPTKLYINSLKQKNYDIFNFGIDISGFRQVYNEDYKKNQDGTFQKLKEEAFELSDGEITELMKSFSSKPEYYTPIVTSSDASNNEILSKIQQQFEKILTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEDPNTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGSMMSIAGGIYIWKRYKKSSDISREKD

SEQ ID NO: 320 - protein, 896 aa, S. agalactiae
MRKYQKFSKILTLSLFCLSQIPLNTNVLGESTVPENGAKGKLVVKKTDDQNKPLSKATFVLKPTSHSESKVEKVTAELTGEATFDNLTPGDYTLSEETAPEGYKKTTQTWQVKVESNGKTTIQNSDDKKSIIEQRQEELDKQYPLTGAYEDTKESYNLEHVKNSIPNGKLEAKAVNPYSSEGEHIREIQEGTLSKRISEVNDLDHNKYKIELTVSGKSIIKTINKDEPLDVVFVLDNSNSMKNNGKHNKAKKAAEALGTAVKDILGANSDNRVALVTYGSDIFDGRSVDVVKGFKEDPYYGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVKGSTYESQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSDGEITELMNSFSSKPEYYTPIVTSADVSNNEILSKIQQQFEKILTKENSIVNGTIEDPMGDKINLHLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEEPDTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGAMMSIAGGIYIWKRHKKSSDASIEKD

SEQ ID NO: 321 - protein, 901 aa, S. agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNHEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPRAKWGSTTNGLTPEQQKQYYLSKVGETFTMKAFMEADDILSQVDRNSQKIIVHITDGVPTRSYAINNFKLGASYESQFEQMKKNGYLNKSNFLLTDKPEDIKGNGESYFLFPLDSYQTQIISGNLQKLHYLDLNLNYPKGTIYRNGPVREHGTPTKLYINSLKQKNYDIFNFGIDISAFRQVYNEDYKKNQDGTFQKLKEEAFELSDGEITELMKSFSSKPEYYTPIVTSSDASNNEILSKIQQQFEKVLTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEDPNTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGSMMSIAGGIYIWKRYKKSSDISREKD

SEQ ID NO: 322 - protein, 237 aa, S. agalactiae
MIVRLIKLLDKLINVIVLCFFFLCLLIAALGIYDALTVYQGANATNYQQYKKKGVQFDDLLAINSDVMAWLTVKGTHIDYPIVQGENNLEYINKSVEGEYSLSGSVFLDYRNKVTFEDKYSLIYAHHMAGNVMFGELPNFRKKSFFNKHKEFSIETKTKQKLKINIFACIQTDAFDSLLFNPIDVDISSKNEFLNHIKQKSVQYREILTTNESRFVALSTCEDMTTDGRIIVIGQIQ

SEQ ID NO: 323 - protein, 241 aa, S. agalactiae; identical to SEQ ID NO: 68

SEQ ID NO: 324 - protein, 241 aa, S. agalactiae
MMMTIVQVINKAIDTLILIFCLVVLFLAGFGLWDSYHLYQQADASNFKKFKTAQQQPKFEDLLALNEDVIGWLNIPGTHIDYPLVQGKTNLEYINKAVDGSVAMSGSLFLDTRNHNDFTDDYSLIYGHHMAGNAMFGEIPKFLKKDFFNKHNKAIIETKERKKLTVTIFACLKTDAFDQLVFNPNAITNQDQQKQLVDYISKRSKQFKPVKLKHHTKFVAFSTCENFSTDNRVIVVGTIQE

SEQ ID NO: 325 - protein, 241 aa, S. agalactiae; identical to SEQ ID NO: 115

SEQ ID NO: 326 - protein, 241 aa, S. agalactiae
MMMTIVQVINKAIDTLILIFCLVVLFLAGFGLWDSYHLYQQADASNFKKFKTAQQQPKFEDLLALNEDVIGWLNIPGTHMDYPLVQGKTNLEYINKAVDGSVAMSGSLFLDTRNHNDFTDDYSLIYGHHMAGNAMFGEIPKFLKKDFFNKHNKAIIETKERKKLTVTIFACLKTDAFDQLVFNPNAITNQDQQRQLVDYISKRSKQFKPVKLKHHTKFVAFSTCENFSTDNRVIVVGTIQE

SEQ ID NO: 327 - protein, 241 aa, S. agalactiae; identical to SEQ ID NO: 247

SEQ ID NO: 328 - protein, 756 aa, S. agalactiae; identical to SEQ ID NO: 109

SEQ ID NO: 329 - protein, 523 aa, S. agalactiae
LQKRDKTNYGSANNKRRQTTIGLLKVFLTFVALIGIVGFSIRAFGAEEKSTETKKTSVIIRKYAEGDYSKLLEGATLRLTGEDIPDFQEKVFQSNGTGEKIELSNGTYTLTETSSPDGYKITEPIKFRVVNKKVFIVQKDGSQVENPNKELGSPYTIEAYNDFDEFGLLSTQNYAKFYYGKNYDGSSQIVYCFNANLKSPPDSEDHGATINPDFTTGDIRYSHIAGSDLIKYANTARDEDPQLFLKHVKKVIENGYHKKGQAIPYNGLTEAQFRAATQLAIYYFTDSVDLTKDRLKDFHGFGDMNDQTLGVAKKIVEYALSDEDSKLTNLDFFVPNNSKYQSLIGTEYHPDDLVDVIRMEDKKQEVIPVTHSLTVQKTVVGELGDKTKGFQFELELKDKTGQPIVNTLKTNNQDLVAKDGKYSFNLKHGDTIRIEGLPTGYSYTLKETEAKDYIVTVDNKVSQEAQSASENVTADKEVTFENRKDLVPPTGLTTDGAIYLWLLLLVPFGLLVWLFGRKGLKND

SEQ ID NO: 330 - protein, 744 aa, S. agalactiae; identical to SEQ ID NO: 57

SEQ ID NO: 331 - protein, 744 aa, S. agalactiae; identical to SEQ ID NO: 57

SEQ ID NO: 332 - protein, 556 aa, S. agalactiae
MQKRDKTNYGSANNKRRQTTIGLLKVFLTFVALIGIVGFSIRAFGAEEQSTFQNLLSAEYVPDTPPKPGEEPPAKTEKTETKKTSVIIRKYAEGDYSKLLEGATLKLAQIEGSGFQEQSFESSTSGQKLQLSDGTYILTETKSPDFNNQGYEIAEPITFKVTAGKVFIKGKDGQFVENQNKEVAEPYSVTAYNDFDDSGFINPKTFTPYGKFYYAKNANGTSQVVYCFNVDLHSPPDSLDKGETIDPDFNEGKEIKYTHILGADLFSYANNPRASTNDELLSQVKKVLEKGYRDDSTTYANLTSVEFRAATQLAIYYFTDSVDLDNLADYHGFGALTTEALNATKEIVAYAEDRANLPNISNLDFYVPNSNKYQSLIGTQYHPESLVDIIRMEDKQAPIIPITHKLTISKTVTGTIADKKKEFNFEIHLKSSDGQAISGTYPTNSGELTVTDGKATFTLKDGESLIVEGLPSGYSYEITETGASDYEVSVNGKNAPDGKATKASVKEDETITFENRKDLVPPTGLTTDGAIYLWLLLLVLLGLWVWLIGRKGLKND

SEQ ID NO: 333 - protein, 762 aa, S. agalactiae; identical to SEQ ID NO: 48

SEQ ID NO: 334 - protein, 698 aa, S. agalactiae; identical to SEQ ID NO: 107

SEQ ID NO: 335 - protein, 627 aa, S. agalactiae; identical to SEQ ID NO: 42

SEQ ID NO: 336 - protein, 655 aa, S. agalactiae
MTQKNSYKLSFLLSLTGFILGLLLVFIGLSGVSVGHAETRNGANKQGAFEIKKNKSQEEYNYEVYDNRNILQDGEHKLEIKRVDGTGKTYQGFCFQLTKNFPTAQGVSKKLYKKLSSSDEETLKQYASKYTSNRRGDTSGNLKKQIAKVLTEGYPTNKSDWLNGLTENEKIEVTQDAIWYFTETTVPADRSYTNRNVNSQKMKEVYQKLIDTTDIDKYEDVQFDLFVPQDTNLQAVISVEPVIESLPWTSLKPIAQKDITAKKQEISVTWTNQLVTDEKGMAYIYSVKEVDKNGELLEPKDYIKKEDGLTVTNTYVKPTSGHYDIEVTFGNGHIDITEDTTPDIVSGENQMKQIEGEDSKPIDEVTENNLIEFGKNTMPGEEDGTNSNKYEEVEDSRPVDTLSGLSSEQGQSGDMTIEEDSATHIKFSKRDIDGKELAGATMELRDSSGKTISTWISDGQVKDFYLMPGKYTFVETAAPDGYEIATAITFTVNEQGQVTVNGKATKGDAHIVMVDAYKPTKGSGQVIDIEEKLPDEQGHSGSTTEIEDSKSSDVIIGGQGQIVETTEDTQTGMHGDSGCKTEVEDTKLVQSFHFDNKESESNSEIPKKDKPKSNTSLPATGEKQHNMFFWMVTSCSLISSVFVISLKTKKRLSSC

SEQ ID NO: 337 - protein, 696 aa, S. agalactiae; identical to SEQ ID NO: 79

SEQ ID NO: 338 - protein, 733 aa, S. agalactiae; identical to SEQ ID NO: 71

SEQ ID NO: 339 - protein, 611 aa, S. agalactiae
MSSSDEETLKQYASKYTSNRRGDTSGNLKKQIAKVLTEGYPTNKSDWLNGLTENEKIEVTQDAIWYFTETTVPADRSYTNRNVNSQKMKEVYQKLIDTTDIDKYEDVQFDLFVPQDTNLQAVISVEPVIESLPWTSLKPIAQKDITAKKIWVDAPKEKPIIYFKLYRQLPGEKEVAVDDAELKQINSEGQQEISVTWTNQLVTDEKGMAYIYSVKEVDKNGELLEPKDYIKKEDQIEGEDSKPIDEVTENNLIEFGKNTMPGEEDGTNSNKYEEVEDSRPVDTLSGLSSEQGQSGDMTIEEDSATHIKFSKRDIDGKELAGATMELRDSSGKTISTWISDGQVKDFYLMPGKYTFVETAAPDGYEVATAITFTVNEQGQVTVNGKATKGDAHIVMVDAYKPTKGSGQVIDIEEKLPDEQGHSGSTTEIEDSKSSDVIIGGQGEVVDTTEDTQSGMTGHSGSTTEIEDSKSSDVIIGGQGEVVDTTEDTQSGMTGHSGSTTKIEDSKSSDVIVGGQGQIVETTEDTQTGMHGDSGRKTEVEDTKLVQSFHFDNKEPESNSEIPKKDKSKSNTSLPATGEKQHNKFFWMVTSCSLISSVFVISLKSKKRLSSC

SEQ ID NO: 340 - protein, 1161 aa, S. agalactiae; identical to SEQ ID NO: 121

SEQ ID NO: 341 - protein, 285 aa, S. agalactiae
MKKNKLLLATAILATALGTASLNQNVKAETAGVVSSGQLTIKKSITNFNDDTLLMPKTDYTFSVNPDSAATGTESNLPIKPGIAVNNQDIKVSYSNTDKTSGKEKQVVVDFMKTKEPIQFNNSFETTSLKIEKEVTGNTGDHKKAFTFTLTLQPNEYYEASSVVKIEENGQTKDVKIGEAYKFTLNDSQSVILSKLPVGINYKVEEAEANQGGYTTTATLKDGEKLSTYNLGQEHKTDKTADEIVVTNNRDTQVPTGVVGTLAPFAVLSIVAIGGVIYITKRKKA

SEQ ID NO: 342 - protein, 352 aa, S. agalactiae
LEREKMKKNKLLLATAILATALGTASLNQNVKAETAGVVTGKSLQVTKTMTYDDEEVLMPETAFTFTIEPDMTASGKEGSLDIKNGIVEGLDKQVTVKYKNTDKTSQKTKIAQFDFSKVKFPAIGVYRYMVSEKNDKKDGITYDDKKWTVDVYVGNKANNEEGFEVLYIVSKEGTSSTKKPIEFTNSIKTTSLKIEKQITGNAGDRKKSFNFTLTLQPSEYYKTGSVVKIEQDGSKKDVTIGTPYKFTLGHGKSVMLSKLPIGINYYLSEDEANKDGYTTTATLKEQGKEKSSDFTLSTQNQKTDESADEIVVTNKRDTQVPTGVVGTLAPFAVLSIVAIGGVIYITKRKKA

SEQ ID NO: 343 - protein, 344 aa, S. agalactiae; identical to SEQ ID NO: 59

SEQ ID NO: 344 - protein, 349 aa, S. agalactiae; identical to SEQ ID NO: 67

SEQ ID NO: 345 - protein, 344 aa, S. agalactiae; identical to SEQ ID NO: 75

SEQ ID NO: 346 - protein, 340 aa, S. agalactiae; identical to SEQ ID NO: 50

SEQ ID NO: 347 - protein, 183 aa, S. agalactiae; identical to SEQ ID NO: 61

SEQ ID NO: 348 - protein, 189 aa, S. agalactiae; identical to SEQ ID NO: 69

SEQ ID NO: 349 - protein, 189 aa, S. agalactiae; identical to SEQ ID NO: 117

SEQ ID NO: 350 - protein, 224 aa, S. agalactiae
LLFQRVKIFLLTIVLSLSVLFKNNERRRLLRKYWKMLFSVVMILTMLAFNQTVLAKDSTVQTSISVENVLERAGDSTPFSVALESIDAMKTIDEITIAGSGKASFSPLTFTTVGQYTYRVYQKPSQNKDYQADTTVFDVLVYVTYDEDGTLVAKVISRRAGDEEKSAITFKPKRLVKPIPPRQPNIPKTPLPLAGEVKSLLGILSIVLLGLLVLLYVKKLKSRL

SEQ ID NO: 351 - protein, 195 aa, S. agalactiae; identical to SEQ ID NO: 77

SEQ ID NO: 352 - protein, 1036 aa, S. agalactiae; identical to SEQ ID NO: 44

SEQ ID NO: 353 - protein, 1161 aa, S. agalactiae; identical to SEQ ID NO: 121

SEQ ID NO: 354 - protein, 611 aa, S. agalactiae; identical to SEQ ID NO: 339

SEQ ID NO: 355 - protein, 340 aa, S. agalactiae; identical to SEQ ID NO: 50

SEQ ID NO: 356 - protein, 467 aa, S. agalactiae
NRRETVREKILITAKKLMLACLAILAVVGLGMTRVSALSKDDTAQLKITNIEGGPTVTLYKIGEGVYNTNGDSFINFKYAEGVSLTETGPTSQEITTIANGINTGKIKPFSTENVSISNGTATYNARGASVYIALLTGATDGRTYNPILLAASYNGEGNLVTKNIDSKSNYLYGQTSVAKSSLPSITKKVTGTIDDVNKKTTSLGSVLSYSLTFELPSYTKEAVNKTVYVSDNMSEGLTFNFNSLTVEWKGKMANITEDGSVMVENTKIGIAKEVNNGFNLSFIYDSLESISPNISYKAVVNNKAIVGEEGNPNKAEFFYSNNPTKGNTYDNLDKKPDKGNGITSKEDSKIVYTYQIAFRKVDSVSKTPLIGAIFGVYDTSNKLIDIVTTNKNGYAISTQVSSGKYKIKELKAPKGYSLNTETYEITANWVTATVKTSANSKSTTYTSDKNKATDNSEQVGWLKNGI

SEQ ID NO: 357 - protein, 100 aa, S. agalactiae
MTRTNYQKKRMTCPVETEDITYRRKKIKGRRQAILAQFEPELVHHELIGDSCTCPDCHGTLTEIGSVVQRQELVFIPAQLKRINHVQHAYKCQTCSDNSL

SEQ ID NO: 358 - protein, 556 aa, S. agalactiae; identical to SEQ ID NO: 332

SEQ ID NO: 359 - protein, 301 aa, S. agalactiae
HIAGRDLFKYTVKPRDTDPDTFLKHIKKVIEKGYREKGQAIEYSGLTETQLRAATQLAIYYFTDSAELDKDKLKDYHGFGDMNDSTLAVAKILVEYAQDSNPPQLTDLDFFIPNNNKYQSLIGTQWHPEDLVDIIRMEDKKEVIPVTHNLTLRKTVTGLAGDRTKDFHFEIELKNNKQELLSQTVKTDKTNLEFKDGKATINLKHGESLTLQGLPEGYSYLVKETDSEGYKVKVNSQEVANATVSKTGITSDETLAFENNKEPVVPTGVDQKINGYLALIVIAGISLGIWGIHTIRIRKHD

SEQ ID NO: 360 - protein, 344 aa, S. agalactiae; identical to SEQ ID NO: 59

SEQ ID NO: 361 - protein, 349 aa, S. agalactiae; identical to SEQ ID NO: 67

SEQ ID NO: 362 - protein, 189 aa, S. agalactiae; identical to SEQ ID NO: 117

SEQ ID NO: 363 - protein, 117 aa, S. agalactiae
ITIAGSGKASFSPLTFTTVGQYTYRVYQKPSQNKDYQADTTVFDVLVYVTYDEDGTLVAKVISRRAGDEEKSAITFKPKRLVKPIPPRQPNIPKTPLPLAGEVKSLLGILSIVLLGL

SEQ ID NO: 364 - protein, 183 aa, S. agalactiae; identical to SEQ ID NO: 61

SEQ ID NO: 365 - protein, 467 aa, S. agalactiae; identical to SEQ ID NO: 356

SEQ ID NO: 366 - protein, 350 aa, S. agalactiae
EKEVAVDDAELKQINSEGQQEISVTWTNQLVTDEKGMAYIYSVKEVDKNGELLEPKDYIKKEDGLTVTNTYVKPTSGHYDIEVTFGNGHIDITEDTTPDIVSGENQMKQIEGEDSKPIDEVTENNLIEFGKNTMPGEEDGTNSNKYEEVEDSRPVDTLSGLSSEQGQSGDMTIEEDSATHIKFSKRDIDGKELAGATMELRDSSGKTISTWISDGQVKDFYLMPGKYTFVETAAPDGYEIATAITFTVNEQGQVTVNGKATKGDAHIVMVDAYKPTKGSGQVIDIEEKLPDEQGHSGSTTEIEDSKSSDVIIGGQGQIVETTEDTQTGMHGDSGCKTEVEDTKLVQSFHF

SEQ ID NO: 367 - protein, 655 aa, S. agalactiae; identical to SEQ ID NO: 336

SEQ ID NO: 368 - protein, 611 aa, S. agalactiae; identical to SEQ ID NO: 339

SEQ ID NO: 369 - protein, 396 aa, S. agalactiae
EKEVAVDDAELKQINSEGQQEISVTWTNQLVTDEKGMAYIYSVKEVDKNGELLEPKDYIKKEDGLTVTNTYVKPTSGHYDIEVTFGNGHIDITEDTTPDIVSGENQMKQIEGEDSKPIDEVTENNLIEFGKNTMPGEEDGTNSNKYEEVEDSRPVDTLSGLSSEQGQSGDMTIEEDSATHIKFSKRDIDGKELAGATMELRDSSGKTISTWISDGQVKDFYLMPGKYTFVETAAPDGYEVATAITFTVNEQGQVTVNGKATKGDAHIVMVDAYKPTKGSGQVIDIEEKLPDEQGHSGSTTEIEDSKSSDVIIGGQGEVVDTTEDTQSGMTGHSGSTTKIEDSKSSDVIVGGQGQIVETTEDTQTGMHGDSGRKTEVEDTKLVQSFHFDNKEPESNS

SEQ ID NO: 370 - protein, 334 aa, S. agalactiae
ATALGTASLNQNVKAETAGVVTGKSLQVTKTMTYDDEEVLMPETAFTFTIEPDMTASGKEGSLDIKNGIVEGLDKQVTVKYKNTDKTSQKTKIAQFDFSKVKFPAIGVYRYMVSEKNDKKDGITYDDKKWTVDVYVGNKANNEEGFEVLYIVSKEGTSSTKKPIEFTNSIKTTSLKIEKQITGNAGDRKKSFNFTLTLQPSEYYKTGSVVKIEQDGSKKDVTIGTPYKFTLGHGKSVMLSKLPIGINYYLSEDEANKDGYTTTATLKEQGKEKSSDFTLSTQNQKTDESADEIVVTNKRDTQVPTGVVGTLAPFAVLSIVAIGGVIYITKRKKA

SEQ ID NO: 371 - protein, 285 aa, S. agalactiae; identical to SEQ ID NO: 341

SEQ ID NO: 372 - protein, 1161 aa, S. agalactiae; identical to SEQ ID NO: 121

SEQ ID NO: 373 - protein, 344 aa, S. agalactiae; identical to SEQ ID NO: 59

SEQ ID NO: 374 - protein, 349 aa, S. agalactiae; identical to SEQ ID NO: 67

SEQ ID NO: 375 - protein, 340 aa, S. agalactiae
VWYYSDNAPISNPDESFKRESESNLVSTSQLSLMRQALKQLIDPNLATKMPKQVPDDFQLSIFESEDKGDKYNKGYQNLLSGGLVPTKPPTPGDPPMPPNQPQTTSVLIRKYAIGDYSKLLEGATLQLTGDNVNSFQARVFSSNDIGERIELSDGTYTLTELNSPAGYSIAEPITFKVEAGKVYTIIDGKQIENPNKEIVEPYSVEAYNDFEEFSVLTTQNYAKFYYAKNKNGSSQVVYCFNADLKSPPDSEDGGKTMTPDFTTGEVKYTHIAGRDLFKYTVKPRDTDPDTFLKHIKKVIEKGYREKGQAIEYSGLTETQLRAATQLAIYYFTDSAELDK

SEQ ID NO: 376 - protein, 340 aa, S. agalactiae; identical to SEQ ID NO: 50

SEQ ID NO: 377 - protein, 384 aa, S. agalactiae
PKNANGYMDKIEPLNAILVTQQAVWYYSDSSYGNIKTLWASELKDGKIDFEQVKLMREAYSKLISDDLEETSKNKLPQGSKLNIFVPQDKSVQNLLSAEYVPESPPAPGQSPEPPVQTKKTSVIIRKYAEGDYSKLLEGATLRLTGEDILDFQEKVFQSNGTGEKIELSNGTYTLTETSSPDGYKIAEPIKFRVVNKKVFIVQKDGSQVENPNKEVAEPYSVEAYSDMQDSNYINPETFTPYGKFYYAKNKDKSSQVVYCFNADLHSPPESEDGGGTIDPDISTMKEVKYTHTAGSDLFKYALRPRDTNPEDFLKHIKKVIEKGYNKKGDSYNGLTETQFRAATQLAIYYFTDSTDLKTLKTYNNGKGYHGFESMDEKTLAVTK

SEQ ID NO: 378 - protein, 1036 aa, S. agalactiae; identical to SEQ ID NO: 44

SEQ ID NO: 379 - protein, 174 aa, S. agalactiae
TASINIEVINQVDVATNKQSSDIDETFMFVIEALDKESPLPNSVTTSVKGNGKTSFEQLTFSEVGQYHYKIHQLLGKNSQYHYDETVYEVVIYVLYNEQSGALETNLVSNKLGETEKSELIFKQEYSEKTPEPHQPDTTEKEKPQKKRNGILPSTGEMVSYVSALGIVLVATIT

SEQ ID NO: 380 - protein, 344 aa, S. agalactiae; identical to SEQ ID NO: 75

SEQ ID NO: 381 - protein, 215 aa, S. agalactiae; identical to SEQ ID NO: 52

SEQ ID NO: 382 - protein, 195 aa, S. agalactiae; identical to SEQ ID NO: 77

SEQ ID NO: 383 - protein, 189 aa, S. agalactiae; identical to SEQ ID NO: 69

SEQ ID NO: 384 - protein, 189 aa, S. agalactiae; identical to SEQ ID NO: 117

SEQ ID NO: 385 - protein, 183 aa, S. agalactiae; identical to SEQ ID NO: 61

SEQ ID NO: 386 - protein, 180 aa, S. agalactiae
LMPKADYTFKVEADDNAKGKTKDGLDIKPGVIDGLENTKTIHYGNSDKTTAKEKSVNFDFANVKFPGVGVYRYTVSEVNGNKAGIAYDSQQWTVDVYVVNREDGGFEAKYIVSTEGGQSDKKPVLFKNFFDTTSLKVTKKVTGNTGEHQRSFSFTLLLTPNECFEKGQVVNILQGGETKK

SEQ ID NO: 387 - protein, 340 aa, S. agalactiae; identical to SEQ ID NO: 50

SEQ ID NO: 388 - protein, 178 aa, S. agalactiae
SVNPDSAATGTESNLPIKPGIAVNNQDIKVSYSNTDKTSGKEKQVVVDFMKVTFPSVGIYRYVVTENKGTAEGVTYDDTKWLVDVYVGNNEKGGLEPKYIVSKKGDSATKEPIQFNNSFETTSLKIEKEVTGNTGDHKKAFTFTLTLQPNEYYEASSVVKIEENGQTKDVKIGEAYKF

SEQ ID NO: 389 - protein, 627 aa, S. agalactiae; identical to SEQ ID NO: 42

SEQ ID NO: 390 - protein, 109 aa, S. agalactiae
IETEDTKEPEVLMGGQSESVEFTKDTQTGMSGFSETATVVEDTRPKLVFHFDNNEPKVEENREKPTKNITPILPATGDIENVLAFLGILILSVLSIFSLLKNKQSNKKV

SEQ ID NO: 391 - protein, 98 aa, S. agalactiae
VLMGGQSESVEFTKDTQTGMSGFSETVTIVEDTRPKLVFHFDNNEPKVEENREKPTKNITPILPATGDIENVLAFLGILILSVLSIFSLLKNKQNNKV

SEQ ID NO: 392 - protein, 10 aa, S. pyogenes
PKEKPIIYFK

SEQ ID NO: 393 - protein, 12 aa, S. pyogenes
YTFVETAAPDGY

SEQ ID NO: 394 - protein, 10 aa, S. pyogenes
PKEKPIIYFK

SEQ ID NO: 395 - protein, 12 aa, S. pyogenes
YTFVETAAPDGY

SEQ ID NO: 396 - protein, 10 aa, S. pyogenes
PKEKPIIYFK

SEQ ID NO: 397 - protein, 12 aa, S. pyogenes
YTFVETAAPDGY

SEQ ID NO: 398 - protein, 10 aa, S. pyogenes
PKEKPIIYFK

SEQ ID NO: 399 - protein, 12 aa, S. pyogenes
YTFVETAAPDGY

SEQ ID NO: 400 - protein, 10 aa, S. pyogenes
PKGISQDIPK

SEQ ID NO: 401 - protein, 10 aa, S. pyogenes
PKGYQQVTEK

SEQ ID NO: 402 - protein, 11 aa, S. pyogenes
PKMSVVSKYGK

SEQ ID NO: 403 - protein, 11 aa, S. pyogenes
PKYDAKNQEYK

SEQ ID NO: 404 - protein, 12 aa, S. pyogenes
YDLYETKAPKGY

SEQ ID NO: 405 - protein, 12 aa, S. pyogenes
YTFVETAAPDGY

SEQ ID NO: 406 - DNA, 17172 bp, S. pneumoniae
gacaagcttccttatacgaccgctttctatatcggactcttccaagttcttgctcttttaccagggactagccgttcaggtgcaacgattgtcggtggtttgttaaatggaaccagtcgttcagttgtgacagaatttaccttctatcttgggattcccgttatgtttggagctagtgccttaaagattttcaaatttgtgaaagccggagaactcttgagctttgggcaattgtttttgctcttggtcgcgatgggagtagcttttgcggtcagcatggtggctattcgcttcttgaccagctatgtgaaaaaacacgacttcaccctttttggtaaataccgtatcgtgcttggtagtgttttgctactttacagttttgtccgtttatttgtataagaaaaaccttgaaggggtaactcttcaaggttttatactcttagaaaatctcttcaaaccgcgtcagctttatctgcaacctcaaaacagtgttttgagcagcctgcggctagcttcctagtttgctctttgattttcattgagctttaaaatccagtcagggtaatccccaataggcggacacctctttctttctcgcttaattcttcatagagttgcagggctatttggcttatctgactagcatcttgtgttttttggcaagactttttcgtttggtaagagttgaaaagtcctcgtagcggattttcaaaatgacaatttttccagctttttcttgttgatgtagattgagagcgactttttctgatagaagagtcagctcttttttgatatcttcctcggcacggagaatcttcccgtaggttttctccttgccgattgatttacggatgcgattggatttgactggagagttgtgaatgccacgagcctttcgatacagatcatagcctagtctaccaaaacggtctattagggttacctcaggaacttcaagtaaatcagcaccagtaaaaacgcccatttgatgaagacgttctactgtcttttttcctactccatgaaatttggaaatatccatttgtttgagaaaatcctcagcctgttcaggtagaatcactgtcaaaccatgtggtttttgataatcactcgccattttagctaagaatttgttgtaagaaacgcctgcggaagcagttagatggagttctttccagatatctttttgaatgaggcgagcaattttgaccgctgacttgataccgagtttattttctgtcacatccaaataggcttcgtcaatgctcatgggttcaatcaaatctgtatagcgcttaaaaatagctcgaatccggagtcccacagacttgtatttctcataattccctgagataaagacagcctggggacaacgttcataagcttccttggaactcatggcagaatggacaccaaaagctcttgcctcataactacaggtagaaacgactccccgtccacctgtttgccgagggtcgcttccaataatgacaggttttcctctgagtttaggattatccctgatttccactgcagcaaaaaaggcatccatgtcaatatggatgatttttcttgacaaatcatttaacaaaggaaaaatcaacatgcctagcacctttttatactcttcgaaaatctcttcaaaccacgtcagcttccatctgcaacctcaaaacagtattttgagctgacttcgtcagttctatttacaacctcaaagcagtgctttgagcagcctgcggctagtttcctagtttgcttttcgatttccattgagtgtaactgcttattttcttttattatacccttttttctgaaaaaaagaaaaaaggactttatttttttcaaaaatataatacagtttgaaataaaatatagactgttttagaaaagaaagtgtaaaaataggaatttttcacttgttgaaatcggttactttatggtatacttgtctcatgaatgtaacagatgactgttactagaaaaaagaggacattaatatggttgttaagacagttgttgaagcacaagatatttttgacaaagcttgggaaggcttcaaaggcgtagattggaaagaaaaagcaagtgtatcacgctttgtacaagctaactacacaccttatgatggagacgaaagcttccttgcaggaccaacagagcgttcacttcacatcaagaaaattgtagaagaaactaaagcacactacgaagaaactcgtttcccaatggacactcgtccaacatctatcgctgatatccctgctggatttatcgacaaagaaaatgaagttatctttggtatccaaaatgatgaactcttcaaattgaacttcatgccaaaaggtggtatccgtatggctgaaactactttaaaagaaaatggatacgaaccagacccagctgttcacgaaatcttcactaaatatgtaacaacagttaacgacggtattttccgtgcctacacttcaaatattcgtcgcgctcgtcatgcacacactgtaactggtcttccagatgcatactcacgcggacgtatcatcggtgtttacgcacgtcttgctctttacggtgcagactacttgatgcaagaaaaagtaaacgactggaatgcaatcaaagaaatcgatgaagaaacaatccgtcttcgtgaagaagtaaaccttcaataccaagcattgcaacaagttgttcgcctgggtgacctttacggggttgatgttcgcaaaccagcgatgaacgtgaaagaagcaatccaatgggttaacattgctttcatggctgtctgccgtgtgattaacggtgctgctacatctctaggtcgtgtaccaatcgtattggacatctttgcagaacgtgaccttgctcgtggtacatttactgaatcagaaatccaagaattcgttgatgatttcgttatgaaacttcgtacagttaaatttgctcgtaccaaagcttatgaccaattgtactcaggtgacccaacctttatcacaacttctatggctggtatgggtaacgacggtcgtcaccgtgttactaagatggactaccgtttcttgaacactcttgacaacatcggtaactcaccagaaccaaacttgacagttctttggactgacaaattgccatacaacttccgtcgctactgtatgcacatgagccacaaacactcttctatccaatacgaaggtgtaacaacaatggctaaagacggatatggtgaaatgagctgtatctcatgctgtgtgtctccacttgatccagaaaatgaagaacaacgccacaacatccagtacttcggtgctcgtgtaaacgttcttaaagcccttcttactggtttgaatggtggttacgacgatgttcacaaagactacaaagtatttgatatcgaaccaatccgtgacgaagttcttgaatttgaatcagttaaagcgaactttgaaaaatctcttgactggttgactgacacttacgtagatgccttgaacatcatccactacatgactgataggtacaactacgaagctgttcaaatggccttcttgccaactaaacaacgtgccaacatgggattcggtatctgtggatttgctaacactgttgatacattgtcagctatcaaatacgctacagttaaaccaatccgtgacgaagatggctacatctacgattacgaaacaatcggtgactacccacgctggggtgaagatgacccacgttcaaacgaattggcagaatggttgatcgaagcttacacaactcgtctacgtagccacaaactatacaaagacgcagaagctacagtatcacttttgacaatcacatctaacgttgcttactctaaacaaactggtaactcaccagttcacaaaggtgtatacctcaacgaagatggttctgtgaacttgtctaaacttgaattcttctcaccaggtgctaacccatctaacaaagctagacacttgaacagatttgaacttaagaagagtggtccacgattgggtagattgtttcgataaggtggttggttgcaaaacttgaactcactttctagccttgactttagttatgcagctgacggtatctcattgactacacaagtatcacctcgcgctcttggtaagactcgtgatgaacaagttgataacttggtaacaatccttgatggttacttcgaaaacggtggacaacacgttaacttgaacgttatggacttgaacgatgtttacgaaaaaatcatgtcaggcgaagacgttatcgtacgtatctctggatactgtgtaaacactaaatacctcactccagaacaaaaaactgaattgacacaacgtgtcttccacgaagttctttcaatggatgacgccttggatgcattgagctaatcaagttcttgaataataaaaagggctctttgtcaactgtagtgggttgaagaaaagctaagctcgagaaaggacaaattttgtcctttcttttttgatgttcagagcgatgaaaatccgttttttgaagttttcaaagttccgaaaaccaaaggcattgcgcttgatgtctttgatgagtttgttagtggcctcaagtttagcgttagaataaggcaattcaatggcgttagtgatgtagtttttatagcaaataaatgtgctcaaagtggttttaaaggtgcggttgagatgaggtaacgtgtcttgaattaagccccaaaactggtcagtattcttctcttgtagatgaaataggagtagttgatacaggtcatagtaatctttaagttcaggtactagagtaaagattttcttcagacactccctaggagttaaggtctctctgaaagttctagcatagaaaggcttaagagagagtttccgactatcttttaggataaatttccagtaatatttaagagctctgtattccagagatttatcatcaaattgcttcatgatgttgattctagtctgattaagagccctgctcatgtgttggacaatgtggaaacgatcgagaacaattttagcattgggaaataatttcttaatgagagggatataacttccagacatatcaacagtgacgactttaactttttttctagcttctttcgagtacttgaagaaatgatttcggatggttgtttgacgtctgttatcaagaatggtcatgattttcttagtgttgaaatcctgagcaatgaaagccaatttccccttctggtaggagaattcatcccaggagaggatttcaggcaaagtggtgtaatcctcttggaaatgaaattgcttgagcttacgatagacggtagaggtagaggtagagatggctaatttagaagcgatatgtgtaagagcctctctgttgagtaggagttgggcaattttctgtctcaccatttccgagatttggcaatttttctgaacgagagttgtttcagctacagtgactttccgacaggacttgcattgaaatcgtctctttttcaaatgaatgaggctagggaaaccaccaatctcgataaaagggattttagaaggcttttggaagtcgtatttgatttgttttcctttacagtgtttacatttaggtgggtgataatcaagtgtagcgaagacttcgatatgggtatcgtgctgaatggctttatttaaggtgatgtttttgtcttttattccgatgagtaatgtggtatgattgatgtgttccataagatactttctaatgagttgtttaggcgcttttcattataagtcttatgggacttttttgatactcaaaaagccctataatctccacagtgggatttacccactacagaaattatagagccagaaaaaacacttttgttcactagcagaaactagagagcagaagtgtttttctgttcagatttacccaaaactgggaaatatggggataagaatagagatggcttaggaagcccctttttgtgtgtagacagtacgatgaacttataacaaatagtgagcctttttagcaatcattgcgacccgtttgtcaaaagcctcttttcggatatctacaattgtctgatagatgagacgctgttggctaacatgcaaatctaaggcaatcgtcaaaaagtgatgtttccctttgggatactgctttttaacgtaaggcaggtattctttcgttgtaataataatcaatggctctgtcaaatgctcctctgaaggaggaggactaattagaatattgtatcctgtaacagaggcaactttgtcagtaaaattccgtaaaataatggactttattaagtttacatctgcttgattatttaaaatgataaaaatcgggatagcaggtagtgaggaaaagatggtttctgtcaagtagagtgagaaaaggtacagccgatgctggtcgataactccttcaatcttctgctcagtcatccactcttgaacaattgctttcgaaatatgatacagtggcttgtcgctttcaatcccataatgttcgtaataattataatagggaactagattttgtaaaccaaacaaaaacgttcttgttaagaaagtcagtgctgttaaaaaagaaagagaattcgaaatgtcatttcctaagatattcttgaacttggatagtagatgctttcctcttgtatgctgaagaatcagttgaatagtatgagtctttttttcttgattccatttgtccttggaaaacgaagaattagcagaacaataaaccaaaaagatataatccagttcttcctgagtaaaagtcatgttggcatgtggctctaagtaagtttggcaatgttccatcaaaatcggatacataaagaggttttttaatttttcaaactctttggactcagggaactcaagtggaaattcccgacgtttccaagtgagtgccactagtatgctaaaatgaacatactcgtcaggtgtgatttctaacagttcatgactgagttgagaattagactgcacaatcatatgtgtgacccaatccatacttccatcattcaaatcataaatctcaataccaaaatgaaactggaggagtgcaattaaaaaacgaatgcgatattcaggaccaactacttgatttttcacaaggtccaaacctactgaacgtagtaacaagccacacttttgtcgtacgcggtagcctgttgcgatggaaatatactctttttgtgtaaattcgttaaagctttgattaccttgtagtagaaagaagcggagtatttttaaaatagttgattggttataaagctgatggaagtaataattcgtttgatgagaatggtgttcgattaattgaacttgttgcgtatctaaattaaatgtcaactcttcctcgaatgtttcttgtaattcctgcaaaatgcttaggagacttttagattgtaatgaagttaaagtagacagttcatctagttcaatagaccgaatatccaataatatatttaaaatggtaattttatctgtaattcttttttcaatgtatttgtttagcatagttaccgaatcttagttgcatatagataattttaattattataatacaaaagaaactaattgtcttgtcaaaaaggttgtggaatttccgactttattgataaaacagcatgtaataaaaggcattttaaagatagtaatgagtattggtggagttttatggcttattttttttattagaccgtaaaatttctatcattactcataaccacctcaaaataccgaataaaaaaaataatctaaatatttttttatcaaatattgtcgttctataaaaaaatatgtgataaaaatatctattgtgatggaagttgttttaatttatactaggatagttaatagtaatactatactatactatattgtatacaagtgtgtcattgccaggttgagaagatagctataacgcacttttatacgcttttgctacgtttgttagtgaacggattaactcagtgagataaattttatcagaacataagtaatccgtttcttcgtgtatacagattgaaagtacctatgaatcatagaaggattaacttgttctatgaataatgcttaacagggagacacacatgaaaaaagtaagaaagatatttcagaaggcagttgcaggactgtgctgtatatctcagttgacagctttttcttcgatagttgctttagcagaaacgcctgaaaccagtccagcgataggaaaagtagtgattaaggagacaggcgaaggaggagcgcttctaggagatgccgtctttgagttgaaaaacaatacggatggcacaactgtttcgcaaaggacagaggcgcaaacaggagaagcgatattttcaaacataaaacctgggacatacaccttgacagaagcccaacctccagttggttataaaccctctactaaacaatggactgttgaagttgagaagaatggtcggacgactgtccaaggtgaacaggtagaaaatcgagaagaggctctatctgaccagtatccacaaacagggacttatccagatgttcaaacaccttatcagattattaaggtagatggttcggaaaaaaacggacagcacaaggcgttgaatccgaatccatatgaacgtgtgattccagaaggtacactttcaaagagaatttatcaagtgaataatttggatgataaccaatatggaatcgagttgacggttagtggtaaaacgacggttgaaacgaaagaagcctctactccgctagatgttgttattctattagataactccaatagtatgagtaatattcgacataatcatgcccatcgagcggaaaaagcgggagaagcgacacgagcccttgtagataagattacctccaatccagataatcgagtagcacttgtgacttatggctcaactatctttgacggttcagaagctactgtggaaaaaggggtagcagatgcgaacggaaaaatattgaatgactcagctttatggacgttcgatcgtacgacgtttacagctaaaacttataattatagctttttaaatctcacatcagatcctactgatattcaaactattaaggataggattccatcagatgcagaggaattgaacaaagacaaattgatgtatcaattcggcgcgacttttacccagaaggctttgatgaccgctgatgatatcttgacaaagcaggcaagaccaaacagtaaaaaggttattttccacattacagatggtgttccgactatgtcatatccaattaattttaaatatacaggaacgacgcaatcgtacagaactcagctgaataattttaaagcaaaaactccaaatagtagcgggatattactggaggactttgttacatggtcagcagatggtgaacataagattgttcgtggagatggtgaaagttatcagatgtttacgaagaaacctgtaacagaccaatacggagttcatcaaatactttcaatcacctccatggagcagagagctaaattagtttcagcgggatataggttctatggaactgacttgtatttatattggcgtgatagtattctagcctatccatttaactctagtaccgattggattaccaaccatggtgaccctacgacttggtattataacggaaatatggctcaggatggctatgatgtcttcactgttggggttggtgtaaacggggatcctggtacggatgaagcaacggctactagatttatgcagagcatctctagttctcctgacaactacactaacgtagcagatccatctcagattttacaagaattgaatcgctacttctatactatcgtcaatgagaagaaatctatcgaaaatggtacgattacagacccgatgggtgaactaattgatttccaattgggagcagatggaaggtttgatccagcggattacactttaactgcaaacgatggtagttcgttggtgaataatgtccctactgggggaccacaaaatgatggtggcttgctaaaaaatgcaaaagtgttctatgatacgactgagaaaaggattcgtgtaacaggtttgtaccttggaacgggtgaaaaagttacattgacttataatgttcgcttgaatgaccaatttgtaagcaataaattctatgacacgaatggtcgaacaaccctacaccctaaggaagtagaaaagaacacagtgcgcgacttcccgattcctaagattcgtgatgtacgaaagtatccagaaatcacaattccaaaagagaaaaaacttggtgaaattgagtttattaagatcaataagaatgataaaaaaccactgagagatgcggtctttagtcttcaaaaacaacatccggattatccagatatttatggagctattgatcaaaatggcacttatcaaaatgtgagaacaggtgaagatggtaagttgacctttaaaaatctgtcagatgggaaatatcgattatttgaaaattctgaaccagctggttataaacccgttcaaaataagcctatcgttgccttccaaatagtaaatggagaagtcagagatgtgacttcaatcgttccacaagatataccagcgggttacgagtttacgaatgataagcactatatcacaaatgagccaattcctccaaaaagagaatatcctcgaactggtggtatcggaatgttgccattctatctgataggttgcatgatgatgggaggagttctattatacacacggaaacatccgtaaagtgtagcaatgagaaatgataatatcgatactctgagcgatacttttaagaagtagcactcaagaagagatttaagtttacttggtgaaaacagttttcttcgccaagtaaaccaccattgaaaggggagatgttttcgaaaacttgcacagaaaaaaggattattattgtcatgtgtaattcattacattgctcacagttgattttaagagatatgaataaggagaaatcatgaaatcaatcaacaaatttttaacaatgcttgctgccttattactgacagcgagtagcctgttttcagctgcaacagtttttgcggcggacaatgttagtacagcaccagatgctgttactaaaactttaacaatccataagttactgctctcagaagatgatttaaagacttgggatacaaacggtcctaaaggatatgatggaactcaatctagtttaaaagatttaactggagttgtagctgaggaaattccaaatgtatactttgaattacaaaagtataatttgactgatggtaaggaaaaagaaaatcttaaagatgatagtaaatggacaacagttcatggtggtttgacaactaaagatggacttaaaattgaaaccagtactcttaaaggtgtgtatcgtattcgtgaggatagaacaaagactacctatgttggtcctaatgggcaagtattaacaggttcaaaagccgtacctgctcttgtaactcttccacttgttaacaataatggtacagtaattgatgcacatgttttccctaaaaattcatataataaaccagttgtagataaaagaattgctgatactttgaattataacgatcaaaatggtctgtctatcggtactaaaatcccatatgttgttaatacaacaattccaagtaatgcaacatttgcaacttcattttggtcagatgaaatgacagaaggtctaacttataatgaagatgtaacaattactttgaataatgtagctatggatcaagctgattatgaagtcactaaaggaaataatggctttaacttaaaattaacagaagcaggtttagctaaaattaatggtaaggatgcagaccaaaaaatccaaattacttactcagctactttgaactcacttgctgttgcagacattcctgaaagtaacgatattacatatcattacggaaatcatcaagatcatgggaatactccaaaaccaactaaacctaataatggtcaaattacagtaactaagacatgggacagtcaacctgctcctgagggggtgaaagcgactgttcaacttgtaaatgccaagactggtgagaaagtcggtgctcctgtagaactttcagaaaataattggacatatacttggagtggtctagataattctattgaatacaaagttgaagaagaatataatggatactcagctgaatacacagtagagagcaaagggaagttgggggtaaaaaactggaaagataataacccagctccaatcaatcctgaagaaccacgtgtaaaaacatacggtaaaaagtttgtcaaagtagaccaaaaagatactcgtctagaaaatgcgcagttcgttgttaaaaaagcagatagcaataaatatattgcctttaagtcaactgcacaacaagctgcagatgaaaaagcagcagcaactgcaaaacaaaaattggatgcagcggtagcagcttacacaaatgctgcagataagcaagccgctcaagctctagtagatcaagcacagcaagaatacaatgtagcttacaaagaagccaaatttggttatgttgaagtagctggaaaagatgaagcaatggttcttacttctaatacggatggtcaattccaaatttcaggtcttgctgctggtacttataaattagaagaaattaaagctccagaaggttttgcgaaaattgatgatgtagaatttgttgttggagcaggttcttggaatcaaggtgagtttaattacttaaaagatgttcaaaagaatgacgctacaaaagtagtcaacaaaaaaatcactatcccacaaacgggtggtattggtacaattatctttgctgtagcgggggctgcgattatgggtattgcagtgtacgcatatgttaaaaacaacaaagatgaggatcaacttgcttaagtaagagagaaaggagccattgatgacaatgcagaaaatgcagaaaatgattagtcgtatcttctttgttatggctctgtgtttttctcttgtatggggtgcacatgcagtccaagcgcaagaagatcacacgttggtcttgcaattggagaactatcaggaggtggttagtcaattgccatctcgtgatggtcatcggttgcaagtatggaagttggatgattcgtattcctatgatgatcgggtgcaaattgtaagagacttgcattcgtgggatgagaataaactttcttctttcaaaaagacttcgtttgagatgaccttccttgagaatcagattgaagtatctcatattccaaatggtctttactatgttcgctctattatccagacggatgcggtttcttatccagctgaatttctttttgaaatgacagatcaaacggtagagcctttggtcattgtagcgaaaaaaacagatacaatgacaacaaaggtgaagctgataaaggtggatcaagaccacaatcgcttggagggtgtcggctttaaattggtatcagtagcaagagatggttctgaaaaagaggttcccttgattggagaataccgttacagttcttctggtcaagtagggagaactctctatactgataaaaatggagagatttttgtgacaaatcttcctcttgggaactatcgtttcaaggaggtggagccactggcaggctatgctgttacgacgctggatacggatgtccagctggtagatcatcagctggtgacgattacggttgtcaatcagaaattaccacgtggcaatgttgactttatgaaggtggatggtcggaccaatacctctcttcaaggggcaatgttcaaagtcatgaaagaagaaagcggacactatactcctgttcttcaaaatggtaaggaagtagttgtaacatcagggaaagatggtcgtttccgagtggaaggtctagagtatgggacatactatttatgggagctccaagctccaactggttatgttcaattaacatcgcctgtttcctttacaatcgggaaagatactcgtaaggaactggtaacagtggttaaaaataacaagcgaccacggattgatgtgccagatacaggggaagaaaccttgtatatcttgatgcttgttgccattttgttgtttggtagtggttattatcttacgaaaaaaccaaataactgatattcaatgtacatcattatgaaaaagatagcaggctgaagggaagaccagagtactctgaggtgatgttaatcaggaatcatggtgatgtggcatgaatcacaataacggatatgaggctgggcagattgtgccagcctcattgtgggttattgtttgtaaaacgataggactggtctggtaatcattttaggaatggacaggactgggattctgatttaaaatggatggtgaatcagaaagaaatgagattttctcgtttctcttagcagataggattgtctgttaggaaaagcgataaaatgatgagtttgaagataaagggatgctgataaaaatggtaaaaacaaaaaagcaaaaacgaaataatctcctattaggagtggtatttttcattggaatggcggtaatggcgtatccgctggtgtctcgcttgtattatcgagtggaatcaaatcaacaaattgctgactttgataaggaaaaagcaacgttggatgaggctgacattgatgaacgaatgaaattggcacaagccttcaatgactctttgaataatgtagtgagtggcgatccttggtcggaagaaatgaagaaaaaagggcgagcagagtatgcacgtatgttagaaatccatgagcggatggggcatgtggaaatccccgttattgacgtggatttgccggtttatgctggtactgctgaagaggtattgcagcaaggggctgggcatctagagggaacttctctgccgatcggaggcaattcgacccatgcggtgattacggcacatacaggtttgccaacagctaagatgtttacggatttgaccaaacttaaagttggggataagttttatgtgcacaatatcaaggaagtgatggcctatcaagtggatcaagtaaaggtgattgagccgacgaactttgatgatttattgattgtaccaggtcatgattatgtgaccttgctgacttgtacgccatacatgatcaatacccatcgtctattggttcgggggcatcggataccgtacgtagcagaggttgaggaagaatttattgcagcaaacaaactcagtcatctctatcgctacctgttttatgtggcagttggtttgattgtgattcttttatggattattcgacgcttgcgcaagaagaaaaaacaaccggaaaaggctttgaaggcgctgaaagcagcaaggaaggaagtgaaggtggaggatggacaacagtagacgttcacgaaaaaaaggcacaaaaaagaagaaacatccgctgatccttcttctgattttcttagtaggattcgccgttgcgatatatccattggtgtctcgttattattatcgtattgagtcaaacgaggttattaaagagtttgatgagacggtttcccagatggataaggcagaacttgaggagcgttggcgcttggctcaagccttcaatgcgaccttgaaaccatctgaaattcttgatccttttacagagcaagagaaaaagaaaggcgtctcagaatatgccaatatgctaaaggtccatgagcggattggctatgtggaaattcctgcgattgatcaggaaattccgatgtatgtcggaacgagtgaggaaattcttcagaagggcgcaggattgctagagggagcttcgttaccggttggtggtgaaaatacccacacagttgtcactgctcatagaggattaccgacggcagaactgtttagtcaattggataagatgaaaaaaggggatgtcttttatcttcacgttttagaccaggtgttggcctaccaagtggatcagattttgacggttgagccaaatgactttgagcctgtcttgattcaacatggggaagattatgcgaccttgttgacctgtacaccgtatatgattaacagtcatcgtctgttggtacgtgggaagcggattccgtatacggcaccaattgcagagcgaaatcgagcggtgagagagcgtgggcaattctggttgtggttattgctagcggcgttggttatgattctggtattgagttacggggtgtatcgtcatcgtcgcattgtcaaagggctagaaaaacaattggaggagcatcatgtcaaaggctaagctacagaaattactagggcagtctttaggacaagtaaaaggtcatgagatattttcagaatctgtgacggccgacagttaccaagagcaattgcaacggtcgcttgattacaatcaacgcttggattcgcaaaatcgtattgtagatccttttttggcggaagggtatgaggtaaattaccaagtgtctgacgatcctgatgcagtctacggctatttgtcgattccgagtttggaaatcatggagccagtttatctaggagcggattaccatcatttagcaatggggttggcccatgtggatgggacgcctcttcctgttgagggaaaagggattcgttcagtgattgctgggcaccgtgcagaaccaagccatgtctttttccgccatttggatcagctaaaagttggagatgctctttattatgataatggccaggaaattgtagaatatcagatgatggacacagagattattttaccgtcggaatgggaaaaattagaatcggttagctctaaaaatatcatgaccttgataacctgcgatccgattcctacctttaataaacgcttattagtgaattttgaacgagtcgctgtttatcaaaaatcagatccacaaacagctgcagttgcgagggttgcttttacgaaagaaggacaatctgtatcgcgtgttgcaacctctcaatggttgtaccgtgggctagtggtactggcatttctgggaatcctgtttgttttgtggaagctagcacgtttactacgagggaaataaaaagaaatgaaaggaaagctaaggctgttcctttttccggctctttgtcaactgtagtgggttgaaaaaaagctaagctcgagaaaggacaaattttgtcctttcttttttgatattcagagcgataaaaatccgttttttgaagttttcaaa

SEQ ID NO: 407 - protein, 774 aa, S. pneumoniae
MVVKTVVEAQDIFDKAWEGFKGVDWKEKASVSRFVQANYTPYDGDESFLAGPTERSLHIKKIVEETKAHYEETRFPMDTRPTSIADIPAGFIDKENEVIFGIQNDELFKLNFMPKGGIRMAETTLKENGYEPDPAVHEIFTKYVTTVNDGIFRAYTSNIRRARHAHTVTGLPDAYSRGRIIGVYARLALYGADYLMQEKVNDWNAIKEIDEETIRLREEVNLQYQALQQVVRLGDLYGVDVRKPAMNVKEAIQWVNIAFMAVCRVINGAATSLGRVPIVLDIFAERDLARGTFTESEIQEFVDDFVMKLRTVKFARTKAYDQLYSGDPTFITTSMAGMGNDGRHRVTKMDYRFLNTLDNIGNSPEPNLTVLWTDKLPYNFRRYCMHMSHKHSSIQYEGVTTMAKDGYGEMSCISCCVSPLDPENEEQRHNIQYFGARVNVLKALLTGLNGGYDDVHKDYKVFDIEPIRDEVLEFESVKANFEKSLDWLTDTYVDALNIIHYMTDRYNYEAVQMAFLPTKQRANMGFGICGFANTVDTLSAIKYATVKPIRDEDGYIYDYETIGDYPRWGEDDPRSNELAEWLIEAYTTRLRSHKLYKDAEATVSLLTITSNVAYSKQTGNSPVHKGVYLNEDGSVNLSKLEFFSPGANPSNKAKGGWLQNLNSLSSLDFSYAADGISLTTQVSPRALGKTRDEQVDNLVTILDGYFENGGQHVNLNVMDLNDVYEKIMSGEDVIVRISGYCVNTKYLTPEQKTELTQRVFHEVLSMDDALDALS

SEQ ID NO: 408 - protein, 420 aa, S. pneumoniae
ARSLVFKTREKKINLAIFIRKKFNEFNRFGFANRKIDKILKNTAELKANSYPLEIANTIYNKYCIFTSLTTKFTRNLHPLTDQILGWFQDTNKEQLHFLLLQYLDYYDKLEPVLTFIKKLCERPTLTERFTRAYFPKLSLKRSDKLIFKWYYKLARYELSKDDFQKMINIRTQNLARSMHQVIHFRDLVIKANPFLKKILPIYSGSMDVTVVKVKKRAEKSYKFFHNRITTQRRNDLITMIKKTNFDQAIFALKGKQYSFEDWSLIEPLTTYDEQFHFQKLKRYVTSTSTSIALKSAIHTLAERNLLLQAIKQRVMESIQCNKQVLTTEAVTVKRCSKCQFRRKKLHILSPFGGIEIFPIKSPKQFDYKIQKGKCHKCKPPHYDLTAFVEIHTDHQIAKNLTINKDKIGILLTTHNIHEM

SEQ ID NO: 409 - protein, 509 aa, S. pneumoniae
LLYHAKKAIMAVRKDFAEKRIDVITQYILRQQSVHLDLAITLFHHKGKPYQKKVYPLYEKTTIIILPETLHEESPPPSILINYGTVSAVKDTFNRLIISKILNVDAQNNLIIFIPIAPLSSFITETLYLSFLYLRHQDIVGEIKQETMWEQVIAKSIHYLPKDSEIGYHEYYNYYPVLNQLGFLFTRTLFTLATLFSLSNSIDNGLINKFKSLLHKGRTHQLILQITHTKKEQNWKDKSFSSNASCYVLFIYDLEEQTFTMNAHPELYTQCHEMLIPYMFLNKLKEFEKSEPFELPFERRKWTLAVLISFHVYEDPTIELLEHSLQSNSQVIMHTVWDMSGDNLDYIEIGFHFQLLAILFRIRYEPGVVQNKVLDLGVSRLLLGCKQRVRYGTAISIYEKQTFENFSQNGQLLFFRLIKLITSQNYLQHFYYNTQHSHHEILQVQQTDLNFTLEEEFTEQLEQLISLLSKSQLSTLTSLEDLEISRIDLLINLITIKDTIRKEIYKNLM

SEQ ID NO: 410 - protein, 891 aa, S. pneumoniae
MLNRETHMKKVRKIFQKAVAGLCCISQLTAFSSIVALAETPETSPAIGKVVIKETGEGGALLGDAVFELKNNTDGTTVSQRTEAQTGEAIFSNIKPGTYTLTEAQPPVGYKPSTKQWTVEVEKNGRTTVQGEQVENREEALSDQYPQTGTYPDVQTPYQIIKVDGSEKNGQHKALNPNPYERVIPEGTLSKRIYQVNNLDDNQYGIELTVSGKTTVETKEASTPLDVVILLDNSNSMSNIRHNHAHRAEKAGEATRALVDKITSNPDNRVALVTYGSTIFDGSEATVEKGVADANGKILNDSALWTFDRTTFTAKTYNYSFLNLTSDPTDIQTIKDRIPSDAEELNKDKLMYQFGATFTQKALMTADDILTKQARPNSKKVIFHITDGVPTMSYPINFKYTGTTQSYRTQLNNFKAKTPNSSGILLEDFVTWSADGEHKIVRGDGESYQMFTKKPVTDQYGVHQILSITSMEQRAKLVSAGYRFYGTDLYLYWRDSILAYPFNSSTDWITNHGDPTTWYYNGNMAQDGYDVFTVGVGVNGDPGTDEATATRFMQSIWSSSPDNYTNVADPSQILQELNRYFYTIVNEKKSIENGTITDPMGELIDFQLGADGRFDPADYTLTANDGSSLVNNVPTGGPQNDGGLLKNAKVFYDTTEKRIRVTGLYLGTGEKVTLTYNVRLNDQFVSNKFYDTNGRTTLHPKEVEKNTVRDFPIPKIRDVRKYPEITIPKEKKLGEIEFIKINKNDKKPLRDAVFSLQKQHPDYPDIYGAIDQNGTYQNVRTGEDGKLTFKNLSDGKYRLFENSEPAGYKPVQNKPIVAFQIVNGEVRDVTSIVPQDIPAGYEFTNDKHYITNEPIPPKREYPRTGGIGMLPFYLIGCMMMGGVLLYTRKHP

SEQ ID NO: 411 - protein, 644 aa, S. pneumoniae; identical to SEQ ID NO: 174

SEQ ID NO: 412 - protein, 401 aa, S. pneumoniae; identical to SEQ ID NO: 175

SEQ ID NO: 413 - protein, 304 aa, S. pneumoniae; identical to SEQ ID NO: 176

SEQ ID NO: 414 - protein, 249 aa, S. pneumoniae
VSRYYYRIESNEVIKEFDETVSQMDKAELEERWRLAQAFNATLKPSEILDPFTEQEKKKGVSEYANMLKVHERIGYVEIPAIDQEIPMYVGTSEEILQKGAGLLEGASLPVGGENTHTVVTAHRGLPTAELFSQLDKMKKGDVFYLHVLDQVLAYQVDQILTVEPNDFEPVLIQHGEDYATLLTCTPYMINSHRLLVRGKRIPYTAPIAERNRAVRERGQFWLWLLLAALVMILVLSYGVYRHRRIVKG

SEQ ID NO: 415 - protein, 295 aa, S. pneumoniae
MSKAKLQKLLGLEKQLEEHHVKGYLLMLVALVIPVYCFGQMVLQSLGQVKGHEIFSESVTADSYQEQLQRSLDYNQRLDSQNRIVDPFLAEGYEVNYQVSDDPDAVYGYLSIPSLEIMEPVYLGADYHHLAMGLAHVDGTPLPVEGKGIRSVIAGHRAEPSHVFFRHLDQLKVGDALYYDNGQEIVEYQMMDTEIILPSEWEKLESVSSKNIMTLITCDPIPTFNKRLLVNFERVAVYQKSDPQTAAVARVAFTKEGQSVSRVATSQWLYRGLVVLAFLGILFVLWKLARLLRGK

SEQ ID NO: 416 - protein, 509 aa, S. pneumoniae; identical to SEQ ID NO: 87

SEQ ID NO: 417 - protein, 509 aa, S. pneumoniae; identical to SEQ ID NO: 87

SEQ ID NO: 418 - protein, 509 aa, S. pneumoniae; identical to SEQ ID NO: 87

SEQ ID NO: 419 - protein, 509 aa, S. pneumoniae; identical to SEQ ID NO: 87

SEQ ID NO: 420 - protein, 509 aa, S. pneumoniae; identical to SEQ ID NO: 87

SEQ ID NO: 421 - protein, 509 aa, S. pneumoniae; identical to SEQ ID NO: 87

SEQ ID NO: 422 - protein, 509 aa, S. pneumoniae; identical to SEQ ID NO: 87

SEQ ID NO: 423 - protein, 509 aa, S. pneumoniae; identical to SEQ ID NO: 87

SEQ ID NO: 424 - protein, 509 aa, S. pneumoniae; identical to SEQ ID NO: 87

SEQ ID NO: 425 - protein, 509 aa, S. pneumoniae; identical to SEQ ID NO: 87

SEQ ID NO: 426 - protein, 823 aa, S. pneumoniae
MKKVRKIFQKAVAGLCCISQLTAFSSIVALAETPETSPAIGKVVIKETGEGGALLGDAVFELKNNTDGTTVSQRTEAQTGEAIFSNIKPGTYTLTEAQPPVGYKPSTKQWTVEVEKNGRTTVQGEQVENREEALSDQYPQTGTYPDVQTPYQIIKVDGSEKNGQHKALNPNPYERVIPEGAEKAGEATRALVDKITSNPDNRVALVTYGSTIFDGSEATVEKGVADANGKILNDSALWTFDRTTFTAKTYNYSFLNLTSDPTDIQTIKDRIPSDAEELNKDKLMYQFGATFTQKALMTADDILTKQARPNSKKVIFHITDGVPTMSYPINFKYTGTTQSYRTQLNNFKAKTPNSSGILLEDFVTWSADGEHKIVRGDGESYQMFTKKPVTDQYGVHQILSITSMEQRAKLVSAGYRFYGTDLYLYWRDSILAYPFNSSTDWITNHGDPTTWYYNGNMAQDGYDVFTVGVGVNGDPGTDEATATRFMQSISSSPDNYTNVADPSQILQELNRYFYTIVNEKKSIENGTITDPMGELIDFQLGADGRFDPADYTLTANDGSSLVNNVPTGGPQNDGGLLKNAKVFYDTTEKRIRVTGLYLGTGEKVTLTYNVRLNDQFVSNKFYDTNGRTTLHPKEVEKNTVRDFPIPKIRDVRKYPEITIPKEKKLGEIEFIKINKNDKKPLRDAVFSLQKQHPDYPDIYGAIDQNGTYQNVRTGEDGKLTFKNLSDGKYRLFENSEPAGYKPVQNKPIVAFQIVNGEVRDVTSIVPQDIPAGYEFTNDKHYITNEPIPPKREYPRTGGIGMLPFYLIGCMMMGGVLLYTRKNP

SEQ ID NO: 427 - protein, 883 aa, S. pneumoniae; identical to SEQ ID NO: 188

SEQ ID NO: 428 - protein, 883 aa, S. pneumoniae; identical to SEQ ID NO: 195

SEQ ID NO: 429 - protein, 883 aa, S. pneumoniae; identical to SEQ ID NO: 195

SEQ ID NO: 430 - protein, 883 aa, S. pneumoniae; identical to SEQ ID NO: 195

SEQ ID NO: 431 - protein, 883 aa, S. pneumoniae; identical to SEQ ID NO: 195

SEQ ID NO: 432 - protein, 886 aa, S. pneumoniae; identical to SEQ ID NO: 223

SEQ ID NO: 433 - protein, 886 aa, S. pneumoniae
MKKVRKIFQKAVAGLCCISQLTAFSSIVALAETPETSPAIGKVVIKETGEGGALLGDAVFELKNNTNGTTVSQRTEAQTGEAIFSNIKPGTYTLTEAQPPVGYKPSTKQRTVEVEKNGRTTVQGEQVENREEALSDQYPQTGTYPDVQTPYQIIKVDGSEKNGQHKALNPNPYERVIPEGTLSKRIYQVNNLDDNQYGIELTVSGKTVYERKDKSVPLDVVILLDNSNSMSNIRNKNARRAERAGEATRSLIDKITSDPENRVALVTYASTIFDGTEFTVEKGVADKNGKRLNDSLFWNYDQTSFTTNTKDYSYLKLTNDKNDIVELKNKVPTEAEDHDGNRLMYQFGATFTQKALMKADEILTQQARQNSQKVIFHITDGVPTMSYPINFNHATFAPSYQNQLNVFFSKSPNKDGILLSDFITQATSGEHTIVRGDGQSYQMFTDKTVYEKGAPAAFPVKPEKYSEMKAVGYAVIGDPINGGYIWLNWRESILAYPFNSNTAKITNHGDPTRWYYNGNIAPDGYDVFTVGIGINGDPGTDEATATSFMQSISSKPENYTNVTDTTKILEQLNRYFHTIVTEKKSIENGTITDPMGELIDLQLGTDGRFDPADYTLTANDGSRLENGQAVGGPQNDGGLLKNAKVFYDTTEKRIRVTGLYLGTGEKVTLTYNVRLNDQFVSNKFYDTNGRTTLHPKEVEKNTVRDFPIPKIRDVRKYPAITIAKEKKLGEIEFIKINKNDKKPLRDAVFSLQKQHPDYPDIYGAIDQNGTYQNVRTGEDGKLTFKNLSDGKYRLFENSEPAGYKPVQNKPIVAFQIVNGEVRDVTSIVPQDIPAGYEFTNDKHYITNEPIPPKREYPRTGGIGMLLFYLIGCMMMGGVLLYTRKHP

SEQ ID NO: 434 - protein, 886 aa, S. pneumoniae; identical to SEQ ID NO: 230

SEQ ID NO: 435 - protein, 886 aa, S. pneumoniae
MKKVRKIFQKAVAGLCCISQLTAFSSIVALAETPETSPAIGKVVIKETGEGGALLGDAVFELKNNTDGTTVSQRTEAQTGEAIFSNIKPGTYTLTEAQPPVGYKPSTKQWTVEVEKNGRTTVQGEQVENREEALSDQYPQTGTYPDVQTPYQIIKVDGSEKNGQHKALNPNPYERVIPEGTLSKRIYQVNNLDDNQYGIELTVSGKTVYEQKDKSVPLDVVILLDNSNSMSNIRNKNARRAERAGEATRSLIDKITSDSENRVALVTYASTIFDGTEFTVEKGVADKNGKRLNDSLFWNYDQTSFTTNTKDYSYLKLTNDKNDIVELKNKVPTEAEDHDGNRLMYQFGATFTQKALMKADEILTQQARQNSQKVIFHITDGVPTMSYPINFNHATFAPSYQNQLNAFFSKSPNKDGILLSDFITQATSGEHTIVRGDGQSYQMFTDKTVYEKGAPAAFPVKPEKYSEMKAAGYAVIGDPINGGYIWLNWRESILAYPFNSNTAKITNHGDPTRWYYNGNIAPDGYDVFTVGIGINGDPGTDEATATSFMQSISSKPENYTNVTDTTKILEQLNRYFHTIVTEKKSIENGTITDPMGELIDLQLGTDGRFDPADYTLTANDGSRLENGQAVGGPQNDGGLLKNAKVLYDTTEKRIRVTGLYLGTDEKVTLTYNVRLNDEFVSNKFYDTNGRTTLHPKEVEQNTVRDFPIPKIRDVRKYPEITISKEKKLGDIEFIKVNKNDKKPLRGAVFSLQKQHPDYPDIYGAIDQNGTYQNVRTGEDGKLTFKNLSDGKYRLFENSEPAGYKPVQNKPIVAFQIVNGEVRDVTSIVPQDIPAGYEFTNDKHYITNEPIPPKREYPRTGGIGMLPFYLIGCMMMGGVLLYTRKHP

SEQ ID NO: 436 - protein, 644 aa, S. pneumoniae; identical to SEQ ID NO: 174

SEQ ID NO: 437 - protein, 644 aa, S. pneumoniae; identical to SEQ ID NO: 174

SEQ ID NO: 438 - protein, 644 aa, S. pneumoniae; identical to SEQ ID NO: 174

SEQ ID NO: 439 - protein, 644 aa, S. pneumoniae; identical to SEQ ID NO: 174

SEQ ID NO: 440 - protein, 644 aa, S. pneumoniae; identical to SEQ ID NO: 189
  VARIANT (1)...(644): Xaa = Any Amino Acid

SEQ ID NO: 441 - protein, 644 aa, S. pneumoniae; identical to SEQ ID NO: 238

SEQ ID NO: 442 - protein, 654 aa, S. pneumoniae; identical to SEQ ID NO: 231

SEQ ID NO: 443 - protein, 665 aa, S. pneumoniae; identical to SEQ ID NO: 210

SEQ ID NO: 444 - protein, 612 aa, S. pneumoniae
MKSINKFLTMLAALLLTASSLFSAATVFAAGTTTTSVTVHKLLATDGDMDKIANELETGNYAGNKVGVLPANAKEIAGVMFVWTNTNNEIIDENGQTLGVNIDPQTFKLSGAMPATAMKKLTEAEGAKFNTANLPAAKYKIYEIHSLSTYVGEDGATLTGSKAVPIEIELPLNDVVDAHVYPKNTEAKPKIDKDFKGKANPDTPRVDKDTPVNHQVGDVVEYEIVTKIPALANYATANWSDRMTEGLAFNKGTVKVTVDDVALEAGDYALTEVATGFDLKLTDAGLAKVNDQNAEKTVKITYSATLNDKAIVEVPESNDVTFNYGNNPDHGNTPKPNKPNENGDLTLTKFVERSIKGYSADYQEITTAGEIAVKNWKDENPKPLDPTEPKVVTYGKKFVKVNDKDNRLAGAEFVIANADNAGQYLARKADKVSQEEKQLVVTTKDALDRAVAAYNALTAQQQTQQEKEKVDKAQAAYNAAVIAANNAFEWVADKDNENVVKLVSDAQGRFEITGLLAGTYYLEETKQPAGYALLTSRQKFEVTATSYSATGQGIEYTAGSGKDDATKVVNKKITIPQTGGIGTIIFAVAGAVIMGIAVYAYVKNNKDEDQLA

SEQ ID NO: 445 - protein, 665 aa, S. pneumoniae; identical to SEQ ID NO: 85

SEQ ID NO: 446 - protein, 401 aa, S. pneumoniae; identical to SEQ ID NO: 175

SEQ ID NO: 447 - protein, 401 aa, S. pneumoniae
MTMQKMQKMISRIFFVMALCFSLVWGAHAVQAQEDHTLVLQLENYQEVVSQLPSRDGHRLQVWKLDDSYSYDDRVQIVRDLHSWDENKLSSFKKTSFEMTFLENQIEVSHIPNGLYYVRSIIQTDAVSYPAEFLFEMTDQTVEPLVIVAKKTDTMTTKVKLIKVDQDHNRLEGVGFKLVSVARDVSEKEVPLIGEYRYSSSGQVGRTLYTDKNGEIFVTNLPLGNYRFKEVEPLAGYAVTTLDTDVQLVDHQLVTITVVNQKLPRGNVDFMKVDGRTNTSLQGAMFKVMKEESGHYTPVLQNGKEVVVTSGKDGRFRVEGLEYGTYYLWELQAPTGYVQLTSPVSFTIGKDTRKELVTVVKNNKRPRIDVPDTGEETLYILMLVAILLFGSGYYLTKKPNN

SEQ ID NO: 448 - protein, 401 aa, S. pneumoniae; identical to SEQ ID NO: 175

SEQ ID NO: 449 - protein, 401 aa, S. pneumoniae; identical to SEQ ID NO: 175

SEQ ID NO: 450 - protein, 401 aa, S. pneumoniae; identical to SEQ ID NO: 175

SEQ ID NO: 451 - protein, 401 aa, S. pneumoniae; identical to SEQ ID NO: 175

SEQ ID NO: 452 - protein, 401 aa, S. pneumoniae; identical to SEQ ID NO: 225

SEQ ID NO: 453 - protein, 401 aa, S. pneumoniae; identical to SEQ ID NO: 225

SEQ ID NO: 454 - protein, 413 aa, S. pneumoniae; identical to SEQ ID NO: 211

SEQ ID NO: 455 - protein, 401 aa, S. pneumoniae; identical to SEQ ID NO: 239

SEQ ID NO: 456 - protein, 304 aa, S. pneumoniae; identical to SEQ ID NO: 233

SEQ ID NO: 457 - protein, 304 aa, S. pneumoniae; identical to SEQ ID NO: 176

SEQ ID NO: 458 - protein, 304 aa, S. pneumoniae; identical to SEQ ID NO: 176

SEQ ID NO: 459 - protein, 304 aa, S. pneumoniae; identical to SEQ ID NO: 176

SEQ ID NO: 460 - protein, 304 aa, S. pneumoniae; identical to SEQ ID NO: 176

SEQ ID NO: 461 - protein, 304 aa, S. pneumoniae; identical to SEQ ID NO: 176

SEQ ID NO: 462 - protein, 304 aa, S. pneumoniae; identical to SEQ ID NO: 176

SEQ ID NO: 463 - protein, 302 aa, S. pneumoniae; identical to SEQ ID NO: 212

SEQ ID NO: 464 - protein, 302 aa, S. pneumoniae; identical to SEQ ID NO: 212

SEQ ID NO: 465 - protein, 302 aa, S. pneumoniae; identical to SEQ ID NO: 226

SEQ ID NO: 466 - protein, 297 aa, S. pneumoniae; identical to SEQ ID NO: 192

SEQ ID NO: 467 - protein, 297 aa, S. pneumoniae; identical to SEQ ID NO: 192

SEQ ID NO: 468 - protein, 297 aa, S. pneumoniae; identical to SEQ ID NO: 192

SEQ ID NO: 469 - protein, 297 aa, S. pneumoniae; identical to SEQ ID NO: 192

SEQ ID NO: 470 - protein, 297 aa, S. pneumoniae; identical to SEQ ID NO: 192

SEQ ID NO: 471 - protein, 297 aa, S. pneumoniae; identical to SEQ ID NO: 234

SEQ ID NO: 472 - protein, 297 aa, S. pneumoniae; identical to SEQ ID NO: 213

SEQ ID NO: 473 - protein, 297 aa, S. pneumoniae; identical to SEQ ID NO: 213

SEQ ID NO: 474 - protein, 297 aa, S. pneumoniae; identical to SEQ ID NO: 227

SEQ ID NO: 475 - protein, 297 aa, S. pneumoniae
MDNSRRSRKKGTKKKKHPLILLLIFLVGFAVAIYPLVSRYYYRIESNEVIKEFDETVSQMDKAELEERWRLAQAFNATLKPSEILDPFTEQEKKKGVSEYANMLKVHERIGYVEIPAIDQEIPMYVGTSEDILQKGAGLLEGASLPVGGENTHTVITAHRGLPTAELFSQLDKMKKGDIFYLHVLDQVLAYQVDQIVTVEPNDFEPVLIQHGEDYATLLTCTPYMINSHRLLVRGKRIPYTAPIAERNRAVRERGQFWLWLLLGAMAVILLLLYRVYRNRRIVKGLEKQLEGRHVKD

SEQ ID NO: 476 - protein, 283 aa, S. pneumoniae; identical to SEQ ID NO: 178

SEQ ID NO: 477 - protein, 283 aa, S. pneumoniae; identical to SEQ ID NO: 193

SEQ ID NO: 478 - protein, 283 aa, S. pneumoniae; identical to SEQ ID NO: 178

SEQ ID NO: 479 - protein, 283 aa, S. pneumoniae; identical to SEQ ID NO: 178

SEQ ID NO: 480 - protein, 283 aa, S. pneumoniae; identical to SEQ ID NO: 178

SEQ ID NO: 481 - protein, 283 aa, S. pneumoniae; identical to SEQ ID NO: 178

SEQ ID NO: 482 - protein, 283 aa, S. pneumoniae; identical to SEQ ID NO: 80

SEQ ID NO: 483 - protein, 283 aa, S. pneumoniae; identical to SEQ ID NO: 80

SEQ ID NO: 484 - protein, 283 aa, S. pneumoniae; identical to SEQ ID NO: 80

SEQ ID NO: 485 - protein, 283 aa, S. pneumoniae; identical to SEQ ID NO: 80

SEQ ID NO: 486 - protein, 893 aa, S. pneumoniae; identical to SEQ ID NO: 86

SEQ ID NO: 487 - DNA, 26 bp, S. pneumoniae
cgggatccgaaacgcctgaaaccagt

SEQ ID NO: 488 - DNA, 24 bp, S. pneumoniae
ccgctcgagaataggttcattggt

SEQ ID NO: 489 - protein, 665 aa, S. pneumoniae; identical to SEQ ID NO: 85

SEQ ID NO: 490 - DNA, 23 bp, S. pneumoniae
cgggatccgctgcaacagttttt

SEQ ID NO: 491 - DNA, 27 bp, S. pneumoniae
ccgctcgagagtgatttttttgttgac

SEQ ID NO: 492 - protein, 393 aa, S. pneumoniae; identical to SEQ ID NO: 84

SEQ ID NO: 493 - DNA, 29 bp, S. pneumoniae
cgggatcccatgcagtccaagcgcaagaa

SEQ ID NO: 494 - DNA, 27 bp, S. pneumoniae
ccgctcgagcttgttatttttaaccac

SEQ ID NO: 495 - DNA, 11352 bp, S. pneumoniae
gtttaggcgcttttcattataagtcttatgggacttttttgatactcaaaaagccctataatctccacagtgggatttacccactacagaaattatagagccagaaaaaacacttttgttcactagcagaaactagagagcagaagtgtttttctgttcagatttacccaaaactgggaaatatggggataagaatagagatggcttaggaagcccctttttgtgtgtagacagtacgatgaacttataacaaatagtgagcctttttagcaatcattgcgacccgtttgtcaaaagcctcttttcggatatctacaattgtctgatagatgagacgctgttggctaacatgcaaatctaaggcaatcgtcaaaaagtgatgtttccctttgggatactgctttttaacgtaaggcaggtattctttcgttgtaataataatcaatggctctgtcaaatgctcctctgaaggaggaggactaattagaatattgtatcctgtaacagaggcaactttgtcagtaaaattccgtaaaataatggactttattaagtttacatctgcttgattatttaaaatgataaaaatcgggatagcaggtagtgaggaaaagatggtttctgtcaagtagagtgagaaaaggtacagccgatgctggtcgataactccttcaatcttctgctcagtcatccactcttgaacaattgctttcgaaatatgatacagtggcttgtcgctttcaatcccataatgttcgtaataattataatagggaactagattttgtaaaccaaacaaaaacgttcttgttaagaaagtcagtgctgttaaaaaagaaagagaattcgaaatgtcatttcctaagatattcttgaacttggatagtagatgctttcctcttgtatgctgaagaatcagttgaatagtatgagtctttttttcttgattccatttgtccttggaaaacgaagaattagcagaacaataaaccaaaaagatataatccagttcttcctgagtaaaagtcatgttggcatgtggctctaagtaagtttggcaatgttccatcaaaatcggatacataaagaggttttttaatttttcaaactctttggactcagggaactcaagtggaaattcccgacgtttccaagtgagtgccactagtatgctaaaatgaacatactcgtcaggtgtgatttctaacagttcatgactgagttgagaattagactgcacaatcatatgtgtgacccaatccatacttccatcattcaaatcataaatctcaataccaaaatgaaactggaggagtgcaattaaaaaacgaatgcgatattcaggaccaactacttgatttttcacaaggtccaaacctactgaacgtagtaacaagccacacttttgtcgtacgcggtagcctgttgcgatggaaatatactctttttgtgtaaattcgttaaagctttgattaccttgtagtagaaagaagcggagtatttttaaaatagttgattggttataaagctgatggaagtaataattcgtttgatgagaatggtgttcgattaattgaacttgttgcgtatctaaattaaatgtcaactcttcctcgaatgtttcttgtaattcctgcaaaatgcttaggagacttttagattgtaatgaagttaaagtagacagttcatctagttcaatagaccgaatatccaataatatatttaaaatggtaattttatctgtaattcttttttcaatgtatttgtttagcatagttaccgaatcttagttgcatatagataattttaattattataatacaaaagaaactaattgtcttgtcaaaaaggttgtggaatttccgactttattgataaaacagcatgtaataaaaggcattttaaagatagtaatgagtattggtggagttttatggcttattttttttattagaaaatatttttttatcaaatattgtcgttctataaaaaaatatgtgataaaaatatctattgtgatggaagttgttttaatttatactaggatagttaatagtaatactatactatactatattgtatacaagtgtgtcattgccaggttgagaagatagctataacgcacttttatacgcttttgctacgtttgttagtgaacggattaactcagtgagataaattttatcagaacataagtaatccgtttcttcgtgtatacagattgaaagtacctatgaatcatagaaggattaacttgttctatgaataatgcttaacagggagacacacatgaaaaaagtaagaaagatatttcagaaggcagttgcaggactgtgctgtatatctcagttgacagctttttcttcgatagttgctttagcagaaacgcctgaaaccagtccagcgataggaaaagtagtgattaaggagacaggcgaaggaggagcgcttctaggagatgccgtctttgagttgaaaaacaatacggatggcacaactgtttcgcaaaggacagaggcgcaaacaggagaagcgatattttcaaacataaaacctgggacatacaccttgacagaagcccaacctccagttggttataaaccctctactaaacaatggactgttgaagttgagaagaatggtcggacgactgtccaaggtgaacaggtagaaaatcgagaagaggctctatctgaccagtatccacaaacagggacttatccagatgttcaaacaccttatcagattattaaggtagatggttcggaaaaaaacggacagcacaaggcgttgaatccgaatccatatgaacgtgtgattccagaaggtacactttcaaagagaatttatcaagtgaataatttggatgataaccaatatggaatcgagttgacggttagtggtaaaacgacggttgaaacgaaagaagcctctactccgctagatgttgttattctattagataactccaatagtatgagtaatattcgacataatcatgcccatcgagcggaaaaagcgggagaagcgacacgagcccttgtagataagattacctccaatccagataatcgagtagcacttgtgacttatggctcaactatctttgacggttcagaagctactgtggaaaaaggggtagcagatgcgaacggaaaaatattgaatgactcagctttatggacgttcgatcgtacgacgtttacagctaaaacttataattatagctttttaaatctcacatcagatcctactgatattcaaactattaaggataggattccatcagatgcagaggaattgaacaaagacaaattgatgtatcaattcggcgcgacttttacccagaaggctttgatgaccgctgatgatatcttgacaaagcaggcaagaccaaacagtaaaaaggttattttccacattacagatggtgttccgactatgtcatatccaattaattttaaatatacaggaacgacgcaatcgtacagaactcagctgaataattttaaagcaaaaactccaaatagtagcgggatattactggaggactttgttacatggtcagcagatggtgaacataagattgttcgtggagatggtgaaagttatcagatgtttacgaagaaacctgtaacagaccaatacggagttcatcaaatactttcaatcacctccatggagcagagagctaaattagtttcagcgggatataggttctatggaactgacttgtatttatattggcgtgatagtattctagcctatccatttaactctagtaccgattggattaccaaccatggtgaccctacgacttggtattataacggaaatatggctcaggatggctatgatgtcttcactgttggggttggtgtaaacggggatcctggtacggatgaagcaacggctactagatttatgcagagcatctctagttctcctgacaactacactaacgtagcagatccatctcagattttacaagaattgaatcgctacttctatactatcgtcaatgagaagaaatctatcgaaaatggtacgattacagacccgatgggtgaactaattgatttccaattgggagcagatggaaggtttgatccagcggattacactttaactgcaaacgatggtagttcgttggtgaataatgtccctactgggggaccacaaaatgatggtggcttgctaaaaaatgcaaaagtgttctatgatacgactgagaaaaggattcgtgtaacaggtttgtaccttggaacgggtgaaaaagttacattgacttataatgttcgcttgaatgaccaatttgtaagcaataaattctatgacacgaatggtcgaacaaccctacaccctaaggaagtagaaaagaacacagtgcgcgacttcccgattcctaagattcgtgatgtacgaaagtatccagaaatcacaattccaaaagagaaaaaacttggtgaaattgagtttattaagatcaataagaatgataaaaaaccactgagagatgcggtctttagtcttcaaaaacaacatccggattatccagatatttatggagctattgatcaaaatggcacttatcaaaatgtgagaacaggtgaagatggtaagttgacctttaaaaatctgtcagatgggaaatatcgattatttgaaaattctgaaccagctggttataaacccgttcaaaataagcctatcgttgccttccaaatagtaaatggagaagtcagagatgtgacttcaatcgttccacaagatataccagcgggttacgagtttacgaatgataagcactatatcacaaatgagccaattcctccaaaaagagaatatcctcgaactggtggtatcggaatgttgccattctatctgataggttgcatgatgatgggaggagttctattatacacacggaaacatccgtaaagtgtagcaatgagaaatgataatatcgatactctgagcgatacttttaagaagtagcactcaagaagagatttaagtttacttggtgaaaacagttttcttcgccaagtaaaccaccattgaaaggggagatgttttcgaaaacttgcacagaaaaaaggattattattgtcatgtgtaattcattacattgctcacagttgattttaagagatatgaataaggagaaatcatgaaatcaatcaacaaatttttaacaatgcttgctgccttattactgacagcgagtagcctgttttcagctgcaacagtttttgcggcggacaatgttagtacagcaccagatgctgttactaaaactttaacaatccataagttactgctctcagaagatgatttaaagacttgggatacaaacggtcctaaaggatatgatggaactcaatctagtttaaaagatttaactggagttgtagctgaggaaattccaaatgtatactttgaattacaaaagtataatttgactgatggtaaggaaaaagaaaatcttaaagatgatagtaaatggacaacagttcatggtggtttgacaactaaagatggacttaaaattgaaaccagtactcttaaaggtgtgtatcgtattcgtgaggatagaacaaagactacctatgttggtcctaatgggcaagtattaacaggttcaaaagccgtacctgctcttgtaactcttccacttgttaacaataatggtacagtaattgatgcacatgttttccctaaaaattcatataataaaccagttgtagataaaagaattgctgatactttgaattataacgatcaaaatggtctgtctatcggtactaaaatcccatatgttgttaatacaacaattccaagtaatgcaacatttgcaacttcattttggtcagatgaaatgacagaaggtctaacttataatgaagagtaacaattactttgaataatgtagctatggatcaagctgattatgaagtcactaaaggaaataatggctttaacttaaaattaacagaagcaggtttagctaaaattaatggtaaggatgcagaccaaaaaatccaaattacttactcagctactttgaactcacttgctgttgcagacattcctgaaagtaacgatattacatatcattacggaaatcatcaagatcatgggaatactccaaaaccaactaaacctaataatggtcaaattacagtaactaagacatgggacagtcaacctgctcctgagggggtgaaagcgactgttcaacttgtaaatgccaagactggtgagaaagtcggtgctcctgtagaactttcagaaaataattggacatatacttggagtggtctagataattctattgaatacaaagttgaagaagaatataatggatactcagctgaatacacagtagagagcaaagggaagttgggggtaaaaaactggaaagataataacccagctccaatcaatctgaagaaccacgtgtaaaaacatacggtaaaaagtttgtcaaagtagaccaaaaagatactcgtctagaaaatgcgcagttcgttgttaaaaaagcagatagcaataaatatattgcctttaagtcaactgcacaacaagctgcagatgaaaaagcagcagcaactgcaaaacaaaaattggatgcagcggtagcagcttacacaaatgctgcagataagcaagccgctcaagctctagtagatcaagcacagcaagaatacaatgtagcttacaaagaagccaaatttggttatgttgaagtagctggaaaagatgaagcaatggttcttacttctaatacggatggtcaattccaaatttcaggtcttgctgctggtacttataaattagaagaaattaaagctccagaaggttttgcgaaaattgatgatgtagaatttgttgttggagcaggttcttggaatcaaggtgagtttaattacttaaaagatgttcaaaagaatgacgctacaaaagtagtcaacaaaaaaatcactatcccacaaacgggtggtattggtacaattatctttgctgtagcgggggctgcgattatgggtattgcagtgtacgcatatgttaaaaacaacaaagatgaggatcaacttgcttaagtaagagagaaaggagccattgatgacaatgcagaaaatgcagaaaatgattagtcgtatcttctttgttatggctctgtgtttttctcttgtatggggtgcacatgcagtccaagcgcaagaagatcacacgttggtcttgcaattggagaactatcaggaggtggttagtcaattgccatctcgtgatggtcatcggttgcaagtatggaagttggatgattcgtattcctatgatgatcgggtgcaaattgtaagagacttgcattcgtgggatgagaataaactttcttctttcaaaaagacttcgtttgagatgaccttccttgagaatcagattgaagtatctcatattccaaatggtctttactatgttcgctctattatccagacggatgcggtttcttatccagctgaatttctttttgaaatgacagatcaaacggtagagcctttggtcattgtagcgaaaaaaacagatacaatgacaacaaaggtgaagctgataaaggtggatcaagaccacaatcgcttggagggtgtcggctttaaattggtatcagtagcaagagatggttctgaaaaagaggttcccttgattggagaataccgttacagttcttctggtcaagtagggagaactctctatactgataaaaatggagagatttttgtgacaaatcttcctcttgggaactatcgtttcaaggaggtggagccactggcaggctatgctgttacgacgctggatacggatgtccagctggtagatcatcagctggtgacgattacggttgtcaatcagaaattaccacgtggcaatgttgactttatgaaggtggatggtcggaccaatacctctcttcaaggggcaatgttcaaagtcatgaaagaagaaagcggacactatactcctgttcttcaaaatggtaaggaagtagttgtaacatcagggaaagatggtcgtttccgagtggaaggtctagagtatgggacatactatttatgggagctccaagctccaactggttatgttcaattaacatcgcctgtttcctttacaatcgggaaagatactcgtaaggaactggtaacagtggttaaaaataacaagcgaccacggattgatgtgccagatacaggggaagaaaccttgtatatcttgatgcttgttgccattttgttgtttggtagtggttattatcttacgaaaaaaccaaataactgatattcaatgtacatcattatgaaaaagatagcaggctgaagggaagaccagagtactctgaggtgatgttaatcaggaatcatggtgatgtggcatgaatcacaataacggatatgaggctgggcagattgtgccagcctcattgtgggttattgtttgtaaaacgataggactggtctggtaatcattttaggaatggacaggactgggattctgatttaaaatggatggtgaatcagaaagaaatgagattttctcgtttctcttagcagataggattgtctgttaggaaaagcgataaaatgatgagtttgaagataaagggatgctgataaaaatggtaaaaacaaaaaagcaaaaacgaaataatctcctattaggagtggtatttttcattggaatggcggtaatggcgtatccgctggtgtctcgcttgtattatcgagtggaatcaaatcaacaaattgctgactttgataaggaaaaagcaacgttggatgaggctgacattgatgaacgaatgaaattggcacaagccttcaatgactctttgaataatgtagtgagtggcgatccttggtcggaagaaatgaagaaaaaagggcgagcagagtatgcacgtatgttagaaatccatgagcggatggggcatgtggaaatccccgttattgacgtggatttgccggtttatgctggtactgctgaagaggtattgcagcaaggggctgggcatctagagggaacttctctgccgatcggaggcaattcgacccatgcggtgattacggcacatacaggtttgccaacagctaagatgtttacggatttgaccaaacttaaagttggggataagttttatgtgcacaatatcaaggaagtgatggcctatcaagtggatcaagtaaaggtgattgagccgacgaactttgatgatttattgattgtaccaggtcatgattatgtgaccttgctgacttgtacgccatacatgatcaatacccatcgtctattggttcgggggcatcggataccgtacgtagcagaggttgaggaagaatttattgcagcaaacaaactcagtcatctctatcgctacctgttttatgtggcagttggtttgattgtgattcttttatggattattcgacgcttgcgcaagaagaaaaaacaaccggaaaaggctttgaaggcgctgaaagcagcaaggaaggaagtgaaggtggaggatggacaacagtagacgttcacgaaaaaaaggcacaaaaaagaagaaacatccgctgatccttcttctgattttcttagtaggattcgccgttgcgatatatccattggtgtctcgttattattatcgtattgagtcaaacgaggttattaaagagtttgatgagacggtttcccagatggataaggcagaacttgaggagcgttggcgcttggctcaagccttcaatgcgaccttgaaaccatctgaaattcttgatccttttacagagcaagagaaaaagaaaggcgtctcagaatatgccaatatgctaaaggtccatgagcggattggctatgtggaaattcctgcgattgatcaggaaattccgatgtatgtcggaacgagtgaggaaattcttcagaagggcgcaggattgctagagggagcttcgttaccggttggtggtgaaaatacccacacagttgtcactgctcatagaggattaccgacggcagaactgtttagtcaattggataagatgaaaaaaggggatgtcttttatcttcacgttttagaccaggtgttggcctaccaagtggatcagattttgacggttgagccaaatgactttgagcctgtcttgattcaacatggggaagattatgcgaccttgttgacctgtacaccgtatatgattaacagtcatcgtctgttggtacgtgggaagcggattccgtatacggcaccaattgcagagcgaaatcgagcggtgagagagcgtgggcaattctggttgtggttattgctagcggcgttggttatgattctggtattgagttacggggtgtatcgtcatcgtcgcattgtcaaagggctagaaaaacaattggaggagcatcatgtcaaaggctaagctacagaaattactagggtatttgctgatgctggtagcattggtgattcctgtttattgttttgggcagatggtgttacagtctttaggacaagtaaaaggtcatgagatattttcagaatctgtgacggccgacagttaccaagagcaattgcaacggtcgcttgattacaatcaacgcttggattcgcaaaatcgtattgtagatccttttttggcggaagggtatgaggtaaattaccaagtgtctgacgatcctgatgcagtctacggctatttgtcgattccgagtttggaaatcatggagccagtttatctaggagcggattaccatcatttagcaatggggttggcccatgtggatgggacgcctcttcctgttgagggaaaagggattcgttcagtgattgctgggcaccgtgcagaaccaagccatgtctttttccgccatttggatcagctaaaagttggagatgctctttattatgataatggccaggaaattgtagaatatcagatgatggacacagagattattttaccgtcggaatgggaaaaattagaatcggttagctctaaaaatatcatgaccttgataacctgcgatccgattcctacctttaataaacgcttattagtgaattttgaacgagtcgctgtttatcaaaaatcagatccacaaacagctgcagttgcgagggttgcttttacgaaagaaggacaatctgtatcgcgtgttgcaacctctcaatggttgtaccgtgggctagtggtactggcatttctgggaatcctgtttgttttgtggaagctagcacgtttactacgagggaaataaaaagaaatgaaaggaaagctaaggctgttcctttttccggctctttgtcaactgtagggg

SEQ ID NO: 496 - DNA, 11447 bp, S. pneumoniae
gtttaggcgcttttcattataagtcttatgggacttttttgatactcaaaaagccctataatctccacagtgggatttacccactacagaaattatagagccagaaaaaacacttttgttcactagcagaaactagagagcagaagtgtttttctgttcagatttacccaaaactgggaaatatggggataagaatagagatggcttaggaagcccctttttgtgtgtagacagtacgatgaacttataacaaatagtgagcctttttagcaatcattgcgacccgtttgtcaaaagcctcttttcggatatctacaattgtctgatagatgagacgctgttggctaacatgcaaatctaaggcaatcgtcaaaaagtgatgtttccctttgggatactgctttttaacgtaaggcaggtattctttcgttgtaataataatcaatggctctgtcaaatgctcctctgaaggaggaggactaattagaatattgtatcctgtaacagaggcaactttgtcagtaaaattccgtaaaataatggactttattaagtttacatctgcttgattatttaaaatgataaaaatcgggatagcaggtagtgaggaaaagatggtttctgtcaagtagagtgagaaaaggtacagccgatgctggtcgataactccttcaatcttctgctcagtcatccactcttgaacaattgctttcgaaatatgatacagtggcttgtcgctttcaatcccataatgttcgtaataattataatagggaactagattttgtaaaccaaacaaaaacgttcttgttaagaaagtcagtgctgttaaaaaagaaagagaattcgaaatgtcatttcctaagatattcttgaacttggatagtagatgctttcctcttgtatgctgaagaatcagttgaatagtatgagtctttttttcttgattccatttgtccttggaaaacgaagaattagcagaacaataaaccaaaaagatataatccagttcttcctgagtaaaagtcatgttggcatgtggctctaagtaagtttggcaatgttccatcaaaatcggatacataaagaggttttttaatttttcaaactctttggactcagggaactcaagtggaaattcccgacgtttccaagtgagtgccactagtatgctaaaatgaacatactcgtcaggtgtgatttctaacagttcatgactgagttgagaattagactgcacaatcatatgtgtgacccaatccatacttccatcattcaaatcataaatctcaataccaaaatgaaactggaggagtgcaattaaaaaacgaatgcgatattcaggaccaactacttgatttttcacaaggtccaaacctactgaacgtagtaacaagccacacttttgtcgtacgcggtagcctgttgcgatggaaatatactctttttgtgtaaattcgttaaagctttgattaccttgtagtagaaagaagcggagtatttttaaaatagttgattggttataaagctgatggaagtaataattcgtttgatgagaatggtgttcgattaattgaacttgttgcgtatctaaattaaatgtcaactcttcctcgaatgtttcttgtaattcctgcaaaatgcttaggagacttttagattgtaatgaagttaaagtagacagttcatctagttcaatagaccgaatatccaataatatatttaaaatggtaattttatctgtaattcttttttcaatgtatttgtttagcatagttaccgaatcttagttgcatatagataattttaattattataatacaaaagaaactaattgtcttgtcaaaaaggttgtggaatttccgactttattgataaaacagcatgtaataaaaggcattttaaagatagtaatgagtattggtggagttttatggcttattttttttattagaaaatatttttttatcaaatattgtcgttctataaaaaaatatgtgataaaaatatctattgtgatggaagttgttttaatttatactaggatagttaatagtaatactatactatactatattgtatacaagtgtgtcattgccaggttgagaagatagctataacgcacttttatacgcttttgctacgtttgttagtgaacggattaactcagtgagataaattttatcagaacataagtaatccgtttcttcgtgtatacagattgaaagtacctatgaatcatagaaggattaacttgttctatgaataatgcttaacagggagacacacatgaaaaaagtaagaaagatatttcagaaggcagttgcaggactgtgctgtatatctcagttgacagctttttcttcgatagttgctttagcagaaacgcctgaaaccagtccagcgataggaaaagtagtgattaaggagacaggcgaaggaggagcgcttctaggagatgccgtctttgagttgaaaaacaatacggatggcacaactgtttcgcaaaggacagaggcgcaaacaggagaagcgatattttcaaacataaaacctgggacatacaccttgacagaagcccaacctccagttggttataaaccctctactaaacaatggactgttgaagttgagaagaatggtcggacgactgtccaaggtgaacaggtagaaaatcgagaagaggctctatctgaccagtatccacaaacagggacttatccagatgttcaaacaccttatcagattattaaggtagatggttcggaaaaaaacggacagcacaaggcgttgaatccgaatccatatgaacgtgtgattccagaaggtacactttcaaagagaatttatcaagtgaataatttggatgataaccaatatggaatcgagttgacggttagtggtaaaacgacggttgaaacgaaagaagcctctactccgctagatgttgttattctattagataactccaatagtatgagtaatattcgacataatcatgcccatcgagcggaaaaagcgggagaagcgacacgagcccttgtagataagattacctccaatccagataatcgagtagcacttgtgacttatggctcaactatctttgacggttcagaagctactgtggaaaaaggggtagcagatgcgaacggaaaaatattgaatgactcagctttatggacgttcgatcgtacgacgtttacagctaaaacttataattatagctttttaaatctcacatcagatcctactgatattcaaactattaaggataggattccatcagatgcagaggaattgaacaaagacaaattgatgtatcaattcggcgcgacttttacccagaaggctttgatgaccgctgatgatatcttgacaaagcaggcaagaccaaacagtaaaaaggttattttccacattacagatggtgttccgactatgtcatatccaattaattttaaatatacaggaacgacgcaatcgtacagaactcagctgaataattttaaagcaaaaactccaaatagtagcgggatattactggaggactttgttacatggtcagcagatggtgaacataagattgttcgtggagatggtgaaagttatcagatgtttacgaagaaacctgtaacagaccaatacggagttcatcaaatactttcaatcacctccatggagcagagagctaaattagtttcagcgggatataggttctatggaactgacttgtatttatattggcgtgatagtattctagcctatccatttaactctagtaccgattggattaccaaccatggtgaccctacgacttggtattataacggaaatatggctcaggatggctatgatgtcttcactgttggggttggtgtaaacggggatcctggtacggatgaagcaacggctactagatttatgcagagcatctctagttctcctgacaactacactaacgtagcagatccatctcagattttacaagaattgaatcgctacttctatactatcgtcaatgagaagaaatctatcgaaaatggtacgattacagacccgatgggtgaactaattgatttccaattgggagcagatggaaggtttgatccagcggattacactttaactgcaaacgatggtagttcgttggtgaataatgtccctactgggggaccacaaaatgatggtggcttgctaaaaaatgcaaaagtgttctatgatacgactgagaaaaggattcgtgtaacaggtttgtaccttggaacgggtgaaaaagttacattgacttataatgttcgcttgaatgaccaatttgtaagcaataaattctatgacacgaatggtcgaacaaccctacaccctaaggaagtagaaaagaacacagtgcgcgacttcccgattcctaagattcgtgatgtacgaaagtatccagaaatcacaattccaaaagagaaaaaacttggtgaaattgagtttattaagatcaataagaatgataaaaaaccactgagagatgcggtctttagtcttcaaaaacaacatccggattatccagatatttatggagctattgatcaaaatggcacttatcaaaatgtgagaacaggtgaagatggtaagttgacctttaaaaatctgtcagatgggaaatatcgattatttgaaaattctgaaccagctggttataaacccgttcaaaataagcctatcgttgccttccaaatagtaaatggagaagtcagagatgtgacttcaatcgttccacaagatataccagcgggttacgagtttacgaatgataagcactatatcacaaatgagccaattcctccaaaaagagaatatcctcgaactggtggtatcggaatgttgccattctatctgataggttgcatgatgatgggaggagttctattatacacacggaaacatccgtaaagtgtagcaatgagaaatgataatatcgatactctgagcgatacttttaagaagtagcactcaagaagagatttaagtttacttggtgaaaacagttttcttcgccaagtaaaccaccattgaaaggggagatgttttcgaaaacttgcacagaaaaaaggattattattgtcatgtgtaattcattacattgctcacagttgattttaagagatatgaataaggagaaatcatgaaatcaatcaacaaatttttaacaatgcttgctgccttattactgacagcgagtagcctgttttcagctgcaacagtttttgcggcggacaatgttagtacagcaccagatgctgttactaaaactttaacaatccataagttactgctctcagaagatgatttaaagacttgggatacaaacggtcctaaaggatatgatggaactcaatctagtttaaaagatttaactggagttgtagctgaggaaattccaaatgtatactttgaattacaaaagtataatttgactgatggtaaggaaaaagaaaatcttaaagatgatagtaaatggacaacagttcatggtggtttgacaactaaagatggacttaaaattgaaaccagtactcttaaaggtgtgtatcgtattcgtgaggatagaacaaagactacctatgttggtcctaatgggcaagtattaacaggttcaaaagccgtacctgctcttgtaactcttccacttgttaacaataatggtacagtaattgatgcacatgttttccctaaaaattcatataataaaccagttgtagataaaagaattgctgatactttgaattataacgatcaaaatggtctgtctatcggtactaaaatcccatatgttgttaatacaacaattccaagtaatgcaacatttgcaacttcattttggtcagatgaaatgacagaaggtctaacttataatgaagatgtaacaattactttgaataatgtagctatggatcaagctgattatgaagtcactaaaggaaataatggctttaacttaaaattaacagaagcaggtttagctaaaattaatggtaaggatgcagaccaaaaaatccaaattacttactcagctactttgaactcacttgctgttgcagacattccygaaagtaacgatattacatatcattacggaaatcatcaagatcatgggaatactccaaaaccaactaaacctaataatggtcaaattacagtaactaagacatgggacagtcaacctgctcctgagggggtgaaagcgactgttcaacttgtaaatgccaagactggtgagaaagtcggtgctcctgtagaactttcagaaaataattggacatatacttggagtggtctagataattctattgaatacaaagttgaagaagaatataatggatactcagctgaatacacagtagagagcaaagggaagttgggggtaaaaaactggaaagataataacccagctccaatcaatcctgaagaaccacgtgtaaaaacatacggtaaaaagtttgtcaaagtagaccaaaaagatactcgtctagaaaatgcgcagttcgttgttaaaaaagcagatagcaataaatatattgcctttaagtcaactgcacaacaagctgcagatgaaaaagcagcagcaactgcaaaacaaaaattggatgcagcggtagcagcttacacaaatgctgcagataagcaagccgctcaagctctagtagatcaagcacagcaagaatacaatgtagcttacaaagaagccaaatttggttatgttgaagtagctggaaaagatgaagcaatggttcttacttctaatacggatggtcaattccaaatttcaggtcttgctgctggtacttataaattagaagaaattaaagctccagaaggttttgcgaaaattgatgatgtagaatttgttgttggagcaggttcttggaatcaaggtgagtttaattacttaaaagatgttcaaaagaatgacgctacaaaagtagtcaacaaaaaaatcactatcccacaaacgggtggtattggtacaattatctttgctgtagcgggggctgcgattatgggtattgcagtgtacgcatatgttaaaaacaacaaagatgaggatcaacttgcttaagtaagagagaaaggagccattgatgacaatgcagaaaatgcagaaaatgattagtcgtatcttctttgttatggctctgtgtttttctcttgtatggggtgcacatgcagtccaagcgcaagaagatcacacgttggtcttgcaattggagaactatcaggaggtggttagtcaattgccatctcgtgatggtcatcggttgcaagtatggaagttggatgattcgtattcctatgatgatcgggtgcaaattgtaagagacttgcattcgtgggatgagaataaactttcttctttcaaaaagacttcgtttgagatgaccttccttgagaatcagattgaagtatctcatattccaaatggtctttactatgttcgctctattatccagacggatgcggtttcttatccagctgaatttctttttgaaatgacagatcaaacggtagagcctttggtcattgtagcgaaaaaaacagatacaatgacaacaaaggtgaagctgataaaggtggatcaagaccacaatcgcttggagggtgtcggctttaaattggtatcagtagcaagagatggttctgaaaaagaggttcccttgattggagaataccgttacagttcttctggtcaagtagggagaactctctatactgataaaaatggagagatttttgtgacaaatcttcctcttgggaactatcgtttcaaggaggtggagccactggcaggctatgctgttacgacgctggatacggatgtccagctggtagatcatcagctggtgacgattacggttgtcaatcagaaattaccacgtggcaatgttgactttatgaaggtggatggtcggaccaatacctctcttcaaggggcaatgttcaaagtcatgaaagaagaaagcggacactatactcctgttcttcaaaatggtaaggaagtagttgtaacatcagggaaagatggtcgtttccgagtggaaggtctagagtatgggacatactatttatgggagctccaagctccaactggttatgttcaattaacatcgcctgtttcctttacaatcgggaaagatactcgtaaggaactggtaacagtggttaaaaataacaagcgaccacggattgatgtgccagatacaggggaagaaaccttgtatatcttgatgcttgttgccattttgttgtttggtagtggttattatcttacgaaaaaaccaaataactgatattcaatgtacatcattatgaaaaagatagcaggctgaagggaagaccagagtactctgaggtgatgttaatcaggaatcatggtgatgtggcatgaatcacaataacggatatgaggctgggcagattgtgccagcctcattgtgggttattgtttgtaaaacgataggactggtctggtaatcattttaggaatggacaggactgggattctgatttaaaatggatggtgaatcagaaagaaatgagattttctcgtttctcttagcagataggattgtctgttaggaaaagcgataaaatgatgagtttgaagataaagggatgctgataaaaatggtaaaaacaaaaaagcaaaaacgaaataatctcctattaggagtggtatttttcattggaatggcggtaatggcgtatccgctggtgtctcgcttgtattatcgagtggaatcaaatcaacaaattgctgactttgataaggaaaaagcaacgttggatgaggctgacattgatgaacgaatgaaattggcacaagccttcaatgactctttgaataatgtagtgagtggcgatccttggtcggaagaaatgaagaaaaaagggcgagcagagtatgcacgtatgttagaaatccatgagcggatggggcatgtggaaatccccgttattgacgtggatttgccggtttatgctggtactgctgaagaggtattgcagcaaggggctgggcatctagagggaacttctctgccgatcggaggcaattcgacccatgcggtgattacggcacatacaggtttgccaacagctaagatgtttacggatttgaccaaacttaaagttggggataagttttatgtgcacaatatcaaggaagtgatggcctatcaagtggatcaagtaaaggtgattgagccgacgaactttgatgatttattgattgtaccaggtcatgattatgtgaccttgctgacttgtacgccatacatgatcaatacccatcgtctattggttcgggggcatcggataccgtacgtagcagaggttgaggaagaatttattgcagcaaacaaactcagtcatctctatcgctacctgttttatgtggcagttggtttgattgtgattcttttatggattattcgacgcttgcgcaagaagaaaaaacaaccggaaaaggctttgaaggcgctgaaagcagcaaggaaggaagtgaaggtggaggatggacaacagtagacgttcacgaaaaaaaggcacaaaaaagaagaaacatccgctgatccttcttctgattttcttagtaggattcgccgttgcgatatatccattggtgtctcgttattattatcgtattgagtcaaacgaggttattaaagagtttgatgagacggtttcccagatggataaggcagaacttgaggagcgttggcgcttggctcaagccttcaatgcgaccttgaaaccatctgaaattcttgatccttttacagagcaagagaaaaagaaaggcgtctcagaatatgccaatatgctaaaggtccatgagcggattggctatgtggaaattcctgcgattgatcaggaaattccgatgtatgtcggaacgagtgaggaaattcttcagaagggcgcaggattgctagagggagcttcgttaccggttggtggtgaaaatacccacacagttgtcactgctcatagaggattaccgacggcagaactgtttagtcaattggataagatgaaaaaaggggatgtcttttatcttcacgttttagaccaggtgttggcctaccaagtggatcagattttgacggttgagccaaatgactttgagcctgtcttgattcaacatggggaagattatgcgaccttgttgacctgtacaccgtatatgattaacagtcatcgtctgttggtacgtgggaagcggattccgtatacggcaccaattgcagagcgaaatcgagcggtgagagagcgtgggcaattctggttgtggttattgctagcggcgttggttatgattctggtattgagttacggggtgtatcgtcatcgtcgcattgtcaaagggctagaaaaacaattggaggagcatcatgtcaaaggctaagctacagaaattactagggtatttgctgatgctggtagcattggtgattcctgtttattgttttgggcagatggtgttacagtctttaggacaagtaaaaggtcatgagatattttcagaatctgtgacggccgacagttaccaagagcaattgcaacggtcgcttgattacaatcaacgcttggattcgcaaaatcgtattgtagatccttttttggcggaagggtatgaggtaaattaccaagtgtctgacgatcctgatgcagtctacggctatttgtcgattccgagtttggaaatcatggagccagtttatctaggagcggattaccatcatttagcaatggggttggcccatgtggatgggacgcctcttcctgttgagggaaaagggattcgttcagtgattgctgggcaccgtgcagaaccaagccatgtctttttccgccatttggatcagctaaaagttggagatgctctttattatgataatggccaggaaattgtagaatatcagatgatggacacagagattattttaccgtcggaatgggaaaaattagaatcggttagctctaaaaatatcatgaccttgataacctgcgatccgattcctacctttaataaacgcttattagtgaattttgaacgagtcgctgtttatcaaaaatcagatccacaaacagctgcagttgcgagggttgcttttacgaaagaaggacaatctgtatcgcgtgttgcaacctctcaatggttgtaccgtgggctagtggtactggcatttctgggaatcctgtttgttttgtggaagctagcacgtttactacgagggaaataaaaagaaatgaaaggaaagctaaggctgttcctttttccggctctttgtcaactgtagtgggttgaaaaaaagctaagctcgagaaaggacaaattttgtcctttcttttttgatattcagagcgataaaaatccgttttttgaagttttcaaa

SEQ ID NO: 497 - DNA, 11351 bp, S. pneumoniae
gtttaggcgcttttcattataagtcttatgggacttttttgatactcaaaaagccctataatctccacagtgggatttacccactacagaaattatagagccagaaaaaacacttttgttcactagcagaaactagagagcagaagtgtttttctgttcagatttacccaaaactgggaaatatggggataagaatagagatggcttaggaagcccctttttgtgtgtagacagtacgatgaacttataacaaatagtgagcctttttagcaatcattgcgacccgtttgtcaaaagcctcttttcggatatctacaattgtctgatagatgagacgctgttggctaacatgcaaatctaaggcaatcgtcaaaaagtgatgtttccctttgggatactgctttttaacgtaaggcaggtattctttcgttgtaataataatcaatggctctgtcaaatgctcctctgaaggaggaggactaattagaatattgtatcctgtaacagaggcaactttgtcagtaaaattccgtaaaataatggactttattaagtttacatctgcttgattatttaaaatgataaaaatcgggatagcaggtagtgaggaaaagatggtttctgtcaagtagagtgagaaaaggtacagccgatgctggtcgataactccttcaatcttctgctcagtcatccactcttgaacaattgctttcgaaatatgatacagtggcttgtcgctttcaatcccataatgttcgtaataattataatagggaactagattttgtaaaccaaacaaaaacgttcttgttaagaaagtcagtgctgttaaaaaagaaagagaattcgaaatgtcatttcctaagatattcttgaacttggatagtagatgctttcctcttgtatgctgaagaatcagttgaatagtatgagtctttttttcttgattccatttgtccttggaaaacgaagaattagcagaacaataaaccaaaaagatataatccagttcttcctgagtaaaagtcatgttggcatgtggctctaagtaagtttggcaatgttccatcaaaatcggatacataaagaggttttttaatttttcaaactctttggactcagggaactcaagtggaaattcccgacgtttccaagtgagtgccactagtatgctaaaatgaacatactcgtcaggtgtgatttctaacagttcatgactgagttgagaattagactgcacaatcatatgtgtgacccaatccatacttccatcattcaaatcataaatctcaataccaaaatgaaactggaggagtgcaattaaaaaacgaatgcgatattcaggaccaactacttgatttttcacaaggtccaaacctactgaacgtagtaacaagccacacttttgtcgtacgcggtagcctgttgcgatggaaatatactctttttgtgtaaattcgttaaagctttgattaccttgtagtagaaagaagcggagtatttttaaaatagttgattggttataaagctgatggaagtaataattcgtttgatgagaatggtgttcgattaattgaacttgttgcgtatctaaattaaatgtcaactcttcctcgaatgtttcttgtaattcctgcaaaatgcttaggagacttttagattgtaatgaagttaaagtagacagttcatctagttcaatagaccgaatatccaataatatatttaaaatggtaattttatctgtaattcttttttcaatgtatttgtttagcatagttaccgaatcttagttgcatatagataattttaattattataatacaaaagaaactaattgtcttgtcaaaaaggttgtggaatttccgactttattgataaaacagcatgtaataaaaggcattttaaagatagtaatgagtattggtggagttttatggcttattttttttattagaaaatatttttttatcaaatattgtcgttctataaaaaaatatgtgataaaaatatctattgtgatggaagttgttttaatttatactaggatagttaatagtaatactatactatactatattgtatacaagtgtgtcattgccaggttgagaagatagctataacgcacttttatacgcttttgctacgtttgttagtgaacggattaactcagtgagataaattttatcagaacataagtaatccgtttcttcgtgtatacagattgaaagtacctatgaatcatagaaggattaacttgttctatgaataatgcttaacagggagacacacatgaaaaaagtaagaaagatatttcagaaggcagttgcaggactgtgctgtatatctcagttgacagctttttcttcgatagttgctttagcagaaacgcctgaaaccagtccagcgataggaaaagtagtgattaaggagacaggcgaaggaggagcgcttctaggagatgccgtctttgagttgaaaaacaatacggatggcacaactgtttcgcaaaggacagaggcgcaaacaggagaagcgatattttcaaacataaaacctgggacatacaccttgacagaagcccaacctccagttggttataaaccctctactaaacaatggactgttgaagttgagaagaatggtcggacgactgtccaaggtgaacaggtagaaaatcgagaagaggctctatctgaccagtatccacaaacagggacttatccagatgttcaaacaccttatcagattattaaggtagatggttcggaaaaaaacggacagcacaaggcgttgaatccgaatccatatgaacgtgtgattccagaaggtacactttcaaagagaatttatcaagtgaataatttggatgataaccaatatggaatcgagttgacggttagtggtaaaacgacggttgaaacgaaagaagcctctactccgctagatgttgttattctattagataactccaatagtatgagtaatattcgacataatcatgcccatcgagcggaaaaagcgggagaagcgacacgagcccttgtagataagattacctccaatccagataatcgagtagcacttgtgacttatggctcaactatctttgacggttcagaagctactgtggaaaaaggggtagcagatgcgaacggaaaaatattgaatgactcagctttatggacgttcgatcgtacgacgtttacagctaaaacttataattatagctttttaaatctcacatcagatcctactgatattcaaactattaaggataggattccatcagatgcagaggaattgaacaaagacaaattgatgtatcaattcggcgcgacttttacccagaaggctttgatgaccgctgatgatatcttgacaaagcaggcaagaccaaacagtaaaaaggttattttccacattacagatggtgttccgactatgtcatatccaattaattttaaatatacaggaacgacgcaatcgtacagaactcagctgaataattttaaagcaaaaactccaaatagtagcgggatattactggaggactttgttacatggtcagcagatggtgaacataagattgttcgtggagatggtgaaagttatcagatgtttacgaagaaacctgtaacagaccaatacggagttcatcaaatactttcaatcacctccatggagcagagagctaaattagtttcagcgggatataggttctatggaactgacttgtatttatattggcgtgatagtattctagcctatccatttaactctagtaccgattggattaccaaccatggtgaccctacgacttggtattataacggaaatatggctcaggatggctatgatgtcttcactgttggggttggtgtaaacggggatcctggtacggatgaagcaacggctactagatttatgcagagcatctctagttctcctgacaactacactaacgtagcagatccatctcagattttacaagaattgaatcgctacttctatactatcgtcaatgagaagaaatctatcgaaaatggtacgattacagacccgatgggtgaactaattgatttccaattgggagcagatggaaggtttgatccagcggattacactttaactgcaaacgatggtagttcgttggtgaataatgtccctactgggggaccacaaaatgatggtggcttgctaaaaaatgcaaaagtgttctatgatacgactgagaaaaggattcgtgtaacaggtttgtaccttggaacgggtgaaaaagttacattgacttataatgttcgcttgaatgaccaatttgtaagcaataaattctatgacacgaatggtcgaacaaccctacaccctaaggaagtagaaaagaacacagtgcgcgacttcccgattcctaagattcgtgatgtacgaaagtatccagaaatcacaattccaaaagagaaaaaacttggtgaaattgagtttattaagatcaataagaatgataaaaaaccactgagagatgcggtctttagtcttcaaaaacaacatccggattatccagatatttatggagctattgatcaaaatggcacttatcaaaatgtgagaacaggtgaagatggtaagttgacctttaaaaatctgtcagatgggaaatatcgattatttgaaaattctgaaccagctggttataaacccgttcaaaataagcctatcgttgccttccaaatagtaaatggagaagtcagagatgtgacttcaatcgttccacaagatataccagcgggttacgagtttacgaatgataagcactatatcacaaatgagccaattcctccaaaaagagaatatcctcgaactggtggtatcggaatgttgccattctatctgataggttgcatgatgatgggaggagttctattatacacacggaaacatccgtaaagtgtagcaatgagaaatgataatatcgatactctgagcgatacttttaagaagtagcactcaagaagagatttaagtttacttggtgaaaacagttttcttcgccaagtaaaccaccattgaaaggggagatgttttcgaaaacttgcacagaaaaaaggattattattgtcatgtgtaattcattacattgctcacagttgattttaagagatatgaataaggagaaatcatgaaatcaatcaacaaatttttaacaatgcttgctgccttattactgacagcgagtagcctgttttcagctgcaacagtttttgcggcggacaatgttagtacagcaccagatgctgttactaaaactttaacaatccataagttactgctctcagaagatgatttaaagacttgggatacaaacggtcctaaaggatatgatggaactcaatctagtttaaaagatttaactggagttgtagctgaggaaattccaaatgtatactttgaattacaaaagtataatttgactgatggtaaggaaaaagaaaatcttaaagatgatagtaaatggacaacagttcatggtggtttgacaactaaagatggacttaaaattgaaaccagtactcttaaaggtgtgtatcgtattcgtgaggatagaacaaagactacctatgttggtcctaatgggcaagtattaacaggttcaaaagccgtacctgctcttgtaactcttccacttgttaacaataatggtacagtaattgatgcacatgttttccctaaaaattcatataataaaccagttgtagataaaagaattgctgatactttgaattataacgatcaaaatggtctgtctatcggtactaaaatcccatatgttgttaatacaacaattccaagtaatgcaacatttgcaacttcattttggtcagatgaaatgacagaaggtctaacttataatgaagatgtaacaattactttgaataatgtagctatggatcaagctgattatgaagtcactaaaggaaataatggctttaacttaaaattaacagaagcaggtttagctaaaattaatggtaaggatgcagaccaaaaaatccaaattacttactcagctactttgaactcacttgctgttgcagacattcccgaaagtaacgatattacatatcattacggaaatcatcaagatcatgggaatactccaaaaccaactaaacctaataatggtcaaattacagtaactaagacatgggacagtcaacctgctcctgagggggtgaaagcgactgttcaacttgtaaatgccaagactggtgagaaagtcggtgctcctgtagaactttcagaaaataattggacatatacttggagtggtctagataattctattgaatacaaagttgaagaagaatataatggatactcagctgaatacacagtagagagcaaagggaagttgggggtaaaaaactggaaagataataacccagctccaatcaatcctgaagaaccacgtgtaaaaacatacggtaaaaagtttgtcaaagtagaccaaaaagatactcgtctagaaaatgcgcagttcgttgttaaaaaagcagatagcaataaatatattgcctttaagtcaactgcacaacaagctgcagatgaaaaagcagcagcaactgcaaaacaaaaattggatgcagcggtagcagcttacacaaatgctgcagataagcaagccgctcaagctctagtagatcaagcacagcaagaatacaatgtagcttacaaagaagccaaatttggttatgttgaagtagctggaaaagatgaagcaatggttcttacttctaatacggatggtcaattccaaatttcaggtcttgctgctggtacttataaattagaagaaattaaagctccagaaggttttgcgaaaattgatgatgtagaatttgttgttggagcaggttcttggaatcaaggtgagtttaattacttaaaagatgttcaaaagaatgacgctacaaaagtagtcaacaaaaaaatcactatcccacaaacgggtggtattggtacaattatctttgctgtagcgggggctgcgattatgggtattgcagtgtacgcatatgttaaaaacaacaaagatgaggatcaacttgcttaagtaagagagaaaggagccattgatgacaatgcagaaaatgcagaaaatgattagtcgtatcttctttgttatggctctgtgtttttctcttgtatggggtgcacatgcagtccaagcgcaagaagatcacacgttggtcttgcaattggagaactatcaggaggtggttagtcaattgccatctcgtgatggtcatcggttgcaagtatggaagttggatgattcgtattcctatgatgatcgggtgcaaattgtaagagacttgcattcgtgggatgagaataaactttcttctttcaaaaagacttcgtttgagatgaccttccttgagaatcagattgaagtatctcatattccaaatggtctttactatgttcgctctattatccagacggatgcggtttcttatccagctgaatttctttttgaaatgacagatcaaacggtagagcctttggtcattgtagcgaaaaaaacagatacaatgacaacaaaggtgaagctgataaaggtggatcaagaccacaatcgcttggagggtgtcggctttaaattggtatcagtagcaagagatggttctgaaaaagaggttcccttgattggagaataccgttacagttcttctggtcaagtagggagaactctctatactgataaaaatggagagatttttgtgacaaatcttcctcttgggaactatcgtttcaaggaggtggagccactggcaggctatgctgttacgacgctggatacggatgtccagctggtagatcatcagctggtgacgattacggttgtcaatcagaaattaccacgtggcaatgttgactttatgaaggtggatggtcggaccaatacctctcttcaaggggcaatgttcaaagtcatgaaagaagaaagcggacactatactcctgttcttcaaaatggtaaggaagtagttgtaacatcagggaaagatggtcgtttccgagtggaaggtctagagtatgggacatactatttatgggagctccaagctccaactggttatgttcaattaacatcgcctgtttcctttacaatcgggaaagatactcgtaaggaactggtaacagtggttaaaaataacaagcgaccacggattgatgtgccagatacaggggaagaaaccttgtatatcttgatgcttgttgccattttgttgtttggtagtggttattatcttacgaaaaaaccaaataactgatattcaatgtacatcattatgaaaaagatagcaggctgaagggaagaccagagtactctgaggtgatgttaatcaggaatcatggtgatgtggcatgaatcacaataacggatatgaggctgggcagattgtgccagcctcattgtgggttattgtttgtaaaacgataggactggtctggtaatcattttaggaatggacaggactgggattctgatttaaaatggatggtgaatcagaaagaaatgagattttctcgtttctcttagcagataggattgtctgttaggaaaagcgataaaatgatgagtttgaagataaagggatgctgataaaaatggtaaaaacaaaaaagcaaaaacgaaataatctcctattaggagtggtatttttcattggaatggcggtaatggcgtatccgctggtgtctcgcttgtattatcgagtggaatcaaatcaacaaattgctgactttgataaggaaaaagcaacgttggatgaggctgacattgatgaacgaatgaaattggcacaagccttcaatgactctttgaataatgtagtgagtggcgatccttggtcggaagaaatgaagaaaaaagggcgagcagagtatgcacgtatgttagaaatccatgagcggatggggcatgtggaaatccccgttattgacgtggatttgccggtttatgctggtactgctgaagaggtattgcagcaaggggctgggcatctagagggaacttctctgccgatcggaggcaattcgacccatgcggtgattacggcacatacaggtttgccaacagctaagatgtttacggatttgaccaaacttaaagttggggataagttttatgtgcacaatatcaaggaagtgatggcctatcaagtggatcaagtaaaggtgattgagccgacgaactttgatgatttattgattgtaccaggtcatgattatgtgaccttgctgacttgtacgccatacatgatcaatacccatcgtctattggttcgggggcatcggataccgtacgtagcagaggttgaggaagaatttattgcagcaaacaaactcagtcatctctatcgctacctgttttatgtggcagttggtttgattgtgattcttttatggattattcgacgcttgcgcaagaagaaaaaacaaccggaaaaggctttgaaggcgctgaaagcagcaaggaaggaagtgaaggtggaggatggacaacagtagacgttcacgaaaaaaaggcacaaaaaagaagaaacatccgctgatccttcttctgattttcttagtaggattcgccgttgcgatatatccattggtgtctcgttattattatcgtattgagtcaaacgaggttattaaagagtttgatgagacggtttcccagatggataaggcagaacttgaggagcgttggcgcttggctcaagccttcaatgcgaccttgaaaccatctgaaattcttgatccttttacagagcaagagaaaaagaaaggcgtctcagaatatgccaatatgctaaaggtccatgagcggattggctatgtggaaattcctgcgattgatcaggaaattccgatgtatgtcggaacgagtgaggaaattcttcagaagggcgcaggattgctagagggagcttcgttaccggttggtggtgaaaatacccacacagttgtcactgctcatagaggattaccgacggcagaactgtttagtcaattggataagatgaaaaaaggggatgtcttttatcttcacgttttagaccaggtgttggcctaccaagtggatcagattttgacggttgagccaaatgactttgagcctgtcttgattcaacatggggaagattatgcgaccttgttgacctgtacaccgtatatgattaacagtcatcgtctgttggtacgtgggaagcggattccgtatacggcaccaattgcagagcgaaatcgagcggtgagagagcgtgggcaattctggttgtggttattgctagcggcgttggttatgattctggtattgagttacggggtgtatcgtcatcgtcgcattgtcaaagggctagaaaaacaattggaggagcatcatgtcaaaggctaagctacagaaattactagggtatttgctgatgctggtagcattggtgattcctgtttattgttttgggcagatggtgttacagtctttaggacaagtaaaaggtcatgagatattttcagaatctgtgacggccgacagttaccaagagcaattgcaacggtcgcttgattacaatcaacgcttggattcgcaaaatcgtattgtagatccttttttggcggaagggtatgaggtaaattaccaagtgtctgacgatcctgatgcagtctacggctatttgtcgattccgagtttggaaatcatggagccagtttatctaggagcggattaccatcatttagcaatggggttggcccatgtggatgggacgcctcttcctgttgagggaaaagggattcgttcagtgattgctgggcaccgtgcagaaccaagccatgtctttttccgccatttggatcagctaaaagttggagatgctctttattatgataatggccaggaaattgtagaatatcagatgatggacacagagattattttaccgtcggaatgggaaaaattagaatcggttagctctaaaaatatcatgaccttgataacctgcgatccgattcctacctttaataaacgcttattagtgaattttgaacgagtcgctgtttatcaaaaatcagatccacaaacagctgcagttgcgagggttgcttttacgaaagaaggacaatctgtatcgcgtgttgcaacctctcaatggttgtaccgtgggctagtggtactggcatttctgggaatcctgtttgttttgtggaagctagcacgtttactacgagggaaataaaaagaaatgaaaggaaagctaaggctgttcctttttccggctctttgtcaactgtag

SEQ ID NO: 498 - DNA, 11345 bp, S. pneumoniae
gcgcttttcattataagtcttatgggacttttttgatactcaaaaagccctataatctccacagtgggatttacccactacagaaattatagagccagaaaaaacacttttgttcactagcagaaactagagagcagaagtgtttttctgttcagatttacccaaaactgggaaatatggggataagaatagagatggcttaggaagcccctttttgtgtgtagacagtacgatgaacttataacaaatagtgagcctttttagcaatcattgcgacccgtttgtcaaaagcctcttttcggatatctacaattgtctgatagatgagacgctgttggctaacatgcaaatctaaggcaatcgtcaaaaagtgatgtttccctttgggatactgctttttaacgtaaggcaggtattctttcgttgtaataataatcaatggctctgtcaaatgctcctctgaaggaggaggactaattagaatattgtatcctgtaacagaggcaactttgtcagtaaaattccgtaaaataatggactttattaagtttacatctgcttgattatttaaaatgataaaaatcgggatagcaggtagtgaggaaaagatggtttctgtcaagtagagtgagaaaaggtacagccgatgctggtcgataactccttcaatcttctgctcagtcatccactcttgaacaattgctttcgaaatatgatacagtggcttgtcgctttcaatcccataatgttcgtaataattataatagggaactagattttgtaaaccaaacaaaaacgttcttgttaagaaagtcagtgctgttaaaaaagaaagagaattcgaaatgtcatttcctaagatattcttgaacttggatagtagatgctttcctcttgtatgctgaagaatcagttgaatagtatgagtctttttttcttgattccatttgtccttggaaaacgaagaattagcagaacaataaaccaaaaagatataatccagttcttcctgagtaaaagtcatgttggcatgtggctctaagtaagtttggcaatgttccatcaaaatcggatacataaagaggttttttaatttttcaaactctttggactcagggaactcaagtggaaattcccgacgtttccaagtgagtgccactagtatgctaaaatgaacatactcgtcaggtgtgatttctaacagttcatgactgagttgagaattagactgcacaatcatatgtgtgacccaatccatacttccatcattcaaatcataaatctcaataccaaaatgaaactggaggagtgcaattaaaaaacgaatgcgatattcaggaccaactacttgatttttcacaaggtccaaacctactgaacgtagtaacaagccacacttttgtcgtacgcggtagcctgttgcgatggaaatatactctttttgtgtaaattcgttaaagctttgattaccttgtagtagaaagaagcggagtatttttaaaatagttgattggttataaagctgatggaagtaataattcgtttgatgagaatggtgttcgattaattgaacttgttgcgtatctaaattaaatgtcaactcttcctcgaatgtttcttgtaattcctgcaaaatgcttaggagacttttagattgtaatgaagttaaagtagacagttcatctagttcaatagaccgaatatccaataatatatttaaaatggtaattttatctgtaattcttttttcaatgtatttgtttagcatagttaccgaatcttagttgcatatagataattttaattattataatacaaaagaaactaattgtcttgtcaaaaaggttgtggaatttccgactttattgataaaacagcatgtaataaaaggcattttaaagatagtaatgagtattggtggagttttatggcttattttttttattagaaaatatttttttatcaaatattgtcgttctataaaaaaatatgtgataaaaatatctattgtgatggaagttgttttaatttatactaggatagttaatagtaatactatactatactatattgtatacaagtgtgtcattgccaggttgagaagatagctataacgcacttttatacgcttttgctacgtttgttagtgaacggattaactcagtgagataaattttatcagaacataagtaatccgtttcttcgtgtatacagattgaaagtacctatgaatcatagaaggattaacttgttctatgaataatgcttaacagggagacacacatgaaaaaagtaagaaagatatttcagaaggcagttgcaggactgtgctgtatatctcagttgacagctttttcttcgatagttgctttagcagaaacgcctgaaaccagtccagcgataggaaaagtagtgattaaggagacaggcgaaggaggagcgcttctaggagatgccgtctttgagttgaaaaacaatacggatggcacaactgtttcgcaaaggacagaggcgcaaacaggagaagcgatattttcaaacataaaacctgggacatacaccttgacagaagcccaacctccagttggttataaaccctctactaaacaatggactgttgaagttgagaagaatggtcggacgactgtccaaggtgaacaggtagaaaatcgagaagaggctctatctgaccagtatccacaaacagggacttatccagatgttcaaacaccttatcagattattaaggtagatggttcggaaaaaaacggacagcacaaggcgttgaatccgaatccatatgaacgtgtgattccagaaggtacactttcaaagagaatttatcaagtgaataatttggatgataaccaatatggaatcgagttgacggttagtggtaaaacgacggttgaaacgaaagaagcctctactccgctagatgttgttattctattagataactccaatagtatgagtaatattcgacataatcatgcccatcgagcggaaaaagcgggagaagcgacacgagcccttgtagataagattacctccaatccagataatcgagtagcacttgtgacttatggctcaactatctttgacggttcagaagctactgtggaaaaaggggtagcagatgcgaacggaaaaatattgaatgactcagctttatggacgttcgatcgtacgacgtttacagctaaaacttataattatagctttttaaatctcacatcagatcctactgatattcaaactattaaggataggattccatcagatgcagaggaattgaacaaagacaaattgatgtatcaattcggcgcgacttttacccagaaggctttgatgaccgctgatgatatcttgacaaagcaggcaagaccaaacagtaaaaaggttattttccacattacagatggtgttccgactatgtcatatccaattaattttaaatatacaggaacgacgcaatcgtacagaactcagctgaataattttaaagcaaaaactccaaatagtagcgggatattactggaggactttgttacatggtcagcagatggtgaacataagattgttcgtggagatggtgaaagttatcagatgtttacgaagaaacctgtaacagaccaatacggagttcatcaaatactttcaatcacctccatggagcagagagctaaattagtttcagcgggatataggttctatggaactgacttgtatttatattggcgtgatagtattctagcctatccatttaactctagtaccgattggattaccaaccatggtgaccctacgacttggtattataacggaaatatggctcaggatggctatgatgtcttcactgttggggttggtgtaaacggggatcctggtacggatgaagcaacggctactagatttatgcagagcatctctagttctcctgacaactacactaacgtagcagatccatctcagattttacaagaattgaatcgctacttctatactatcgtcaatgagaagaaatctatcgaaaatggtacgattacagacccgatgggtgaactaattgatttccaattgggagcagatggaaggtttgatccagcggattacactttaactgcaaacgatggtagttcgttggtgaataatgtccctactgggggaccacaaaatgatggtggcttgctaaaaaatgcaaaagtgttctatgatacgactgagaaaaggattcgtgtaacaggtttgtaccttggaacgggtgaaaaagttacattgacttataatgttcgcttgaatgaccaatttgtaagcaataaattctatgacacgaatggtcgaacaaccctacaccctaaggaagtagaaaagaacacagtgcgcgacttcccgattcctaagattcgtgatgtacgaaagtatccagaaatcacaattccaaaagagaaaaaacttggtgaaattgagtttattaagatcaataagaatgataaaaaaccactgagagatgcggtctttagtcttcaaaaacaacatccggattatccagatatttatggagctattgatcaaaatggcacttatcaaaatgtgagaacaggtgaagatggtaagttgacctttaaaaatctgtcagatgggaaatatcgattatttgaaaattctgaaccagctggttataaacccgttcaaaataagcctatcgttgccttccaaatagtaaatggagaagtcagagatgtgacttcaatcgttccacaagatataccagcgggttacgagtttacgaatgataagcactatatcacaaatgagccaattcctccaaaaagagaatatcctcgaactggtggtatcggaatgttgccattctatctgataggttgcatgatgatgggaggagttctattatacacacggaaacatccgtaaagtgtagcaatgagaaatgataatatcgatactctgagcgatacttttaagaagtagcactcaagaagagatttaagtttacttggtgaaaacagttttcttcgccaagtaaaccaccattgaaaggggagatgttttcgaaaacttgcacagaaaaaaggattattattgtcatgtgtaattcattacattgctcacagttgattttaagagatatgaataaggagaaatcatgaaatcaatcaacaaatttttaacaatgcttgctgccttattactgacagcgagtagcctgttttcagctgcaacagtttttgcggcggacaatgttagtacagcaccagatgctgttactaaaactttaacaatccataagttactgctctcagaagatgatttaaagacttgggatacaaacggtcctaaaggatatgatggaactcaatctagtttaaaagatttaactggagttgtagctgaggaaattccaaatgtatactttgaattacaaaagtataatttgactgatggtaaggaaaaagaaaatcttaaagatgatagtaaatggacaacagttcatggtggtttgacaactaaagatggacttaaaattgaaaccagtactcttaaaggtgtgtatcgtattcgtgaggatagaacaaagactacctatgttggtcctaatgggcaagtattaacaggttcaaaagccgtacctgctcttgtaactcttccacttgttaacaataatggtacagtaattgatgcacatgttttccctaaaaattcatataataaaccagttgtagataaaagaattgctgatactttgaattataacgatcaaaatggtctgtctatcggtactaaaatcccatatgttgttaatacaacaattccaagtaatgcaacatttgcaacttcattttggtcagatgaaatgacagaaggtctaacttataatgaagatgtaacaattactttgaataatgtagctatggatcaagctgattatgaagtcactaaaggaaataatggctttaacttaaaattaacagaagcaggtttagctaaaattaatggtaaggatgcagaccaaaaaatccaaattacttactcagctactttgaactcacttgctgttgcagacattcctgaaagtaacgatattacatatcattacggaaatcatcaagatcatgggaatactccaaaaccaactaaacctaataatggtcaaattacagtaactaagacatgggacagtcaacctgctcctgagggggtgaaagcgactgttcaacttgtaaatgccaagactggtgagaaagtcggtgctcctgtagaactttcagaaaataattggacatatacttggagtggtctagataattctattgaatacaaagttgaagaagaatataatggatactcagctgaatacacagtagagagcaaagggaagttgggggtaaaaaactggaaagataataacccagctccaatcaatcctgaagaaccacgtgtaaaaacatacggtaaaaagtttgtcaaagtagaccaaaaagatactcgtctagaaaatgcgcagttcgttgttaaaaaagcagatagcaataaatatattgcctttaagtcaactgcacaacaagctgcagatgaaaaagcagcagcaactgcaaaacaaaaattggatgcagcggtagcagcttacacaaatgctgcagataagcaagccgctcaagctctagtagatcaagcacagcaagaatacaatgtagcttacaaagaagccaaatttggttatgttgaagtagctggaaaagatgaagcaatggttcttacttctaatacggatggtcaattccaaatttcaggtcttgctgctggtacttataaattagaagaaattaaagctccagaaggttttgcgaaaattgatgatgtagaatttgttgttggagcaggttcttggaatcaaggtgagtttaattacttaaaagatgttcaaaagaatgacgctacaaaagtagtcaacaaaaaaatcactatcccacaaacgggtggtattggtacaattatctttgctgtagcgggggctgcgattatgggtattgcagtgtacgcatatgttaaaaacaacaaagatgaggatcaacttgcttaagtaagagagaaaggagccattgatgacaatgcagaaaatgcagaaaatgattagtcgtatcttctttgttatggctctgtgtttttctcttgtatggggtgcacatgcagtccaagcgcaagaagatcacacgttggtcttgcaattggagaactatcaggaggtggttagtcaattgccatctcgtgatggtcatcggttgcaagtatggaagttggatgattcgtattcctatgatgatcgggtgcaaattgtaagagacttgcattcgtgggatgagaataaactttcttctttcaaaaagacttcgtttgagatgaccttccttgagaatcagattgaagtatctcatattccaaatggtctttactatgttcgctctattatccagacggatgcggtttcttatccagctgaatttctttttgaaatgacagatcaaacggtagagcctttggtcattgtagcgaaaaaaacagatacaatgacaacaaaggtgaagctgataaaggtggatcaagaccacaatcgcttggagggtgtcggctttaaattggtatcagtagcaagagatggttctgaaaaagaggttcccttgattggagaataccgttacagttcttctggtcaagtagggagaactctctatactgataaaaatggagagatttttgtgacaaatcttcctcttgggaactatcgtttcaaggaggtggagccactggcaggctatgctgttacgacgctggatacggatgtccagctggtagatcatcagctggtgacgattacggttgtcaatcagaaattaccacgtggcaatgttgactttatgaaggtggatggtcggaccaatacctctcttcaaggggcaatgttcaaagtcatgaaagaagaaagcggacactatactcctgttcttcaaaatggtaaggaagtagttgtaacatcagggaaagatggtcgtttccgagtggaaggtctagagtatgggacatactatttatgggagctccaagctccaactggttatgttcaattaacatcgcctgtttcctttacaatcgggaaagatactcgtaaggaactggtaacagtggttaaaaataacaagcgaccacggattgatgtgccagatacaggggaagaaaccttgtatatcttgatgcttgttgccattttgttgtttggtagtggttattatcttacgaaaaaaccaaataactgatattcaatgtacatcattatgaaaaagatagcaggctgaagggaagaccagagtactctgaggtgatgttaatcaggaatcatggtgatgtggcatgaatcacaataacggatatgaggctgggcagattgtgccagcctcattgtgggttattgtttgtaaaacgataggactggtctggtaatcattttaggaatggacaggactgggattctgatttaaaatggatggtgaatcagaaagaaatgagattttctcgtttctcttagcagataggattgtctgttaggaaaagcgataaaatgatgagtttgaagataaagggatgctgataaaaatggtaaaaacaaaaaagcaaaaacgaaataatctcctattaggagtggtatttttcattggaatggcggtaatggcgtatccgctggtgtctcgcttgtattatcgagtggaatcaaatcaacaaattgctgactttgataaggaaaaagcaacgttggatgaggctgacattgatgaacgaatgaaattggcacaagccttcaatgactctttgaataatgtagtgagtggcgatccttggtcggaagaaatgaagaaaaaagggcgagcagagtatgcacgtatgttagaaatccatgagcggatggggcatgtggaaatccccgttattgacgtggatttgccggtttatgctggtactgctgaagaggtattgcagcaaggggctgggcatctagagggaacttctctgccgatcggaggcaattcgacccatgcggtgattacggcacatacaggtttgccaacagctaagatgtttacggatttgaccaaacttaaagttggggataagttttatgtgcacaatatcaaggaagtgatggcctatcaagtggatcaagtaaaggtgattgagccgacgaactttgatgatttattgattgtaccaggtcatgattatgtgaccttgctgacttgtacgccatacatgatcaatacccatcgtctattggttcgggggcatcggataccgtacgtagcagaggttgaggaagaatttattgcagcaaacaaactcagtcatctctatcgctacctgttttatgtggcagttggtttgattgtgattcttttatggattattcgacgcttgcgcaagaagaaaaaacaaccggaaaaggctttgaaggcgctgaaagcagcaaggaaggaagtgaaggtggaggatggacaacagtagacgttcacgaaaaaaaggcacaaaaaagaagaaacatccgctgatccttcttctgattttcttagtaggattcgccgttgcgatatatccattggtgtctcgttattattatcgtattgagtcaaacgaggttattaaagagtttgatgagacggtttcccagatggataaggcagaacttgaggagcgttggcgcttggctcaagccttcaatgcgaccttgaaaccatctgaaattcttgatccttttacagagcaagagaaaaagaaaggcgtctcagaatatgccaatatgctaaaggtccatgagcggattggctatgtggaaattcctgcgattgatcaggaaattccgatgtatgtcggaacgagtgaggaaattcttcagaagggcgcaggattgctagagggagcttcgttaccggttggtggtgaaaatacccacacagttgtcactgctcatagaggattaccgacggcagaactgtttagtcaattggataagatgaaaaaaggggatgtcttttatcttcacgttttagaccaggtgttggcctaccaagtggatcagattttgacggttgagccaaatgactttgagcctgtcttgattcaacatggggaagattatgcgaccttgttgacctgtacaccgtatatgattaacagtcatcgtctgttggtacgtgggaagcggattccgtatacggcaccaattgcagagcgaaatcgagcggtgagagagcgtgggcaattctggttgtggttattgctagcggcgttggttatgattctggtattgagttacggggtgtatcgtcatcgtcgcattgtcaaagggctagaaaaacaattggaggagcatcatgtcaaaggctaagctacagaaattactagggtatttgctgatgctggtagcattggtgattcctgtttattgttttgggcagatggtgttacagtctttaggacaagtaaaaggtcatgagatattttcagaatctgtgacggccgacagttaccaagagcaattgcaacggtcgcttgattacaatcaacgcttggattcgcaaaatcgtattgtagatccttttttggcggaagggtatgaggtaaattaccaagtgtctgacgatcctgatgcagtctacggctatttgtcgattccgagtttggaaatcatggagccagtttatctaggagcggattaccatcatttagcaatggggttggcccatgtggatgggacgcctcttcctgttgagggaaaagggattcgttcagtgattgctgggcaccgtgcagaaccaagccatgtctttttccgccatttggatcagctaaaagttggagatgctctttattatgataatggccaggaaattgtagaatatcagatgatggacacagagattattttaccgtcggaatgggaaaaattagaatcggttagctctaaaaatatcatgaccttgataacctgcgatccgattcctacctttaataaacgcttattagtgaattttgaacgagtcgctgtttatcaaaaatcagatccacaaacagctgcagttgcgagggttgcttttacgaaagaaggacaatctgtatcgcgtgttgcaacctctcaatggttgtaccgtgggctagtggtactggcatttctgggaatcctgtttgttttgtggaagctagcacgtttactacgagggaaataaaaagaaatgaaaggaaagctaaggctgttcctttttccggctctttgtcaactgtag

SEQ ID NO: 499 - DNA, 11351 bp, S. pneumoniae
gtttaggcgcttttcattataagtcttatgggacttttttgatactcaaaaagccctataatctccacagtgggatttacccactacagaaattatagagccagaaaaaacacttttgttcactagcagaaactagagagcagaagtgtttttctgttcagatttacccaaaactgggaaatatggggataagaatagagatggcttaggaagcccctttttgtgtgtagacagtacgatgaacttataacaaatagtgagcctttttagcaatcattgcgacccgtttgtcaaaagcctcttttcggatatctacaattgtctgatagatgagacgctgttggctaacatgcaaatctaaggcaatcgtcaaaaagtgatgtttccctttgggatactgctttttaacgtaaggcaggtattctttcgttgtaataataatcaatggctctgtcaaatgctcctctgaaggaggaggactaattagaatattgtatcctgtaacagaggcaactttgtcagtaaaattccgtaaaataatggactttattaagtttacatctgcttgattatttaaaatgataaaaatcgggatagcaggtagtgaggaaaagatggtttctgtcaagtagagtgagaaaaggtacagccgatgctggtcgataactccttcaatcttctgctcagtcatccactcttgaacaattgctttcgaaatatgatacagtggcttgtcgctttcaatcccataatgttcgtaataattataatagggaactagattttgtaaaccaaacaaaaacgttcttgttaagaaagtcagtgctgttaaaaaagaaagagaattcgaaatgtcatttcctaagatattcttgaacttggatagtagatgctttcctcttgtatgctgaagaatcagttgaatagtatgagtctttttttcttgattccatttgtccttggaaaacgaagaattagcagaacaataaaccaaaaagatataatccagttcttcctgagtaaaagtcatgttggcatgtggctctaagtaagtttggcaatgttccatcaaaatcggatacataaagaggttttttaatttttcaaactctttggactcagggaactcaagtggaaattcccgacgtttccaagtgagtgccactagtatgctaaaatgaacatactcgtcaggtgtgatttctaacagttcatgactgagttgagaattagactgcacaatcatatgtgtgacccaatccatacttccatcattcaaatcataaatctcaataccaaaatgaaactggaggagtgcaattaaaaaacgaatgcgatattcaggaccaactacttgatttttcacaaggtccaaacctactgaacgtagtaacaagccacacttttgtcgtacgcggtagcctgttgcgatggaaatatactctttttgtgtaaattcgttaaagctttgattaccttgtagtagaaagaagcggagtatttttaaaatagttgattggttataaagctgatggaagtaataattcgtttgatgagaatggtgttcgattaattgaacttgttgcgtatctaaattaaatgtcaactcttcctcgaatgtttcttgtaattcctgcaaaatgcttaggagacttttagattgtaatgaagttaaagtagacagttcatctagttcaatagaccgaatatccaataatatatttaaaatggtaattttatctgtaattcttttttcaatgtatttgtttagcatagttaccgaatcttagttgcatatagataattttaattattataatacaaaagaaactaattgtcttgtcaaaaaggttgtggaatttccgactttattgataaaacagcatgtaataaaaggcattttaaagatagtaatgagtattggtggagttttatggcttattttttttattagaaaatatttttttatcaaatattgtcgttctataaaaaaatatgtgataaaaatatctattgtgatggaagttgttttaatttatactaggatagttaatagtaatactatactatactatattgtatacaagtgtgtcattgccaggttgagaagatagctataacgcacttttatacgcttttgctacgtttgttagtgaacggattaactcagcatgagataaattttatcagaataagtaatccgtttcttcgtgtatacagattgaaagtacctatgaatcatagaaggattaacttgttctatgaataatgcttaacagggagacacacatgaaaaaagtaagaaagatatttcagaaggcagttgcaggactgtgctgtatatctcagttgacagctttttcttcgatagttgctttagcagaaacgcctgaaaccagtccagcgataggaaaagtagtgattaaggagacaggcgaaggaggagcgcttctaggagatgccgtctttgagttgaaaaacaatacggatggcacaactgtttcgcaaaggacagaggcgcaaacaggagaagcgatattttcaaacataaaacctgggacatacaccttgacagaagcccaacctccagttggttataaaccctctactaaacaatggactgttgaagttgagaagaatggtcggacgactgtccaaggtgaacaggtagaaaatcgagaagaggctctatctgaccagtatccacaaacagggacttatccagatgttcaaacaccttatcagattattaaggtagatggttcggaaaaaaacggacagcacaaggcgttgaatccgaatccatatgaacgtgtgattccagaaggtacactttcaaagagaatttatcaagtgaataatttggatgataaccaatatggaatcgagttgacggttagtggtaaaacgacggttgaaacgaaagaagcctctactccgctagatgttgttattctattagataactccaatagtatgagtaatattcgacataatcatgcccatcgagcggaaaaagcgggagaagcgacacgagcccttgtagataagattacctccaatccagataatcgagtagcacttgtgacttatggctcaactatctttgacggttcagaagctactgtggaaaaaggggtagcagatgcgaacggaaaaatattgaatgactcagctttatggacgttcgatcgtacgacgtttacagctaaaacttataattatagctttttaaatctcacatcagatcctactgatattcaaactattaaggataggattccatcagatgcagaggaattgaacaaagacaaattgatgtatcaattcggcgcgacttttacccagaaggctttgatgaccgctgatgatatcttgacaaagcaggcaagaccaaacagtaaaaaggttattttccacattacagatggtgttccgactatgtcatatccaattaattttaaatatacaggaacgacgcaatcgtacagaactcagctgaataattttaaagcaaaaactccaaatagtagcgggatattactggaggactttgttacatggtcagcagatggtgaacataagattgttcgtggagatggtgaaagttatcagatgtttacgaagaaacctgtaacagaccaatacggagttcatcaaatactttcaatcacctccatggagcagagagctaaattagtttcagcgggatataggttctatggaactgacttgtatttatattggcgtgatagtattctagcctatccatttaactctagtaccgattggattaccaaccatggtgaccctacgacttggtattataacggaaatatggctcaggatggctatgatgtcttcactgttggggttggtgtaaacggggatcctggtacggatgaagcaacggctactagatttatgcagagcatctctagttctcctgacaactacactaacgtagcagatccatctcagattttacaagaattgaatcgctacttctatactatcgtcaatgagaagaaatctatcgaaaatggtacgattacagacccgatgggtgaactaattgatttccaattgggagcagatggaaggtttgatccagcggattacactttaactgcaaacgatggtagttcgttggtgaataatgtccctactgggggaccacaaaatgatggtggcttgctaaaaaatgcaaaagtgttctatgatacgactgagaaaaggattcgtgtaacaggtttgtaccttggaacgggtgaaaaagttacattgacttataatgttcgcttgaatgaccaatttgtaagcaataaattctatgacacgaatggtcgaacaaccctacaccctaaggaagtagaaaagaacacagtgcgcgacttcccgattcctaagattcgtgatgtacgaaagtatccagaaatcacaattccaaaagagaaaaaacttggtgaaattgagtttattaagatcaataagaatgataaaaaaccactgagagatgcggtctttagtcttcaaaaacaacatccggattatccagatatttatggagctattgatcaaaatggcacttatcaaaatgtgagaacaggtgaagatggtaagttgacctttaaaaatctgtcagatgggaaatatcgattatttgaaaattctgaaccagctggttataaacccgttcaaaataagcctatcgttgccttccaaatagtaaatggagaagtcagagatgtgacttcaatcgttccacaagatataccagcgggttacgagtttacgaatgataagcactatatcacaaatgagccaattcctccaaaaagagaatatcctcgaactggtggtatcggaatgttgccattctatctgataggttgcatgatgatgggaggagttctattatacacacggaaaaatccgtaaagtgtagcaatgagaaatgataatatcgatactctgagcgatacttttaagaagtagcactcaagaagagatttaagtttacttggtgaaaacagttttcttcgccaagtaaaccaccattgaaaggggagatgttttcgaaaacttgcacagaaaaaaggattattattgtcatgtgtaattcattacattgctcacagttgattttaagagatatgaataaggagaaatcatgaaatcaatcaacaaatttttaacaatgcttgctgccttattactgacagcgagtagcctgttttcagctgcaacagtttttgcggcggacaatgttagtacagcaccagatgctgttactaaaactttaacaatccataagttactgctctcagaagatgatttaaagacttgggatacaaacggtcctaaaggatatgatggaactcaatctagtttaaaagatttaactggagttgtagctgaggaaattccaaatgtatactttgaattacaaaagtataatttgactgatggtaaggaaaaagaaaatcttaaagatgatagtaaatggacaacagttcatggtggtttgacaactaaagatggacttaaaattgaaaccagtactcttaaaggtgtgtatcgtattcgtgaggatagaacaaagactacctatgttggtcctaatgggcaagtattaacaggttcaaaagccgtacctgctcttgtaactcttccacttgttaacaataatggtacagtaattgatgcacatgttttccctaaaaattcatataataaaccagttgtagataaaagaattgctgatactttgaattataacgatcaaaatggtctgtctatcggtactaaaatcccatatgttgttaatacaacaattccaagtaatgcaacatttgcaacttcattttggtcagatgaaatgacagaaggtctaacttataatgaagatgtaacaattactttgaataatgtagctatggatcaagctgattatgaagtcactaaaggaattaatggctttaacttaaaattaacagaagcaggtttagctaaaattaatggtaaggatgcagaccaaaaaatccaaattacttactcagctactttgaactcacttgctgttgcagacattcctgaaagtaacgatattacatatcattacggaaatcatcaagatcatgggaatactccaaaaccaactaaacctaataatggtcaaattacagtaactaagacatgggacagtcaacctgctcctgagggggtgaaagcgactgttcaacttgtaaatgccaagactggtgagaaagtcggtgctcctgtagaactttcagaaaataattggacatatacttggagtggtctagataattctattgaatacaaagttgaagaagaatataatggatactcagctgaatacacagtagagagcaaagggaagttgggggtaaaaaactggaaagataataacccagctccaatcaatcctgaagaaccacgtgtaaaaacatacggtaaaaagtttgtcaaagtagaccaaaaagatactcgtctagaaaatgcgcagttcgttgttaaaaaagcagatagcaataaatatattgcctttaagtcaactgcacaacaagctgcagatgaaaaagcagcagcaactgcaaaacaaaaattggatgcagcggtagcagcttacacaaatgctgcagataagcaagccgctcaagctctagtagatcaagcacagcaagaatacaatgtagcttacaaagaagccaaatttggttatgttgaagtagctggaaaagatgaagcaatggttcttacttctaatacggatggtcaattccaaatttcaggtcttgctgctggtacttataaattagaagaaattaaagctccagaaggttttgcgaaaattgatgatgtagaatttgttgttggagcaggttcttggaatcaaggtgagtttaattacttaaaagatgttcaaaagaatgacgctacaaaagtagtcaacaaaaaaatcactatcccacaaacgggtggtattggtacaattatctttgctgtagcgggggctgcgattatgggtattgcagtgtacgcatatgttaaaaacaacaaagatgaggatcaacttgcttaagtaagagagaaaggagccattgatgacaatgcagaaaatgcagaaaatgattagtcgtatcttctttgttatggctctgtgtttttctcttgtatggggtgcacatgcagtccaagcgcaagaagatcacacgttggtcttgcaattggagaactatcaggaggtggttagtcaattgccatctcgtgatggtcatcggttgcaagtatggaagttggatgattcgtattcctatgatgatcgggtgcaaattgtaagagacttgcattcgtgggatgagaataaactttcttctttcaaaaagacttcgtttgagatgaccttccttgagaatcagattgaagtatctcatattccaaatggtctttactatgttcgctctattatccagacggatgcggtttcttatccagctgaatttctttttgaaatgacagatcaaacggtagagcctttggtcattgtagcgaaaaaaacagatacaatgacaacaaaggtgaagctgataaaggtggatcaagaccacaatcgcttggagggtgtcggctttaaattggtatcagtagcaagagatggttctgaaaaagaggttcccttgattggagaataccgttacagttcttctggtcaagtagggagaactctctatactgataaaaatggagagatttttgtgacaaatcttcctcttgggaactatcgtttcaaggaggtggagccactggcaggctatgctgttacgacgctggatacggatgtccagctggtagatcatcagctggtgacgattacggttgtcaatcagaaattaccacgtggcaatgttgactttatgaaggtggatggtcggaccaatacctctcttcaaggggcaatgttcaaagtcatgaaagaagaaagcggacactatactcctgttcttcaaaatggtaaggaagtagttgtaacatcagggaaagatggtcgtttccgagtggaaggtctagagtatgggacatactatttatgggagctccaagctccaactggttatgttcaattaacatcgcctgtttcctttacaatcgggaaagatactcgtaaggaactggtaacagtggttaaaaataacaagcgaccacggattgatgtgccagatacaggggaagaaaccttgtatatcttgatgcttgttgccattttgttgtttggtagtggttattatcttacgaaaaaaccaaataactgatattcaatgtacatcattatgaaaaagatagcaggctgaagggaagaccagagtactctgaggtgatgttaatcaggaatcatggtgatgtggcatgaatcacaataacggatatgaggctgggcagattgtgccagcctcattgtgggttattgtttgtaaaacgataggactggtctggtaatcattttaggaatggacaggactgggattctgatttaaaatggatggtgaatcagaaagaaatgagattttctcgtttctcttagcagataggattgtctgttaggaaaagcgataaaatgatgagtttgaagataaagggatgctgataaaaatggtaaaaacaaaaaagcaaaaacgaaataatctcctattaggagtggtatttttcattggaatggcggtaatggcgtatccgctggtgtctcgcttgtattatcgagtggaatcaaatcaacaaattgctgactttgataaggaaaaagcaacgttggatgaggctgacattgatgaacgaatgaaattggcacaagccttcaatgactctttgaataatgtagtgagtggcgatccttggtcggaagaaatgaagaaaaaagggcgagcagagtatgcacgtatgttagaaatccatgagcggatggggcatgtggaaatccccgttattgacgtggatttgccggtttatgctggtactgctgaagaggtattgcagcaaggggctgggcatctagagggaacttctctgccgatcggaggcaattcgacccatgcggtgattacggcacatacaggtttgccaacagcgaagatgtttacggatttgaccaaacttaaagttggggataagttttatgtgcacaatatcaaggaagtgatggcctatcaagtggatcaagtaaaggtgattgagccgacgaactttgatgatttattgattgtaccaggtcatgattatgtgaccttgctgacttgtacgccatacatgatcaatacccatcgtctattggttcgggggcatcggataccgtacgtagcagaggttgaggaagaatttattgcagcaaacaaactcagtcatctctatcgctacctgttttatgtggcagttggtttgattgtgattcttttatggattattcgacgcttgcgcaagaagaaaaaacaaccggaaaaggctttgaaggcgctgaaagcagcaaggaaggaagtgaaggtggaggatggacaacagtagacgttcacgaaaaaaaggcacaaaaaagaagaaacatccgctgatccttcttctgattttcttagtaggattcgccgttgcgatatatccattggtgtctcgttattattatcgtattgagtcaaacgaggttattaaagagtttgatgagacggtttcccagatggataaggcagaacttgaggagcgttggcgcttggctcaagccttcaatgcgaccttgaaaccatctgaaattcttgatccttttacagagcaagagaaaaagaaaggcgtctcagaatatgccaatatgctaaaggtccatgagcggattggctatgtggaaattcctgcgattgatcaggaaattccgatgtatgtcggaacgagtgaggaaattcttcagaagggcgcaggattgctagagggagcttcgttaccggttggtggtgaaaatacccacacagttgtcactgctcatagaggattaccgacggcagaactgtttagtcaattggataagatgaaaaaaggggatgtcttttatcttcacgttttagaccaggtgttggcctaccaagtggatcagattttgacggttgagccaaatgactttgagcctgtcttgattcaacatggggaagattatgcgaccttgttgacctgtacaccgtatatgattaacagtcatcgtctgttggtacgtgggaagcggattccgtatacggcaccaattgcagagcgaaatcgagcggtgagagagcgtgggcaattctggttgtggttattgctagcggcgttggttatgattctggtattgagttacggggtgtatcgtcatcgtcgcattgtcaaagggctagaaaaacaattggaggagcatcatgtcaaaggctaagctacagaaattactagggtatttgctgatgctggtagcattggtgattcctgtttattgttttgggcagatggtgttacagtctttaggacaagtaaaaggtcatgagatattttcagaatctgtgacggccgacagttaccaagagcaattgcaacggtcgcttgattacaatcaacgcttggattcgcaaaatcgtattgtagatccttttttggcggaagggtatgaggtaaattaccaagtgtctgacgatcctgatgcagtctacggctatttgtcgattccgagtttggaaatcatggagccagtttatctaggagcggattaccatcatttagcaatggggttggcccatgtggatgggacgcctcttcctgttgagggaaaagggattcgttcagtgattgctgggcaccgtgcagaaccaagccatgtctttttccgccatttggatcagctaaaagttggagatgctctttattatgataatggccaggaaattgtagaatatcagatgatggacacagagattattttaccgtcggaatgggaaaaattagaatcggttagctctaaaaatatcatgaccttgataacctgcgatccgattcctacctttaataaacgcttattagtgaattttgaacgagtcgctgtttatcaaaaatcagatccacaaacagctgcagttgcgagggttgcttttacgaaagaaggacaatctgtatcgcgtgttgcaacctctcaatggttgtaccgtgggctagtggtactggcatttatgggaatcctgtttgttttgtggaagctagcacgtttactacgagggaaataaaaagaaatgaaaggaaagctaaggctgttcctttttccggctctttgtcaactgtag

SEQ ID NO: 500 - DNA, 11349 bp, S. pneumoniae
tttaggcgcttttcattataagtcttatgggacttttttgatactcaaaaagccctataatctccacagtgggatttacccactacagaaattatagagccagaaaaaacacttttgttcactagcagaaactagagagcagaagtgtttttctgttcagatttacccaaaactgggaaatatggggataagaatagagatggcttaggaagcccctttttgtgtgtagacagtacgatgaacttataacaaatagtgagcctttttagcaatcattgcgacccgtttgtcaaaagcctcttttcggatatctacaattgtctgatagatgagacgctgttggctaacatgcaaatctaaggcaatcgtcaaaaagtgatgtttccctttgggatactgctttttaacgtaaggcaggtattctttcgttgtaataataatcaatggctctgtcaaatgctcctctgaaggaggaggactaattagaatattgtatcctgtaacagaggcaactttgtcagtaaaattccgtaaaataatggactttattaagtttacatctgcttgattatttaaaatgataaaaatcgggatagcaggtagtgaggaaaagatggtttctgtcaagtagagtgagaaaaggtacagccgatgctggtcgataactccttcaatcttctgctcagtcatccactcttgaacaattgctttcgaaatatgatacagtggcttgtcgctttcaatcccataatgttcgtaataattataatagggaactagattttgtaaaccaaacaaaaacgttcttgttaagaaagtcagtgctgttaaaaaagaaagagaattcgaaatgtcatttcctaagatattcttgaacttggatagtagatgctttcctcttgtatgctgaagaatcagttgaatagtatgagtctttttttcttgattccatttgtccttggaaaacgaagaattagcagaacaataaaccaaaaagatataatccagttcttcctgagtaaaagtcatgttggcatgtggctctaagtaagtttggcaatgttccatcaaaatcggatacataaagaggttttttaatttttcaaactctttggactcagggaactcaagtggaaattcccgacgtttccaagtgagtgccactagtatgctaaaatgaacatactcgtcaggtgtgatttctaacagttcatgactgagttgagaattagactgcacaatcatatgtgtgacccaatccatacttccatcattcaaatcataaatctcaataccaaaatgaaactggaggagtgcaattaaaaaacgaatgcgatattcaggaccaactacttgatttttcacaaggtccaaacctactgaacgtagtaacaagccacacttttgtcgtacgcggtagcctgttgcgatggaaatatactctttttgtgtaaattcgttaaagctttgattaccttgtagtagaaagaagcggagtatttttaaaatagttgattggttataaagctgatggaagtaataattcgtttgatgagaatggtgttcgattaattgaacttgttgcgtatctaaattaaatgtcaactcttcctcgaatgtttcttgtaattcctgcaaaatgcttaggagacttttagattgtaatgaagttaaagtagacagttcatctagttcaatagaccgaatatccaataatatatttaaaatggtaattttatctgtaattcttttttcaatgtatttgtttagcatagttaccgaatcttagttgcatatagataattttaattattataatacaaaagaaactaattgtcttgtcaaaaaggttgtggaatttccgactttattgataaaacagcatgtaataaaaggcattttaaagatagtaatgagtattggtggagttttatggcttattttttttattagaaaatatttttttatcaaatattgtcgttctataaaaaaatatgtgataaaaatatctattgtgatggaagttgttttaatttatactaggatagttaatagtaatactatactatactatattgtatacaagtgtgtcattgccaggttgagaagatagctataacgcacttttatacgcttttgctacgtttgttagtgaacggattaactcagcatgagataaattttatcagaataagtaatccgtttcttcgtgtatacagattgaaagtacctatgaatcatagaaggattaacttgttctatgaataatgcttaacagggagacacacatgaaaaaagtaagaaagatatttcagaaggcagttgcaggactgtgctgtatatctcagttgacagctttttcttcgatagttgctttagcagaaacgcctgaaaccagtccagcgataggaaaagtagtgattaaggagacaggcgaaggaggagcgcttctaggagatgccgtctttgagttgaaaaacaatacggatggcacaactgtttcgcaaaggacagaggcgcaaacaggagaagcgatattttcaaacataaaacctgggacatacaccttgacagaagcccaacctccagttggttataaaccctctactaaacaatggactgttgaagttgagaagaatggtcggacgactgtccaaggtgaacaggtagaaaatcgagaagaggctctatctgaccagtatccacaaacagggacttatccagatgttcaaacaccttatcagattattaaggtagatggttcggaaaaaaacggacagcacaaggcgttgaatccgaatccatatgaacgtgtgattccagaaggtacactttcaaagagaatttatcaagtgaataatttggatgataaccaatatggaatcgagttgacggttagtggtaaaacgacggttgaaacgaaagaagcctctactccgctagatgttgttattctattagataactccaatagtatgagtaatattcgacataatcatgcccatcgagcggaaaaagcgggagaagcgacacgagcccttgtagataagattacctccaatccagataatcgagtagcacttgtgacttatggctcaactatctttgacggttcagaagctactgtggaaaaaggggtagcagatgcgaacggaaaaatattgaatgactcagctttatggacgttcgatcgtacgacgtttacagctaaaacttataattatagctttttaaatctcacatcagatcctactgatattcaaactattaaggataggattccatcagatgcagaggaattgaacaaagacaaattgatgtatcaattcggcgcgacttttacccagaaggctttgatgaccgctgatgatatcttgacaaagcaggcaagaccaaacagtaaaaaggttattttccacattacagatggtgttccgactatgtcatatccaattaattttaaatatacaggaacgacgcaatcgtacagaactcagctgaataattttaaagcaaaaactccaaatagtagcgggatattactggaggactttgttacatggtcagcagatggtgaacataagattgttcgtggagatggtgaaagttatcagatgtttacgaagaaacctgtaacagaccaatacggagttcatcaaatactttcaatcacctccatggagcagagagctaaattagtttcagcgggatataggttctatggaactgacttgtatttatattggcgtgatagtattctagcctatccatttaactctagtaccgattggattaccaaccatggtgaccctacgacttggtattataacggaaatatggctcaggatggctatgatgtcttcactgttggggttggtgtaaacggggatcctggtacggatgaagcaacggctactagatttatgcagagcatctctagttctcctgacaactacactaacgtagcagatccatctcagattttacaagaattgaatcgctacttctatactatcgtcaatgagaagaaatctatcgaaaatggtacgattacagacccgatgggtgaactaattgatttccaattgggagcagatggaaggtttgatccagcggattacactttaactgcaaacgatggtagttcgttggtgaataatgtccctactgggggaccacaaaatgatggtggcttgctaaaaaatgcaaaagtgttctatgatacgactgagaaaaggattcgtgtaacaggtttgtaccttggaacgggtgaaaaagttacattgacttataatgttcgcttgaatgaccaatttgtaagcaataaattctatgacacgaatggtcgaacaaccctacaccctaaggaagtagaaaagaacacagtgcgcgacttcccgattcctaagattcgtgatgtacgaaagtatccagaaatcacaattccaaaagagaaaaaacttggtgaaattgagtttattaagatcaataagaatgataaaaaaccactgagagatgcggtctttagtcttcaaaaacaacatccggattatccagatatttatggagctattgatcaaaatggcacttatcaaaatgtgagaacaggtgaagatggtaagttgacctttaaaaatctgtcagatgggaaatatcgattatttgaaaattctgaaccagctggttataaacccgttcaaaataagcctatcgttgccttccaaatagtaaatggagaagtcagagatgtgacttcaatcgttccacaagatataccagcgggttacgagtttacgaatgataagcactatatcacaaatgagccaattcctccaaaaagagaatatcctcgaactggtggtatcggaatgttgccattctatctgataggttgcatgatgatgggaggagttctattatacacacggaaaaatccgtaaagtgtagcaatgagaaatgataatatcgatactctgagcgatacttttaagaagtagcactcaagaagagatttaagtttacttggtgaaaacagttttcttcgccaagtaaaccaccattgaaaggggagatgttttcgaaaacttgcacagaaaaaaggattattattgtcatgtgtaattcattacattgctcacagttgattttaagagatatgaataaggagaaatcatgaaatcaatcaacaaatttttaacaatgcttgctgccttattactgacagcgagtagcctgttttcagctgcaacagtttttgcggcggacaatgttagtacagcaccagatgctgttactaaaactttaacaatccataagttactgctctcagaagatgatttaaagacttgggatacaaacggtcctaaaggatatgatggaactcaatctagtttaaaagatttaactggagttgtagctgaggaaattccaaatgtatactttgaattacaaaagtataatttgactgatggtaaggaaaaagaaaatcttaaagatgatagtaaatggacaacagttcatggtggtttgacaactaaagatggacttaaaattgaaaccagtactcttaaaggtgtgtatcgtattcgtgaggatagaacaaagactacctatgttggtcctaatgggcaagtattaacaggttcaaaagccgtacctgctcttgtaactcttccacttgttaacaataatggtacagtaattgatgcacatgttttccctaaaaattcatataataaaccagttgtagataaaagaattgctgatactttgaattataacgatcaaaatggtctgtctatcggtactaaaatcccatatgttgttaatacaacaattccaagtaatgcaacatttgcaacttcattttggtcagatgaaatgacagaaggtctaacttataatgaagatgtaacaattactttgaataatgtagctatggatcaagctgattatgaagtcactaaaggaattaatggctttaacttaaaattaacagaagcaggtttagctaaaattaatggtaaggatgcagaccaaaaaatccaaattacttactcagctactttgaactcacttgctgttgcagacattcctgaaagtaacgatattacatatcattacggaaatcatcaagatcatgggaatactccaaaaccaactaaacctaataatggtcaaattacagtaactaagacatgggacagtcaacctgctcctgagggggtgaaagcgactgttcaacttgtaaatgccaagactggtgagaaagtcggtgctcctgtagaactttcagaaaataattggacatatacttggagtggtctagataattctattgaatacaaagttgaagaagaatataatggatactcagctgaatacacagtagagagcaaagggaagttgggggtaaaaaactggaaagataataacccagctccaatcaatcttgaagaaccacgtgtaaaaacatacggtaaaaagtttgtcaaagtagaccaaaaagatactcgtctagaaaatgcgcagttcgttgttaaaaaagcagatagcaataaatatattgcctttaagtcaactgcacaacaagctgcagatgaaaaagcagcagcaactgcaaaacaaaaattggatgcagcggtagcagcttacacaaatgctgcagataagcaagccgctcaagctctagtagatcaagcacagcaagaatacaatgtagcttacaaagaagccaaatttggttatgttgaagtagctggaaaagatgaagcaatggttcttacttctaatacggatggtcaattccaaatttcaggtcttgctgctggtacttataaattagaagaaattaaagctccagaaggttttgcgaaaattgatgatgtagaatttgttgttggagcaggttcttggaatcaaggtgagtttaattacttaaaagatgttcaaaagaatgacgctacaaaagtagtcaacaaaaaaatcacgatcccacaaacgggtggtattggtacaattatctttgctgtagcaggggctgtgattatgggtattgcagtgtacgcatatgttaaaaacaacaaagatgaggatcaacttgcttaagtaagagagaaaggagccattgatgacaatgcagaaaatgcagaaaatgattagtcgtatcttctttgttatggctctgtgtttttctcttgtatggggtgcacatgcagtccaagcgcaagaagatcacacgttggtcttgcaattggagaactatcaggaggtggttagtcaattgccatctcgtgatggtcatcggttgcaggtatggaagttggatgattcgtattcctatgataatcgggtgcaaattgtgagagacttgcattcgtgggatgagaataaactttcttctttcaaaaagacttcgtttgagatgaccttccttgagaatcagattgaagtatctcatattccaaatggtctttactatgttcgctctattatccagacggatgcggtttcttatccagctgaatttctttttgaaatgacagatcagacggtagagcctttggtcattgtagcgaaaaaagcagatacggtgacaacaaaggtgaagctgataaaggtggatcaagaccacaatcgcttggagggtgtcggctttaaattggtatcagtagcaagagatggttctgaaaaagaggttcccttgattggagaataccgttacagttcttctggtcaagtagggagaactctctatactgataaaaatggagagattgttgtgacaaatcttcctcttgggacctatcgtttcaaggaggtggagccactggcaggctatgctgttacgacgatggatacggatgtccagttggtagatcatcagctggtgacgattacggttgtcaatcagaaattaccacgtggcaatgttgactttatgaaggtggatggtaggaccaatacctctcttcaaggggcaatgttcaaagtcatgaaagaagaaaacggacactatactcctgttcttcaaaatggtaaggaagtagttgtggcatcagggaaagatggtcgtttccgagtggaaggtctagagtatgggacatactatttatgggagctccaagctccaactggttatgttcaattaacatcgcctgtttcctttacaatcgggaaagatactcgtaaggaactggtaacagtggttaaaaataacaagcgaccacggattgatgtgccagatacaggggaagaaaccttgtatatcttgatgcttgttgccattttgttgtttggtagtggctattatcttacgaaaaaaacaaataactgatattcaatgtacatcattatgaaaaagatagcaggctgaagggaagaccagagtactctgaggtgatgttaatcaggaatcatggtgatttggcatgaatcataataacggatatgaggctgggcagattgtgccagcctcattgtgggttattgtttgtaaaacgataggactggtctggtaatcattttaggaatggacaggactgggattctgatttaaaatggatggtgaatcagaaagaaatgagattttctcgtttctcttagcagataggattgtctgttaggaaaagcgataaaatgatgagtttgaagttaaaggaatgctgataaaaaatggcaaaaacaaaaaagcaaaaacgaaacaatctcctattaggagtggtatttttcattggaatagcggtaatggcgtatccgctggtgtctcgcttgtattatcgagtggaatcaaatcaacaaattgctgactttgataaggaaaaagcaacgttggatgaggctgacattgatgaacgaatgaaattggcacaagccttcaatgactctttgaataatgtagtgagtggcgatccttggtcggaagaaatgaagaaaaaagggcgagcagagtatgcacgcatgttagaaatccatgagcggatggggcatgtggaaatccctgctattgatgtagatttgccggtttatgctggtactgctgaagaggtattgcagcaaggcgctggacatctagagggaacttctctaccgatcggaggcaattcgacccatgcggtgattacggcacatacaggtttgccaacggctaagatgtttacggatttgaccaaacttaaagttggggataagttttatgtgcacaatatcaaggaagtgatggcctatcaagtggatcaagtaaaggtgattgagccgacgaactttgatgatttattgattgtaccaggtcatgattatgtgaccttgctgacctgtacgccatacatgatcaatacccatcgtctattggttcgggggcatcggataccgtacgtagcagaggttgaggaagaatttattgcggcaaacaaactcagtcatctctatcgctacctgttttatgtggcagttggtttgattgtgattcttttatggattattcgacgcttgcgcaagaagaaacggcaatcagaaagagctttgaaagcattgaaggaagctactaaggaagtgaaggtagaggatgagtaagagtagatattcacggaaaaagagcgtgaaaaagaagaaaaatccgttcattcttcttctgatttttttggtggggcttgccgttgcgatgtatcccttggtgtctcgttattattatcgtattgagtcaaacgaggttattaaagagtttgatgagacggtttcccagatggataaggcggaacttgaggagcgttggcgcttggctcaagccttcaatgcgaccttgaaaccatctgaaattcttgatccttttacagagcaagagaaaaagaaaggcgtctcagaatatgccaatatgctaaaggtccatgagcggattggctatgtggaaattcctgcgattgatcaggaaattccgatgtatgtcggaacgagtgaggaaattcttcagaagggcgcaggattgctagagggagcttcgttaccggttggtggtgaaaatacccacacagttgtcactgctcatagaggattaccgacggcagaactgtttagtcaattggataagatgaaaaaaggggatatcttttatcttcacgttttagatcaggtgttggcctaccaagtggatcagatagtgacggtggagccgaatgactttgagcctgtcttgattcaacatggggaagattatgcgaccttgttgacttgtacaccgtatatgattaacagtcatcgtctgttggtacgtgggaagcggattccgtatacggcaccaattgcagagcggaatcgagcggtgagagagcgtgggcaattctggttgtggttattactaggagcgatggcggtcatccttctcttgctgtatcgcgtgtatcgtaatcgacggattgtcaaaggactagaaaagcaattggaggggcgtcatgtcaaggactaaactacgagccttattgggatacttgttgatgttggtagcctgtttgattcctatttattgttttggacagatggtgttgcagtctcttggacaggtgaaaggtcatgctacatttgtgaaatccatgacaactgaaatgtaccaagaacaacagaaccattctctcgcctacaatcaacgcttggcttcgcaaaatcgcattgtagatccttttttggcggagggatatgaggtcaattaccaagtgtctgacgaccctgatgcagtctatggttacttgtctattccaagtttggaaatcatggagccggtttatttgggagcagattatcatcatttagggatgggcttggctcatgtggatggtacaccgctgcctctggatggtacagggattcgctcagtgattgctgggcaccgtgcagagccaagccatgtctttttccgccatttggatcagctaaaagttggagatgctctttattatgataatggccaggaaattgtagaatatcagatgatggacacagagattattttaccgtcggaatgggaaaaattagaatcggttagctctaaaaatatcatgaccttgataacctgcgatccgattcctacctttaataaacgcttattagtgaattttgaacgagtcgctgtttatcaaaaatcagatccacaaacagctgcagttgcgagggttgcttttacgaaagaaggacaatctgtatcgcgtgttgcaacctctcaatggttgtaccgtgggctagtggtactggcatttctgggaatcctgtttgttttgtggaagctagcacgtttactacgagggaaataaaaagaaatgaaaggaaagctaaggctgttcctttttccggctctttgtcaactgt

SEQ ID NO: 501 - DNA, 11405 bp, S. pneumoniae
ttttcattataaatcttatgggacttttttgatactcaaaaagccctataatctccacagtgggatttacccactacagaaattatagagccagaaaaaacacttttgttcactagcagaaactagagagcagaagtgtttttctgttcagatttacccaaaactgggaaatatggggataagaatagagatggcttaggaagcccctttttgtgtgtagacagtacgatgaacttataacaaatagtgagcctttttagcaatcattgcgacccgtttgtcaaaagcctcttttcggatatctacaattgtctgatagatgagacgctgttggctaacatgcaaatctaaggcaatcgtcaaaaagtgatgtttccctttgggatactgctttttaacgtaaggcaggtattctttcgttgtaataataatcaatggctctgtcaaatgctcctctgaaggaggaggactaattagaatattgtatcctgtaacagaggcaactttgtcagtaaaattccgtaaaataatggactttattaagtttacatctgcttgattatttaaaatgataaaaatcgggatagcaggtagtgaggaaaagatggtttctgtcaagtagagtgagaaaaggtacagccgatgctggtcgataactccttcaatcttctgctcagtcatccactcttgaacaattgctttcgaaatatgatacagtggcttgtcgctttcaatcccataatgttcgtaataattataatagggaactagattttgtaaaccaaacaaaaacgttcttgttaagaaagtcagtgctgttaaaaaagaaagagaattcgaaatgtcatttcctaagatattcttgaacttggatagtagatgctttcctcttgtatgctgaagaatcagttgaatagtatgagtctttttttcttgattccatttgtccttggaaaacgaagaattagcagaacaataaaccaaaaagatataatccagttcttcctgagtaaaagtcatgttggcatgtggctctaagtaagtttggcaatgttccatcaaaatcggatacataaagaggttttttaatttttcaaactctttggactcagggaactcaagtggaaattcccgacgtttccaagtgagtgccactagtatgctaaaatgaacatactcgtcaggtgtgatttctaacagttcatgactgagttgagaattagactgcacaatcatatgtgtgacccaatccatacttccatcattcaaatcataaatctcaataccaaaatgaaactggaggagtgcaattaaaaaacgaatgcgatattcaggaccaactacttgatttttcacaaggtccaaacctactgaacgtagtaacaagccacacttttgtcgtacgcggtagcctgttgcgatggaaatatactctttttgtgtaaattcgttaaagctttgattaccttgtagtagaaagaagcggagtatttttaaaatagttgattggttataaagctgatggaagtaataattcgtttgatgagaatggtgttcgattaattgaacttgttgcgtatctaaattaaatgtcaactcttcctcgaatgtttcttgtaattcctgcaaaatgcttaggagacttttagattgtaatgaagttaaagtagacagttcatctagttcaatagaccgaatatccaataatatatttaaaatggtaattttatctgtaattcttttttcaatgtatttgtttagcatagttaccgaatcttagttgcatatagataattttaattattataatacaaaagaaactaattgtcttgtcaaaaaggttgtggaatttccgactttattgataaaacagcatgtaataaaaggcattttaaagatagtaatgagtattggtggagttttatggcttattttttttattagaaaatatttttttatcaaatattgtcgttctataaaaaaatatgtgataaaaatatctattgtgatggaagttgttttaatttatactaggatagttaatagtaatactatactatactatattgtatacaagtgtgtcattgccaggttgagaagatagctataacgcacttttatacgcttttgctacgtttgttagtgaacggattaactcagtgagataaattttatcagaacataagtaatccgtttcttcgtgtatacagattgaaagtacctatgaatcatagaaggattaacttgttctatgaataatgcttaacagggagacacacatgaaaaaagtaagaaagatatttcagaaggcagttgcaggactgtgctgtatatctcagttgacagctttttcttcgatagttgctttagcagaaacgcctgaaaccagtccagcgataggaaaagtagtgattaaggagacaggcgaaggaggagcgcttctaggagatgccgtctttgagttgaaaaacaatacggatggcacaactgtttcgcaaaggacagaggcgcaaacaggagaagcgatattttcaaacataaaacctgggacatacaccttgacagaagcccaacctccagttggttataaaccctctactaaacaatggactgttgaagttgagaagaatggtcggacgactgtccaaggtgaacaggtagaaaatcgagaagaggctctatctgaccagtatccacaaacagggacttatccagatgttcaaacaccttatcagattattaaggtagatggttcggaaaaaaacggacagcacaaggcgttgaatccgaatccatatgaacgtgtgattccagaaggtacactttcaaagagaatttatcaagtgaataatttggatgataaccaatatggaatcgaattgacggttagtgggaaaacagtgtatgaacgaaaagataagtctgtgccgctggatgtcgttatcttgctcgataactcaaatagtatgagtaacattcgaaacaagaatgctcgacgtgcggaaagagctggtgaggcgacacgttctcttattgataaaattacatctgatccagaaaatagggtagcgcttgtgacttatgcttccactatctttgatgggaccgagtttacagtagaaaaaggggtagcagataaaaacggaaaacgattgaatgattctcttttttggaattatgatcagacgagttttacaaccaataccaaagattatagttatttaaagctgactaatgataagaatgacattgtagaattaaaaaataaggtacctaccgaggcagaagatcatgatggaaatagattgatgtaccaattcggtgccacttttactcagaaagctttgatgaaggcagatgagattttgacacaacaagcgagacaaaatagtcaaaaagtcattttccatattacggatggtgtcccaactatgtcgtatccgattaattttaatcatgctacgtttgctccatcatatcaaaatcaactaaatgcattttttagtaaatctcctaataaagatggaatactattaagtgattttattacgcaagcaactagtggagaacatacaattgtacgcggagatgggcaaagttaccagatgtttacagataagacagtttatgaaaaaggtgctcctgcagctttcccagttaaacctgaaaaatattctgaaatgaaggcggttggttatgcagttataggcgatccaattaatggtggatatatttggcttaattggagagagagtattctggcttatccgtttaattctaatactgctaaaattaccaatcatggtgcccctacaagatggtactataacgggaatattgctcctgatgggtatgatgtctttacggtaggtattggtattaacggagatcctggtacggatgaagcaacggctactagttttatgcaaagtatttctagtaaacctgaaaactataccaatgttactgacacgacaaaaatattggaacagttgaatcgttatttccacaccatcgtaactgaaaagaaatcaattgagaatggtacgattacagatccgatgggtgagttaattgatttgcaattgggcacagatggaagatttgatccagcagattacactttaactgcaaacgatggtagtcgcttggagaatggacaagctgtaggtggtccacaaaatgatggtggcttgctaaaaaatgcaaaagtgttctatgatacgactgagaaaaggattcgtgtaacaggtttgtaccttggaacgggtgaaaaagttacattgacttataatgttcgcttgaatgaccaatttgtaagcaataaattctatgacacgaatggtcgaacaaccctacaccctaaggaagtagaaaagaacacagtgcgcgacttcccgattcctaagattcgtgatgtgcgaaaatatccagcaattacgattgcaaaagagaaaaaacttggtgaaattgagtttattaagatcaataagaatgataaaaaaccactgagagatgcggtctttagtcttcaaaaacaacatccggattatccagatatttatggagctattgatcaaaatggcacttatcaaaatgtgagaacaggtgaagatggtaagttgacctttaaaaatctgtcagatgggaaatatcgattatttgaaaattctgaaccagctggttataaacccgttcaaaataagcctatcgttgccttccaaatagtaaatggagaagtcagagatgtgacttcaatcgttccacaagatataccagcgggttacgagtttacgaatgataagcactatattaccaatgaacctattcctccaaagagagaatatcctcgaactggtggtatcggaatgttgccattctatctgataggttgcatgatgatgggaggagttctattatacacacggaaacatccgtaaagtgtagaaatgataatatctatgttctgaacaatacttttaagaagtagcactcaagaagagatttaagtttacttggtgaaaccagttttcttcgccaagtaaaccaccattgaaaggggagatgttttcgaaaacttgcacagaaaaaggattattattgtcatgtgtaattcattacattgctcacagttgattttaagagataaataaggagaaatcatgaaatcaatcaacaaatttttaacaatgcttgctgccttattattgacagcgagtagcctgttttcagctgcaacagtttttgcggctgggacgacaacaacatctgttaccgttcataaactattggcaacagatggggatatggataaaattgcaaatgagttagaaacaggtaactatgctggtaataaagtgggtgttctacctgcaaatgcaaaagaaattgccggtgttatgttcgtttggacaaatactaataatgaaattattgatgaaaatggccaaactctaggagtgaatattgatccacaaacatttaaactctcaggggcaatgccggcaactgcaatgaaaaaattaacagaagctgaaggagctaaatttaacacggcaaatttaccagctgctaagtataaaatttatgaaattcacagtttatcaacttatgtcggtgaagatggagcaaccttaacaggttctaaagcagttccaattgaaattgaattaccattgaacgatgttgtggatgcgcatgtgtatccaaaaaatacagaagcaaagccaaaaattgataaagatttcaaaggtaaagcaaatccagatacaccacgtgtagataaagatacacctgtgaaccaccaagttggagatgttgtagagtacgaaattgttacaaaaattccagcacttgctaattatgcaacagcaaactggagcgatagaatgactgaaggtttggcattcaacaaaggtacagtgaaagtaactgttgatgatgttgcacttgaagcaggtgattatgctctaacagaagtagcaactggttttgatttgaaattaacagatgctggtttagctaaagtgaatgaccaaaacgctgaaaaaactgtgaaaatcacttattcggcaacattgaatgacaaagcaattgtagaagtaccagaatctaatgatgtaacatttaactatggtaataatccagatcacgggaatactccaaagccgaataagccaaatgaaaacggcgatttgacattgaccaagacatgggttgatgctacaggtgcaccaattccggctggagctgaagcaacgttcgatttggttaatgctcagactggtaaagttgtacaaactgtaactttgacaacagacaaaaatacagttactgttaacggattggataaaaatacagaatataaattcgttgaacgtagtataaaagggtattcagcagattatcaagaaatcactacagctggagaaattgctgtcaagaactggaaagacgaaaatccaaaaccacttgatccaacagagccaaaagttgttacatatggtaaaaagtttgtcaaagttaatgataaagataatcgtttagctggggcagaatttgtaattgcaaatgctgataatgctggtcaatatttagcacgtaaagcagataaagtgagtcaagaagagaagcagttggttgttacaacaaaggatgctttagatagagcagttgctgcttataacgctcttactgcacaacaacaaactcagcaagaaaaagagaaagttgacaaagctcaagctgcttataatgctgctgtgattgctgccaacaatgcatttgaatgggtggcagataaggacaatgaaaatgttgtgaaattagtttctgatgcacaaggtcgctttgaaattacaggccttcttgcaggtacatattacttagaagaaacaaaacagcctgctggttatgcattactaactagccgtcagaaatttgaagtcactgcaacttcttattcagcgactggacaaggcattgagtatactgctggttcaggtaaagatgacgctacaaaagtagtcaacaaaaaaatcacgatcccacaaacgggtggtattggtacaattatctttgctgtagcaggggctgtgattatgggtattgcagtgtacgcatatgttaaaaacaacaaagatgaggatcaacttgcttaagtaagagagaaaggagccattgatgacaatgcagaaaatgcagaaaatgattagtcgtatcttctttgttatggctctgtgtttttctcttgtatggggtgcacatgcagtccaagcgcaagaagatcacacgttggtcttgcaattggagaactatcaggaggtggttagtcaattgccatctcgtgatggtcatcggttgcaggtatggaagttggatgattcgtattcctatgataatcgggtgcaaattgtgagagacttgcattcgtgggatgagaataaactttcttctttcaaaaagacttcgtttgagatgaccttccttgagaatcagattgaagtatctcatattccaaatggtctttactatgttcgctctattatccagacggatgcggtttcttatccagctgaatttctttttgaaatgacagatcagacggtagagcctttggtcattgtagcgaaaaaagcagatacggtgacaacaaaggtgaagctgataaaggtggatcaagaccacaatcgcttggagggtgtcggctttaaattggtatcagtagcaagagatggttctgaaaaagaggttcccttgattggagaataccgttacagttcttctggtcaagtagggagaactctctatactgataaaaatggagagattgttgtgacaaatcttcctcttgggacctatcgtttcaaggaggtggagccactggcaggctatactgttacgacgatggatacggatgtccagttggtagatcatcagctggtgacgattacggttgtcaatcagaaattaccacgtggcaatgttgactttatgaaggtggatggtaggaccaatacctctcttcaaggggcaatgttcaaagtcatgaaagaagaaaacggacactatactcctgttcttcaaaatggtaaggaagtagttgtggcatcagggaaagatggtcgtttccgagtggaaggtctagagtatgggacatactatttatgggagctccaagctccaactggttatgttcaattaacatcgcctgtttcctttacaatcgggaaagatactcgtaaggaactggtaacagtggttaaaaataacaagcgaccacggattgatgtgccagatacaggggaagaaaccttgtatatcttgatgcttgttgccattttgttgtttggtagtggctattatcttacgaaaaaaacaaataactgatattcaatgtacatcattatgaaaaagatagcaggctgaagggaagaccagagtactctgaggtgatgttaatcaggaatcatggtgatttggcatgaatcataataacggatatgaggctgggcagattgtgccagcctcattgtgggttattgtttgtaaaacgataggactggtctggtaatcattttaggaatggacaggactgggattctgatttaaaatggatggtgaatcagaaagaaatgagattttctcgtttctcttagcagataggattgtctgttaggaaaagcgataaaatgatgagtttgaagttaaaggaatgctgataaaaaatggcaaaaacaaaaaagcaaaaacgaaacaatctcctattaggagtggtatttttcattggaatggcggtaatggcgtatccgctggtgtctcgcttgtattatcgagtggaatcaaatcaacaaattgctgactttgataaggaaaaagcaacgttggatgaggctgacattgatgaacgaatgaaattggcacaagccttcaatgactctttgaataatgtagtgagtggcgatccttggtcggaagaaatgaagaaaaaagggcgagcagagtatgcacgcatgttagaaatccatgagcggatggggcatgtggaaatccctgctattgatgtagatttgccggtttatgctggtactgctgaagaggtattgcagcaaggcgctggacatctagagggaacttctctaccgatcggaggcaattcgacccatgcggtgattacggcacatacaggtttgccaacggctaagatgtttacggatttgaccaaacttaaagttggggataagttttatgtgcacaatatcaaggaagtgatggcctatcaagtggatcaagtaaaggtgattgagccgacgaactttgatgatttattgattgtaccaggtcatgattatgtgaccttgctgacctgtacgccatacatgatcaatacccatcgtctattggttcgggggcatcggataccgtacgtagcagaggttgaggaagaatttattgcggcaaacaaactcagtcatctctatcgctacctgttttatgtggcagttggtttgattgtgattcttttatggattattcgacgcttgcgcaagaagaaacggcaatcagaaagagctttgaaagcattgaaggaagctactaaggaagtgaaggtagaggatgagtaagagtagatattcacggaaaaagagcgtgaaaaagaagaaaaatccgttcattcttcttctgatttttttggtggggcttgccgttgcgatgtatcccttggtgtctcgttattattatcgtattgagtcaaacgaggttattaaagagtttgatgagacggtttcccagatggataaggcggaacttgaggagcgttggcgcttggctcaagccttcaatgcgaccttgaaaccatctgaaatcctcgatccttttacagatcaggaaaagaaacagggagtttcagaatatgctaacatgctaaaagttcatgagcgtatcggatatgtagaaattcctgcgattgaacaggaaatccccatgtatgttggcacaagtgaagacattcttcagaaaggggcagggctgttagaaggggcttcgctgcctgttggaggtgaaaatacccatacagtgatcactgctcacagaggattgccaacggcagaattgttcagtcaattggataagatgaagaaaggggatatcttttatcttcacgttttagaccaggttttggcctatcaagtggatcagatagtgacggtggagccgaatgattttgagcctgttctgattcaacatggacaagattatgcgactttactgacttgtacgccatacatgattaacagccaccgtttgttggtacgtgggaaacggattccatatacagcgccgattgctgagcggaatcgagcggtgagagagcgtgggcaattctggttgtggttattactaggagcgatggcggtcatccttctcttgctgtatcgcgtgtatcgtaatcgacggattgtcaaaggactagaaaagcaattggaggggcgtcatgtcaaggactaaactacgagccttattgggatacttgttgatgttggtagcctgtttgattcctatttattgttttggacagatggtgttgcagtctcttggacaggtgaaaggtcatgctacatttgtgaaatccatgacaactgaaatgtaccaagaacaacagaaccattctctcgcctacaatcaacgcttggcttcgcaaaatcgcattgtagatccttttttggcggagggatatgaggtcaattaccaagtgtctgacgaccctgatgcagtctatggttacttgtctattccaagtttggaaatcatggagccggtttatttgggagcagattatcatcatttagggatgggcttggctcatgtggatggtacaccgctgcctctggatggtacagggattcgctcagtgattgctgggcaccgtgcagagccaagccatgtctttttccgccatttggatcagctaaaagttggagatgctctttattatgataatggccaggaaattgtagaatatcagatgatggacacagagattattttaccgtcggaatgggaaaaattagaatcggttagctctaaaaatatcatgaccttgataacctgcgatccgattcctacctttaataaacgcttattagtgaattttgaacgagtcgctgtttatcaaaaatcagatccacaaacagctgcagttgcgagggttgcttttacgaaagaaggacaatctgtatcgcgtgttgcaacctctcaatggttgtaccgtgggctagtggtactggcatttctgggaatcctgtttgttttgtggaagctagcacgtttactacgagggaaataaaaagaaatgaaaggaaagctaaggctgttcctttttccggctctttgtcaactgtagt

SEQ ID NO: 502 - DNA, 11448 bp, S. pneumoniae
tttaggcgcttttcattataagtcttatgggacttttttgatactcaaaaagccctataatctccacagtgggatttacccactacagaaattatagagccagaaaaaacacttttgttcactagcagaaactagagagcagaagtgtttttctgttcagatttacccaaaactgggaaatatggggataagaatagagatggcttaggaagcccctttttgtgtgtagacagtacgatgaacttataacaaatagtgagcctttttagcaatcattgcgacccgtttgtcaaaagcctcttttcggatatctacaattgtctgatagatgagacgctgttggctaacatgcaaatctaaggcaatcgtcaaaaagtgatgtttccctttgggatactgctttttaacgtaaggcaggtattctttcgttgtaataataatcaatggctctgtcaaatgctcctctgaaggaggaggactaattagaatattgtatcctgtaacagaggcaactttgtcagtaaaattccgtaaaataatggactttattaagtttacatctgcttgattatttaaaatgataaaaatcgggatagcaggtagtgaggaaaagatggtttctgtcaagtagagtgagaaaaggtacagccgatgctggtcgataactccttcaatcttctgctcagtcatccactcttgaacaattgctttcgaaatatgatacagtggcttgtcgctttcaatcccataatgttcgtaataattataatagggaactagattttgtaaaccaaacaaaaacgttcttgttaagaaagtcagtgctgttaaaaaagaaagagaattcgaaatgtcatttcctaagatattcttgaacttggatagtagatgctttcctcttgtatgctgaagaatcagttgaatagtatgagtctttttttcttgattccatttgtccttggaaaacgaagaattagcagaacaataaaccaaaaagatataatccagttcttcctgagtaaaagtcatgttggcatgtggctctaagtaagtttggcaatgttccatcaaaatcggatacataaagaggttttttaatttttcaaactctttggactcagggaactcaagtggaaattcccgacgtttccaagtgagtgccactagtatgctaaaatgaacatactcgtcaggtgtgatttctaacagttcatgactgagttgagaattagactgcacaatcatatgtgtgacccaatccatacttccatcattcaaatcataaatctcaataccaaaatgaaactggaggagtgcaattaaaaaacgaatgcgatattcaggaccaactacttgatttttcacaaggtccaaacctactgaacgtagtaacaagccacacttttgtcgtacgcggtagcctgttgcgatggaaatatactctttttgtgtaaattcgttaaagctttgattaccttgtagtagaaagaagcggagtatttttaaaatagttgattggttataaagctgatggaagtaataattcgtttgatgagaatggtgttcgattaattgaacttgttgcgtatctaaattaaatgtcaactcttcctcgaatgtttcttgtaattcctgcaaaatgcttaggagacttttagattgtaatgaagttaaagtagacagttcatctagttcaatagaccgaatatccaataatatatttaaaatggtaattttatctgtaattcttttttcaatgtatttgtttagcatagttaccgaatcttagttgcatatagataattttaattattataatacaaaagaaactaattgtcttgtcaaaaaggttgtggaatttccgactttattgataaaacagcatgtaataaaaggcattttaaagatagtaatgagtattggtggagttttatggcttattttttttattagaaaatattttttatcaaatattgtcgttctataaaaaaatatgtgataaaaatatctattgtgatggaagttgttttaatttatactaggatagttaatagtaatactatactatactatattgtatacaagtgtgtcattgccaggttgagaagatagctataacgcacttttatacgcttttgctacgtttgttagtgaacggattaactcagtgagataaattttatcagaacataagtaatccgtttcttcgtgtatacagattgaaagtacctatgaatcatagaaggattaacttgttctatgaataatgcttaacagggagacacacatgaaaaaagtaagaaagatatttcagaaggcagttgcaggactgtgctgtatatctcagttgacagctttttcttcgatagttgctttagcagaaacgcctgaaaccagtccagcgataggaaaagtagtgattaaggagacaggcgaaggaggagcgcttctaggagatgccgtctttgagttgaaaaacaatacgaatggcacaactgtttcgcaaaggacagaggcgcaaacaggagaagcgatattttcaaacataaaacctgggacatacaccttgacagaagcccaacctccagttggttataaaccctctactaaacaacggactgttgaagttgagaagaatggtcggacgactgtccaaggtgaacaggtagaaaatcgagaagaggctctatctgaccagtatccacaaacagggacttatccagatgttcaaacaccttatcagattattaaggtagatggttcggaaaaaaacggacagcacaaggcgttgaatccgaatccatatgaacgtgtgattccagaaggtacactttcaaagagaatttatcaagtgaataatttggatgataaccaatatggaatcgaattgacggttagtgggaaaacagtgtatgaacgaaaagataagtctgtgccgctggatgtcgttatcttgctcgataactcaaatagtatgagtaacattcgaaacaagaatgctcgacgtgcggaaagagctggtgaggcgacacgttctcttattgataaaattacatctgatccagaaaatagggtagcgcttgtgacttatgcttccactatctttgatgggaccgagtttacagtagaaaaaggggtagcagataaaaacggaaaacgattgaatgattctcttttttggaattatgatcagacgagttttacaaccaataccaaagattatagttatttaaagctgactaatgataagaatgacattgtagaattaaaaaataaggtacctaccgaggcagaagaccatgatggaaatagattgatgtaccaattcggtgccacttttactcagaaagctttgatgaaggccgatgagattttgacacaacaagcgagacaaaatagtcaaaaagtcattttccatattacggatggtgtcccaactatgtcgtatccgattaattttaatcatgctacgtttgctccatcatatcaaaatcaactaaatgtattttttagtaaatctcctaataaagatggaatactattaagtgattttattacgcaagcaactagtggagaacatacaattgtacgcggagatgggcaaagttaccagatgtttacagataagacagtttatgaaaaaggtgctcctgcagctttcccagttaaacctgaaaaatattctgaaatgaaggcggttggttatgcagttataggcgatccaattaatggtggatatatttggcttaattggagagagagtattctggcttatccgtttaattctaatactgctaaaattaccaatcatggtgaccctacaagatggtactataacgggaatattgctcctgatgggtatgatgtctttacggtaggtattggtattaacggagatcctggtacggatgaagcaacggctactagttttatgcaaagtatttctagtaaacctgaaaactataccaatgttactgacacgacaaaaatattggaacagttgaatcgttatttccacaccatcgtaactgaaaagaaatcaattgagaatggtacgattacagatccgatgggtgagttaattgatttgcaattgggcacagatggaagatttgatccagcagattacactttaactgcaaacgatggtagtcgcttggagaatggacaagctgtaggtggtccacaaaatgatggtggcttgctaaaaaatgcaaaagtgttctatgatacgactgagaaaaggattcgtgtaacaggtttgtaccttggaacgggtgaaaaagttacattgacttataatgttcgcttgaatgaccaatttgtaagcaataaattctatgacacgaatggtcgaacaaccctacaccctaaggaagtagaaaagaacacagtgcgcgacttcccgattcctaagattcgtgatgtgcgaaaatatccagcaattacgattgcaaaagagaaaaaacttggtgaaattgagtttattaagatcaataagaatgataaaaaaccactgagagatgcggtctttagtcttcaaaaacaacatccggattatccagatatttatggagctattgatcaaaatggcacttatcaaaatgtgagaacaggtgaagatggtaagttgacctttaaaaatctgtcagatgggaaatatcgattatttgaaaattctgaaccagctggttataaacccgttcaaaataagcctatcgttgccttccaaatagtaaatggagaagtcagagatgtgacttcaatcgttccacaagatataccagcgggttacgagtttacgaatgataagcactatattaccaatgaacctattcctccaaagagagaatatcctcgaactggtggtatcggaatgttgctattctatctgataggttgcatgatgatgggaggagttctattatacacacggaaacatccgtaaagtgtagaaatgataatatctatgttctgaacgatacttttaagaagtagcactcaagaagagatttaagtttacttggtgaaaccagttttcttcgccaagtaaaccaccattgaaaggggagatgttttcgaaaacttgcacagaaaaaggattattattgtcatgtgtaattcattacattgctcacagttgattttaagagataaataaggagaaatcatgaaatcaatcaacaaatttttaacaatgcttgctgccttattactgacagcgagtagcctgttttcagctgcaacagtttttgcggctgggacgacaacaacatctgttaccgttcataaactattggcaacagatggggatatggataaaattgcaaatgagttagaaacaggtaactatgctggtaataaagtgggtgttctacctgcaaatgcaaaagaaattgccggtgttatgttcgtttggacaaatactaataatgaaattattgatgaaaatggccaaactctaggagtgaatattgatccacaaacatttaaactctcaggggcaatgccggcaactgcaatgaaaaaattaacagaagctgaaggagctaaatttaacacggcaaatttaccagctgctaagtataaaatttatgaaattcacagtttatcaacttatgtcggtgaagatggagcaaccttaacaggttctaaagcagttccaattgaaattgaattaccattgaacgatgttgtggatgcgcatgtgtatccaaaaaatacagaagcaaagccaaaaattgataaagatttcaaaggtaaagcaaatccagatacaccacgtgtagataaagatacacctgtgaaccaccaagttggagatgttgtagagtacgaaattgttacaaaaattccagcacttgctaattatgcaacagcaaactggagcgatagaatgactgaaggtttggcattcaacaaaggtacagtgaaagtaactgttgatgatgttgcacttgaagcaggtgattatgctctaacagaagtagcaactggttttgatttgaaattaacagatgctggtttagctaaagtgaatgaccaaaacgctgaaaaaactgtgaaaatcacttattcggcaacattgaatgacaaagcaattgtagaagtaccagaatctaatgatgtaacatttaactatggtaataatccagatcacgggaatactccaaagccgaataagccaaatgaaaacggcgatttgacattgaccaagacatgggttgatgctacaggtgcaccaattccggctggagctgaagcaacgttcgatttggttaatgctcagactggtaaagttgtacaaactgtaactttgacaacagacaaaaatacagttactgttaacggattggataaaaatacagaatataaattcgttgaacgtagtataaaagggtattcagcagattatcaagaaatcactacagctggagaaattgctgtcaagaactggaaagacgaaaatccaaaaccacttgatccaacagagccaaaagttgttacatatggtaaaaagtttgtcaaagttaatgataaagataatcgtttagctggggcagaatttgtaattgcaaatgctgataatgctggtcaatatttagcacgtaaagcagataaagtgagtcaagaagagaagcagttggttgttacaacaaaggatgctttagatagagcagttgctgcttataacgctcttactgcacaacaacaaactcagcaagaaaaagagaaagttgacaaagctcaagctgcttataatgctgctgtgattgctgccaacaatgcatttgaatgggtggcagataaggacaatgaaaatgttgtgaaattagtttctgatgcacaaggtcgctttgaaattacaggccttcttgcaggtacatattacttagaagaaacaaaacagcctgctggttatgcattactaactagtcgtcagaaatttgaagtcactgcaacttcttattcagcgactggacaaggcattgagtatactgctggttcaggtaaagatgacgctacaaaagtagtcaacaaaaaaatcacgatcccacaaacgggtggtattggtacaattatctttgctgtagcaggggctgtgattatgggtattgcagtgtacgcatatgttaaaaacaacaaagatgaggatcaacttgcttaagtaagagagaaaggagccattgatgacaatgcagaaaatgcagaaaatgcagaaaatgcagaaaatgcagaaaatgcagaaaatgattagtcgtatcttctttgttatggctctgtgtttttctcttgtatggggtgcacatgcagtccaagcgcaagaagatcacacgttggtcttgcaattggagaactatcaggaggtggttagtcaattgccatctcgtgatggtcatcggttgcaggtatggaagttggatgattcgtattcctatgataatcgggtgcaaattgtgagagacttgcattcgtgggatgagaataaactttcttctttcaaaaagacttcgtttgagatgaccttccttgagaatcagattgaagtatctcatattccaaatggtctttactatgttcgctctattatccagacggatgcggtttcttatccagctgaatttctttttgaaatgacagatcagacggtagagcctttggtcattgtagcgaaaaaagcagatacggtgacaacaaaggtgaagctgataaaggtggatcaagaccacaatcgcttggagggtgtcggctttaaattggtatcagtagcaagagatggttctgaaaaagaggttcccttgattggagaataccgttacagttcttctggtcaagtagggagaactctctatactgataaaaatggagagattgttgtgacaaatcttcctcttgggacctatcgtttcaaggaggtggagccactggcaggctatactgttacgacgatggatacggatgtccagttggtagatcatcagctggtgacgattacggttgtcaatcagaaattaccacgtggcaatgttgactttatgaaggtggatggtaggaccaatacctctcttcaaggggcaatgttcaaagtcatgaaagaagaaaacggacactatactcctgttcttcaaaatggtaaggaagtagttgtggcatcagggaaagatggtcgtttccgagtggaaggtctagagtatgggacatactatttatgggagctccaagctccaactggttatgttcaattaacatcgcctgtttcctttacaatcgggaaagatactcgtaaggaactggtaacagtggttaaaaataacaagcgaccacggattgatgtgccagatacaggggaagaaaccttgtatatcttgatgcttgttgccattttgttgtttggtagtggctattatcttacgaaaaaaacaaataactgatattcaatgtacatcattatgaaaaagatagcaggctgaagggaagaccagagtactctgaggtgatgttaatcaggaatcatggtgatttggcatgaatcataataacggatatgaggctgggcagattgtgccagcctcattgtgggttattgtttgtaaaacgataggactggtctggtaatcattttaggaatggacaggactgggattctgatttaaaatggatggtgaatcagaaagaaatgagattttctcgtttctcttagcagataggattgtctgttaggaaaagcgataaaatgatgagtttgaagttaaaggaatgctgataaaaaatggcaaaaacaaaaaagcaaaaacgaaacaatctcctattaggagtggtatttttcattggaatagcggtaatggcgtatccgctggtgtctcgcttgtattatcgagtggaatcaaatcaacaaattgctgactttgataaggaaaaagcaacgttggatgaggctgacattgatgaacgaatgaaattggcacaagccttcaatgactctttgaataatgtagtgagtggcgatccttggtcggaagaaatgaagaaaaaagggcgagcagagtatgcacgcatgttagaaatccatgagcggatggggcatgtggaaatccctgctattgatgtagatttgccggtttatgctggtactgctgaagaggtattgcagcaaggcgctggacatctagagggaacttctctaccgatcggaggcaattcgacccatgcggtgattacggcacatacaggtttgccaacggctaagatgtttacggatttgaccaaacttaaagttggggataagttttatgtgcacaatatcaaggaagtgatggcctatcaagtggatcaagtaaaggtgattgagccgacgaactttgatgatttattgattgtaccaggtcatgattatgtgaccttgctgacctgtacgccatacatgatcaatacccatcgtctattggttcgggggcatcggataccgtacgtagcagaggttgaggaagaatttattgcggcaaacaaactcagtcatctctatcgctacctgttttatgtggcagttggtttgattgtgattcttttatggattattcgacgcttgcgcaagaagaaacggcaatcagaaagagctttgaaagcattgaaggaagctactaaggaagtgaaggtagaggatgagtaagagtagatattcacggaaaaagagcgtgaaaaagaagaaaaatccgttcattcttcttctgatttttttggtggggcttgccgttgcgatgtatcccttggtgtctcgttattattatcgtattgagtcaaacgaggttattaaagagtttgatgagacggtttcccagatggataaggcggaacttgaggagcgttggcgcttggctcaagccttcaatgcgaccttgaaaccatctgaaattcttgatccttttacagagcaagagaaaaagaaaggcgtctcagaatatgccaatatgctaaaggtccatgagcggattggctatgtggaaattcctgcgattgatcaggaaattccgatgtatgtcggaacgagtgaggaaattcttcagaagggcgcaggattgctagagggagcttcgttaccggttggtggtgaaaatacccacacagttgtcactgctcatagaggattaccgacggcagaactgtttagtcaattggataagatgaaaaaaggggatatcttttatcttcacgttttagatcaggtgttggcctaccaagtggatcagatagtgacggtggagccgaatgactttgagcctgtcttgattcaacatggggaagattatgcgaccttgttgacttgtacaccgtatatgattaacagtcatcgtctgttggtacgtgggaagcggattccgtatacggcaccaattgcagagcggaatcgagcggtgagagagcgtgggcaattctggttgtggttattactaggagcgatggcggtcatccttctcttgctgtatcgcgtgtatcgtaatcgacggattgtcaaaggactagaaaagcaattggaggggcgtcatgtcaaggactaaactacgagccttattgggatacttgttgatgttggtagcctgtttgattcctatttattgttttggacagatggtgttgcagtctcttggacaggtgaaaggtcatgctacatttgtgaaatccatgacaactgaaatgtaccaagaacaacagaaccattctctcgcctacaatcaacgcttggcttcgcaaaatcgcattgtagatccttttttggcggagggatatgaggtcaattaccaagtgtctgacgaccctgatgcagtctatggttacttgtctattccaagtttggaaatcatggagccggtttatttgggagcagattatcatcatttagggatgggcttggctcatgtggatggtacaccgctgcctctggatggtacagggattcgctcagtgattgctgggcaccgtgcagagccaagccatgtctttttccgccatttggatcagctaaaagttggagatgctctttattatgataatggccaggaaattgtagaatatcagatgatggacacagagattattttaccgtcggaatgggaaaaattagaatcggttagctctaaaaatatcatgaccttgataacctgcgatccgattcctacctttaataaacgcttattagtgaattttgaacgagtcgctgtttatcaaaaatcagatccacaaacagctgcagttgcgagggttgcttttacgaaagaaggacaatctgtatcgcgtgttgcaacctctcaatggttgtaccgtgggctagtggtactggcatttctgggaatcctgtttgttttgtggaagctagcacgtttactacgagggaaataaaaagaaatgaaaggaaagctaaggctgttcctttttccggctctttgtcaactgtag

SEQ ID NO: 503 - DNA, 11449 bp, S. pneumoniae
aagatactttctaatgagttgtttaggcgcttttcattataagtcttatgggacttttttgatactcaaaaagccctataatctccacagtgggatttacccactacagaaattatagagccagaaaaaacacttttgttcactagcagaaactagagagcagaagtgtttttctgttcagatttacccaaaactgggaaatatggggataagaatagagatggcttaggaagcccctttttgtgtgtagacagtacgatgaacttataacaaatagtgagcctttttagcaatcattgcgacccgtttgtcaaaagcctcttttcggatatctacaattgtctgatagatgagacgctgttggctaacatgcaaatctaaggcaatcgtcaaaaagtgatgtttccctttgggatactgctttttaacgtaaggcaggtattctttcgttgtaataataatcaatggctctgtcaaatgctcctctgaaggaggaggactaattagaatattgtatcctgtaacagaggcaactttgtcagtaaaattccgtaaaataatggactttattaagtttacatctgcttgattatttaaaatgataaaaatcgggatagcaggtagtgaggaaaagatggtttctgtcaagtagagtgagaaaaggtacagccgatgctggtcgataactccttcaatcttctgctcagtcatccactcttgaacaattgctttcgaaatatgatacagtggcttgtcgctttcaatcccataatgttcgtaataattataatagggaactagattttgtaaaccaaacaaaaacgttcttgttaagaaagtcagtgctgttaaaaaagaaagagaattcgaaatgtcatttcctaagatattcttgaacttggatagtagatgctttcctcttgtatgctgaagaatcagttgaatagtatgagtctttttttcttgattccatttgtccttggaaaacgaagaattagcagaacaataaaccaaaaagatataatccagttcttcctgagtaaaagtcatgttggcatgtggctctaagtaagtttggcaatgttccatcaaaatcggatacataaagaggttttttaatttttcaaactctttggactcagggaactcaagtggaaattcccgacgtttccaagtgagtgccactagtatgctaaaatgaacatactcgtcaggtgtgatttctaacagttcatgactgagttgagaattagactgcacaatcatatgtgtgacccaatccatacttccatcattcaaatcataaatctcaataccaaaatgaaactggaggagtgcaattaaaaaacgaatgcgatattcaggaccaactacttgatttttcacaaggtccaaacctactgaacgtagtaacaagccacacttttgtcgtacgcggtagcctgttgcgatggaaatatactctttttgtgtaaattcgttaaagctttgattaccttgtagtagaaagaagcggagtatttttaaaatagttgattggttataaagctgatggaagtaataattcgtttgatgagaatggtgttcgattaattgaacttgttgcgtatctaaattaaatgtcaactcttcctcgaatgtttcttgtaattcctgcaaaatgcttaggagacttttagattgtaatgaagttaaagtagacagttcatctagttcaatagaccgaatatccaataatatatttaaaatggtaattttatctgtaattcttttttcaatgtatttgtttagcatagttaccgaatcttagttgcatatagataattttaattattataatacaaaagaaactaattgtcttgtcaaaaaggttgtggaatttccgactttattgataaaacagcatgtaataaaaggcattttaaagatagtaatgagtattggtggagttttatggcttattttttttattagaaaatatttttttatcaaatattgtcgttctataaaaaaatatgtgataaaaatatctattgtgatggaagttgttttaatttatactaggatagttaatagtaatactatactatactatattgtatacaagtgtgtcattgccaggttgagaagatagctataacgcacttttatacgcttttgctacgtttgttagtgaacggattaactcagtgagataaattttatcagaacataagtaatccgtttcttcgtgtatacagattgaaagtacctatgaatcatagaaggattaacttgttctatgaataatgcttaacagggagacacacatgaaaaaagtaagaaagatatttcagaaggcagttgcaggactgtgctgtatatctcagttgacagctttttcttcgatagttgctttagcagaaacgcctgaaaccagtccagcgataggaaaagtagtgattaaggagacaggcgaaggaggagcgcttctaggagatgccgtctttgagttgaaaaacaatacggatggcacaactgtttcgcaaaggacagaggcgcaaacaggagaagcgatattttcaaacataaaacctgggacatacaccttgacagaagcccaacctccagttggttataaaccctctactaaacaatggactgttgaagttgagaagaatggtcggacgactgtccaaggtgaacaggtagaaaatcgagaagaggctctatctgaccagtatccacaaacagggacttatccagatgttcaaacaccttatcagattattaaggtagatggttcggaaaaaaacggacagcacaaggcgttgaatccgaatccatatgaacgtgtgattccagaaggtacactttcaaagagaatttatcaagtgaataatttggatgataaccaatatggaatcgaattgacggttagtgggaaaacagtgtatgaacaaaaagataagtctgtgccgctggatgtcgttatcttgctcgataactcaaatagtatgagtaacattcgaaacaagaatgctcgacgtgcggaaagagctggtgaggcgacacgttctcttattgataaaattacatctgattcagaaaatagggtagcgcttgtgacttatgcttccactatctttgatgggaccgagtttacagtagaaaaaggggtagcagataaaaacggaaagcgattgaatgattctcttttttggaattatgatcagacgagttttacaaccaataccaaagattatagttatttaaagctgactaatgataagaatgacattgtagaattaaaaaataaggtacctaccgaggcagaagaccatgatggaaatagattgatgtaccaattcggtgccacttttactcagaaagctttgatgaaggcagatgagattttgacacaacaagcgagacaaaatagtcaaaaagtcattttccatattacggatggtgtcccaactatgtcgtatccgattaattttaatcatgctacgtttgctccatcatatcaaaatcaactaaatgcattttttagtaaatctcctaataaagatggaatactattaagtgattttattacgcaagcaactagtggagaacatacaattgtacgcggagatgggcaaagttaccagatgtttacagataagacagtttatgaaaaaggtgctcctgcagctttcccagttaaacctgaaaaatattctgaaatgaaggcggctggttatgcagttataggcgatccaattaatggtggatatatttggcttaattggagagagagtattctggcttatccgtttaattctaatactgctaaaattaccaatcatggtgaccctacaagatggtactataacgggaatattgctcctgatgggtatgatgtctttacggtaggtattggtattaacggagatcctggtacggatgaagcaacggctactagttttatgcaaagtatttctagtaaacctgaaaactataccaatgttactgacacgacaaaaatattggaacagttgaatcgttatttccacaccatcgtaactgaaaagaaatcaattgagaatggtacgattacagatccgatgggtgagttaattgatttgcaattgggcacagatggaagatttgatccagcagattacactttaactgcaaacgatggtagtcgcttggagaatggacaagctgtaggtggtccacaaaatgatggtggtttgttaaaaaatgcaaaagtgctctatgatacgactgagaaaaggattcgtgtaacaggtctgtaccttggaacggatgaaaaagttacgttgacctacaatgttcgtttgaatgatgagtttgtaagcaataaattttatgataccaatggtcgaacaaccttacatcctaaggaagtagaacagaacacagtgcgcgacttcccgattcctaagattcgtgatgtgcggaagtatccagaaatcacaatttcaaaagagaaaaaacttggtgacattgagtttattaaggtcaataaaaatgataaaaaaccactgagaggtgcggtctttagtcttcaaaaacaacatccggattatccagatatttatggagctattgatcaaaatggcacttatcaaaatgtgagaacaggtgaagatggtaagttgacctttaaaaatctgtcagatgggaaatatcgattatttgaaaattctgaaccagctggttataaacccgttcaaaataagcctatcgttgccttccaaatagtaaatggagaagtcagagatgtgacttcaatcgttccacaagatataccagcgggttacgagtttacgaatgataagcactatattaccaatgaacctattcctccaaagagagaatatcctcgaactggtggtatcggaatgttgccattctatctgataggttgcatgatgatgggaggagttctattatacacacggaaacatccgtaaagtgtagaaatgataatatctatgttctgaacgatacttttaagaagtagcactcaagaagagatttaagtttacttggtgaaacctgttttattcgtaagtaaactatcattgaaaggggagatgttttcgaaaacttgcacagaaaaaggattattattgtcatgtgtaattcattacattgctcacagttgattttaagagatatgaataaggagaaatcatgaaatcaatcaacaaatttttaacaatgcttgctgccttattactgacagcgagtagcctgttttcagctgcaacagtttttgcggctgggacgacaacaacatctgttaccgttcataaactattggcaacagatggggatatggataaaattgcaaatgagttagaaacaggtaactatgctggtaataaagtgggtgttctacctgcaaatgcaaaagaaattgccggtgttatgttcgtttggacaaatactaataatgaaattattgatgaaaatggccaaactctaggagtgaatattgatccacaaacatttaaactctcaggggcaatgccggcaactgcaatgaaaaaattaacagaagctgaaggagctaaatttaacacggcaaatttaccagctgctaagtataaaatttatgaaattcacagtttatcaacttatgtcggtgaagatggagcaaccttaacaggttctaaagcagttccaattgaaattgaattaccattgaacgatgttgtggatgcgcatgtgtatccaaaaaatacagaagcaaagccaaaaattgataaagatttcaaaggtaaagcaaatccagatacaccacgtgtagataaagatacacctgtgaaccaccaagttggagatgttgtagagtacgaaattgttacaaaaattccagcacttgctaattatgcaacagcaaactggagcgatagaatgactgaaggtttggcattcaacaaaggtacagtgaaagtaactgttgatgatgttgcacttgaagcaggtgattatgctctaacagaagtagcaactggttttgatttgaaattaacagatgctggtttagctaaagtgaatgaccaaaacgctgaaaaaactgtgaaaatcacttattcggcaacattgaatgacaaagcaattgtagaagtaccagaatctaatgatgtaacatttaactatggtaataatccagatcacgggaatactccaaagccgaataagccaaatgaaaacggcgatttgacattgaccaagacatgggttgatgctacaggtgcaccaattccggctggagctgaagcaacgttcgatttggttaatgctcagactggtaaagttgtacaaactgtaactttgacaacagacaaaaatacagttactgttaacggattggataaaaatacagaatataaattcgttgaacgtagtataaaagggtattcagcagattatcaagaaatcactacagctggagaaattgctgtcaagaactggaaagacgaaaatccaaaaccacttgatccaacagagccaaaagttgttacatatggtaaaaagtttgtcaaagttaatgataaagataatcgtttagctggggcagaatttgtaattgcaaatgctgataatgctggtcaatatttagcacgtaaagcagataaagtgagtcaagaagagaagcagttggttgttacaacaaaggatgctttagatagagcagttgctgcttataacgctcttactgcacaacaacaaactcagcaagaaaaagagaaagttgacaaagctcaagctgcttataatgctgctgtgattgctgccaacaatgcatttgaatgggtggcagataaggacaatgaaaatgttgtgaaattagtttctgatgcacaaggtcgctttgaaattacaggccttcttgcaggtacatattacttagaagaaacaaaacagcctgctggttatgcattactaactagccgtcagaaatttgaagtcactgcaacttcttattcagcgactggacaaggcattgagtatactgctggttcaggtaaagatgacgctacaaaagtagtcaacaaaaaaatcactatcccacaaacgggtggtattggtacaattatctttgctgtagcgggggctgcgattatgggtattgcagtgtacgcatatgttaaaaacaacaaagatgaggatcaacttgcttaagtaagagagaaaggagccattgatgacaatgcagaaaatgcagaaaatgattagtcgtatcttctttgttatggctctgtgtttttctcttgtatggggtgcacatgcagtccaagcgcaagaagatcacacgttggtcttgcaattggagaactatcaggaggtggttagtcaattgccatctcgtgatggtcatcggttgcaagtatggaagttggatgattcgtattcctatgatgatcgggtgcaaattgtaagagacttgcattcgtgggatgagaataaactttcttctttcaaaaagacttcgtttgagatgaccttccttgagaatcagattgaagtatctcatattccaaatggtctttactatgttcgctctattatccagacggatgcggtttcttatccagctgaatttctttttgaaatgacagatcaaacggtagagcctttggtcattgtagcgaaaaaaacagatacaatgacaacaaaggtgaagctgataaaggtggatcaagaccacaatcgcttggagggtgtcggctttaaattggtatcagtagcaagagatgtttctgaaaaagaggttcccttgattggagaataccgttacagttcttctggtcaagtagggagaactctctatactgataaaaatggagagatttttgtgacaaatcttcctcttgggaactatcgtttcaaggaggtggagccactggcaggctatgctgttacgacgctggatacggatgtccagctggtagatcatcagctggtgacgattacggttgtcaatcagaaattaccacgtggcaatgttgactttatgaaggtggatggtcggaccaatacctctcttcaaggggcaatgttcaaagtcatgaaagaagaaagcggacactatactcctgttcttcaaaatggtaaggaagtagttgtaacatcagggaaagatggtcgtttccgagtggaaggtctagagtatgggacatactatttatgggagctccaagctccaactggttatgttcaattaacatcgcctgtttcctttacaatcgggaaagatactcgtaaggaactggtaacagtggttaaaaataacaagcgaccacggattgatgtgccagatacaggggaagaaaccttgtatatcttgatgcttgttgccattttgttgtttggtagtggttattatcttacgaaaaaaccaaataactgatattcaatgtacatcattatgaaaaagatagcaggctgaagggaagaccagagtactctgaggtgatgttaatcaggaatcatggtgatgtggcatgaatcacaataacggatatgaggctgggcagattgtgccagcctcattgtgggttattgtttgtaaaacgataggactggtctggtaatcattttaggaatggacaggactgggattctgatttaaaatggatggtgaatcagaaagaaatgagattttctcgtttctcttagcagataggattgtctgttaggaaaagcgataaaatgatgagtttgaagataaagggatgctgataaaaatggtaaaaacaaaaaagcaaaaacgaaataatctcctattaggagtggtatttttcattggaatggcggtaatggcgtatccgctggtgtctcgcttgtattatcgagtggaatcaaatcaacaaattgctgactttgataaggaaaaagcaacgttggatgaggctgacattgatgaacgaatgaaattggcacaagccttcaatgactctttgaataatgtagtgagtggcgatccttggtcggaagaaatgaagaaaaaagggcgagcagagtatgcacgtatgttagaaatccatgagcggatggggcatgtggaaatccccgttattgacgtggatttgccggtttatgctggtactgctgaagaggtattgcagcaaggggctgggcatctagagggaacttctctgccgatcggaggcaattcgacccatgcggtgattacggcacatacaggtttgccaacagctaagatgtttacggatttgaccaaacttaaagttggggataagttttatgtgcacaatatcaaggaagtgatggcctatcaagtggatcaagtaaaggtgattgagccgacgaactttgatgatttattgattgtaccaggtcatgattatgtgaccttgctgacttgtacgccatacatgatcaatacccatcgtctattggttcgggggcatcggataccgtacgtagcagaggttgaggaagaatttattgcagcaaacaaactcagtcatctctatcgctacctgttttatgtggcagttggtttgattgtgattcttttatggattattcgacgcttgcgcaagaagaaaaaacaaccggaaaaggctttgaaggcgctgaaagcagcaaggaaggaagtgaaggtggaggatggacaacagtagacgttcacgaaaaaaaggcacaaaaaagaagaaacatccgctgatccttcttctgattttcttagtaggattcgccgttgcgatatatccattggtgtctcgttattattatcgtattgagtcaaacgaggttattaaagagtttgatgagacggtttcccagatggataaggcagaacttgaggagcgttggcgcttggctcaagccttcaatgcgaccttgaaaccatctgaaattcttgatccttttacagagcaagagaaaaagaaaggcgtctcagaatatgccaatatgctaaaggtccatgagcggattggctatgtggaaattcctgcgattgatcaggaaattccgatgtatgtcggaacgagtgaggacattcttcagaaaggggcagggctgttagaaggggcttcgctgcctgttggaggtgaaaatacccatacagtgatcactgctcacagaggattgccaacggcagaattgttcagtcaattggataagatgaaaaaaggggatatcttttatcttcacgttttagatcaggtgttggcctaccaagtggatcagatagtgacggtggagccgaatgactttgagcctgtcttgattcaacatggggaagattatgcgaccttgttgacttgtacaccgtatatgattaacagtcatcgtctgttggtacgtgggaagcggattccgtatacggcaccaattgcagagcggaatcgagcggtgagagagcgtgggcaattctggttgtggttattactaggagcgatggcggtcatccttctcttgctgtatcgcgtgtatcgtaatcgacggattgtcaaaggactagaaaagcaattggaggggcgtcatgtcaaggactaaactacgagccttattgggatacttgttgatgttggtagcctgtttgattcctatttattgttttggacagatggtgttgcagtctcttggacaggtgaaaggtcatgctacatttgtgaaatccatgacaactgaaatgtaccaagaacaacagaaccattctctcgcctacaatcaacgcttggcttcgcaaaatcgcattgtagatccttttttggcggagggatatgaggtcaattaccaagtgtctgacgaccctgatgcagtctatggttacttgtctattccaagtttggaaatcatggagccggtttatttgggagcagattatcatcatttagggatgggcttggctcatgtggatggtacaccgctgcctctggatggtacagggattcgctcagtgattgctgggcaccgtgcagagccaagccatgtctttttccgccatttggatcagctaaaagttggagatgctctttattatgataatggccaggaaattgtagaatatcagatgatggacacagagattattttaccgtcggaatgggaaaaattagaatcggttagctctaaaaatatcatgaccttgataacctgcgatccgattcctacctttaataaacgcttattagtgaattttgaacgagtcgctgtttatcaaaaatcagatccacaaacagctgcagttgcgagggttgcttttacgaaagaaggacaatctgtatcgcgtgttgcaacctctcaatggttgtaccgtgggctagtggtactggcatttctgggaatcctgtttgttttgtggaagctagcacgtttactacgagggaaataaaaagaaatgaaaggaaagctaaggctgttcctttttccggctctttgtcaactgtagtgggttgaaaaaaag

SEQ ID NO: 504 - DNA, 11369 bp, S. pneumoniae
tacagttgacaaagagccggaaaaaggaacagccttagctttcctttcatttctttttatttccctcgtagtaaacgtgctagcttccacaaaacaaacaggattcccagaaatgccagtaccactagcccacggtacaaccattgagaggttgcaacacgcgatacagattgtccttctttcgtaaaagcaaccctcgcaactgcagctgtttgtggatctgatttttgataaacagcgactcgttcaaaattcactaataagcgtttattaaaggtaggaatcggatcgcaggttatcaaggtcatgatatttttagagctaaccgattctaatttttcccattccgacggtaaaataatctctgtgtccatcatctgatattctacaatttcctggccattatcataataaagagcatctccaacttttagctgatccaaatggcggaaaaagacatggcttggttctgcacggtgcccagcaatcactgaacgaatcccttttccctcaacaggaagaggcgtcccatccacatgggccaaccccattgctaaatgatggtaatccgctcctagataaactggctccatgatttccaaactcggaatcgacaaatagccgtagactgcatcaggatcgtcagacacttggtaatttacctcatacccttccgccaaaaaaggatctacaatacgattttgcgaatccaagcgttgattgtaatcaagcgaccgttgcaattgctcttggtaactgtcggccgtcacagattctgaaaatatctcatgaccttttacttgtcctaaagactgtaacaccatctgcccaaaacaataaacaggaatcaccaatgctaccagcatcagcaaataccctagtaatttctgtagcttagcctttgacatgatgctcctccaattgtttttctagccctttgacaatgcgacgatgacgatacaccccgtaactcaataccagaatcataaccaacgccgctagcaataaccacaaccagaattgcccacgctctctcaccgctcgatttcgctctgcaattggtgccgtatacggaatccgcttcccacgtaccaacagacgatgactgttaatcatatacggtgtacaggtcaacaaggtcgcataatctttcccatgttgaatcaagacaggctcaaagtcatttggctcaaccgtcaaaatctgatccacttggtaggccaacacctggtctaaaacgtgaagataaaagacatccccttttttcatcttatccaattgactaaacagttctgccgtcggtaatcctctatgagcagtaacaactgtgtgggtattttcaccaccaaccggtaacgaagctccctctagcaatcctgcgcccttctgaagaatttcctcactcgttccgacatacatcggaatttcctgatcaatcgcaggaatttccacatagccaatccgctcatggacctttagcatattggcatattctgagacgcctttctttttctcttgctctgtaaaaggatcaagaatttcagatggtttcaaggtcgcattgaaggcttgagccaagcgccaacgctcctcaagttctgccttatccatctgggaaaccgtctcatcaaactctttaataacctcgtttgactcaatacgataataataacgagacaccaatggatatatcgcaacggcgaatcctactaagaaaatcagaagaaggatcagcggatgtttcttcttttttgtgcctttttttcgtgaacgtctactgttgtccatcctccaccttcacttccttccttgctgctttcagcgccttcaaagccttttccggttgttttttcttcttgcgcaagcgtcgaataatccataaaagaatcacaatcaaaccaactgccacataaaacaggtagcgatagagatgactgagtttgtttgctgcaataaattcttcctcaacctctgctacgtacggtatccgatgcccccgaaccaatagacgatgggtattgatcatgtatggcgtacaagtcagcaaggtcacataatcatgacctggtacaatcaataaatcatcaaagttcgtcggctcaatcacctttacttgatccacttgataggccatcacttccttgatattgtgcacataaaacttatccccaactttaagtttggtcaaatccgtaaacatcttagctgttggcaaacctgtatgtgccgtaatcaccgcatgggtcgaattgcctccgatcggcagagaagttccctctagctgcccagccccttgctgcaatacctcttcagcagtaccagcataaaccggcaaatccacgtcaataacggggatttccacatgccccatccgctcatggatttctaacatacgtgcatactctgctcgcccttttttcttcatttcttccgaccaaggatcgccactcactacattattcaaagagtcattgaaggcttgtgccaatttcattcgttcatcaatgtcagcctcatccaacgttgctttttccttatcaaagtcagcaatttgttgatttgattccactcgataatacaagcgagacaccagcggatacgccattaccgccattccaatgaaaaataccactcctaataggagattatttcgtttttgcttttttgtttttaccatttttatcagcatccctttatcttcaaactcatcattttatcgcttttcctaacagacaatcctatctgctaagagaaacgagaaaatctcatttctttctgattcaccatccattttaaatcagaatcccagtcctgtccattcctaaaatgattaccagaccagtcctatcgttttacaaacaataacccacaatgaggctggcacaatctgcccagcctcatatccgttattgtgattcatgccaaatcaccatgattcctgattaacatcacctcagagtactctggtcttcccttcagcctgctatctttttcataatgatgtacattgaatatcagttatttgtttttttcgtaagataatagccactaccaaacaacaaaatggcaacaagcatcaagatatacaaggtttcttcccctgtatctggcacatcaatccgtggtcgcttgttatttttaaccactgttaccagttccttacgagtatctttcccgattgtaaaggaaacaggcgatgttaattgaacataaccagttggagcttggagctcccataaatagtatgtcccatactctagaccttccactcggaaacgaccatctttccctgatgccacaactacttccttaccattttgaagaacaggagtatagtgtccgttttcttctttcatgactttgaacattgccccttgaagagaggtattggtccgaccatccaccttcataaagtcaacattgccacgtggtaatttctgattgacaaccgtaatcgtcaccagctgatgatctaccaactggacatccgtatccatcgtcgtaacagtatagcctgccagtggctccacctccttgaaacgataggtcccaagaggaagatttgtcacaacaatctctccatttttatcagtatagagagttctccctacttgaccagaagaactgtaacggtattctccaatcaagggaacctctttttcagaaccatctcttgctactgataccaatttaaagccgacaccctccaagcgattgtggtcttgatccacctttatcagcttcacctttgttgtcaccgtatctgcttttttcgctacaatgaccaaaggctctaccgtctgatctgtcatttcaaaaagaaattcagctggataagaaaccgcatccgtctggataatagagcgaacatagtaaagaccatttggaatatgagatacttcaatctgattctcaaggaaggtcatctcaaacgaagtctttttgaaagaagaaagtttattctcatcccacgaatgcaagtctctcacaatttgcacccgattatcataggaatacgaatcatccaacttccatacctgcaaccgatgaccatcacgagatggcaattgactaaccacctcctgatagttctccaattgcaagaccaacgtgtgatcttcttgcgcttggactgcatgtgcaccccatacaagagaaaaacacagagccataacaaagaagatacgactaatcattttctgcattttctgcattgtcatcaatggctcctttctctcttacttaagcaagttgatcctcatctttgttgtttttaacatatgcgtacactgcaatacccataatcacagcccccgctacagcaaagataattgtaccaataccacccgtttgagggatcgtgatttttttgttgactacttttgtagcgtcgttcttctgaacatcttttaaataattgaaatcaccttgattccaagaacctgctccaacctcaaacttcacatctccaagttttgcaaagccttctggagcttttgtttcttccaacgtgtagcttccagcagcaagacctgaaatttggaattgaccatcagtgttagaagtaagaactaacgcatcttcttttctctctacttctacatagccaaatctagctgctctgtaattgtcattatatgttttttgcgcagcatctactacagcttgtgctgcatttttatctgcagcatttgtataggctgctatcgctgcatctagcgcttgtttcgcttctgcggcagctttctcatttacagcttgttgtgctgcagatttgagtgcaagatatttcccttgctcattcttcacaacgaattgtgcttcttttaagcgttcgtctttttggtcaaccttaacgaattttttaccatatgtttttacacgtggctcttcaggatttattggttctggattttcatctttccagtttttaacagcaatttttcctgtttcagtaattgtttggtaatctgcagaatatcccttaattgtccgttcaacaaatttatattctgtattattatcaagacctgtagcagtaaatgtccaattatttgtttgattcaatacaatacctgtttcatgtccaggtactttaacgacctcacctgtctgagcatttaccaaatcaaaagttacttctacacctgctataggagcatctttagcatcagcccatgttttagtaattgtaagttcaccgtttttaggtttgtttggttttggagtgttaccatgacctgggttgtttccataatggaatgttacatcattcgcttctggcacatcagcaacagcaagagcatttaaagttgcagtatacttcaacgtaattgttgcttctgcatctttaccgttgattgcttccagacctttttcatttaacttcaagataaagccattatgacctgcttctaatgtgtaatgagaattatcaagcggttgaccattataattaacaactacatcaccattataatctagaccttctgtcatttcatctgaccagaaagctgttgcaagagttgagtttttcggaatagttgttgtaacaatatacggtaccttagtgccaattgctaaacctttttcacctggatctacgaaacctgctgcagtatcaaatgttttcgttgctgtaggtttgtcttcagaattctttggatagacatgtgcattttctacaacaccattttggtttacaagcggcagagtaattaaagcaggaacagctttcatacctgttaaaactttaccatttggaccgacataagtcgattctttacgtacttcgacaagacgatatgtcccttgtaaaacttcagtatcaaatttaacacctgtttcagtcgtcacacctttattaaccgcagtccaaaccgcatcattcgttaaattttcttgttcttttccttgaggacccgtataactctgtaactcgaatgcaacaccagagatttcggttactccttgtggaacaccttgaagttgtttgaactgttcaaaattttgcgaaccgtcataacctgcagtagtaatcgcatcagaattccaagcgtcaagctcttgatctgtcatcaataatttatgaactgtaagtgtcttagttttttgttccgccgcaaaaactgttgcagctgagaacaggctactcactgtcagtaataaggcagcaagtattgttaaaaatttgttgattgatttcatgatttctccttattcatatctcttaaaatcaactgtgagcaatgtaatgaattacacatgacaataataatcctttttctgtgcaagttttcgaaaacatctcccctttcaatgatagtttacttacgaataaaacaggtttcaccaagtaaacttaaatctcttcttgagtgctacttcttaaaagtatcgttcagaacatagatattatcatttctacactttacggatgtttccgtgtgtataatagaactcctcccatcatcatgcaacctatcagatagaatggcaacattccgataccaccagttcgaggatattctctctttggaggaataggttcattggtaatatagtgcttatcattcgtaaactcgtaacccgctggtatatcttgtggaacgattgaagtcacatctctgacttctccatttactatttggaaggcaacgataggcttattttgaacgggtttataaccagctggttcagaattttcaaataatcgatatttcccatctgacagatttttaaaggtcaacttaccatcttcacctgttctcacattttgataagtgccattttgatcaatagctccataaatatctggataatccggatgttgtttttgaagactaaagaccgcatctctcagtggttttttatcatttttattgaccttaataaactcaatgtcaccaagttttttctcttttgaaattgtgatttctggatacttccgcacatcacgaatcttaggaatcgggaagtcgcgcactgtgttctgttctacttccttaggatgtaaggttgttcgaccattggtatcataaaatttattgcttacaaactcatcattcaaacgaacattgtaggtcaacgtaactttttcatccgttccaaggtacagacctgttacacgaatccttttctcagtcgtatcatagagcacttttgcattttttaacaaaccaccatcattttgtggaccacctacagcttgtccattctccaagcgactaccatcgtttgcagttaaagtgtaatctgctggatcaaatcttccatctgtgcccaattgcaaatcaattaactcacccatcggatctgtaatcgtaccattctcaattgatttcttttcagttacgatggtgtggaaataacgattcaactgttccaatatttttgtcgtgtcagtaacattggtatagttttcaggtttactagaaatactttgcataaaactagtagccgttgcttcatccgtaccaggatctccgttaataccaatacctaccgtaaagacatcatacccatcaggagcaatattcccgttatagtaccatcttgtagggtcaccatgattggtaattttagcagtattagaattaaacggataagccagaatactctctctccaattaagccaaatatatccaccattaattggatcgcctataactgcataaccagccgccttcatttcagaatatttttcaggtttaactgggaaagctgcaggagcacctttttcataaactgtcttatctgtaaacatctggtaactttgcccatctccgcgtacaattgtatgttctccactagttgcttgcgtaataaaatcacttaatagtattccatctttattaggagatttactaaaaaatgcatttagttgattttgatatgatggagcaaacgtagcatgattaaaattaatcggatacgacatagttgggacaccatccgtaatatggaaaatgactttttgactattttgtctcgcttgttgtgtcaaaatctcatctgccttcatcaaagctttctgagtaaaagtggcaccgaattggtacatcaatctatttccatcatggtcttctgcctcggtaggtaccttattttttaattctacaatgtcattcttatcattagtcagctttaaataactataatctttggtattggttgtaaaactcgtctgatcataattccaaaaaagagaatcattcaatcgttttccgtttttatctgctacccctttttctactgtaaactcggtcccatcaaagatagtggaagcataagtcacaagcgctaccctattttctggatcagatgtaattttatcaataagagaacgtgtcgcctcaccagctctttccgcacgtcgagcattcttgtttcgaatgttactcatactatttgagttatcgagcaagataacgacatccagcggcacagacttatctttttgttcatacactgttttcccactaaccgtcaattcgattccatattggttatcatccaaattattcacttgataaattctctttgaaagtgtaccttctggaatcacacgttcatatggattcggattcaacgccttgtgctgtccgtttttttccgaaccatctaccttaataatctgataaggtgtttgaacatctggataagtccctgtttgtggatactggtcagatagagcctcttctcgattttctacctgttcaccttggacagtcgtccgaccattcttctcaacttcaacagtccattgtttagtagagggtttataaccaactggaggttgggcttctgtcaaggtgtatgtcccaggttttatgtttgaaaatatcgcttctcctgtttgcgcctctgtcctttgcgaaacagttgtgccatccgtattgtttttcaactcaaagacggcatctcctagaagcgctcctccttcgcctgtctccttaatcactacttttcctatcgctggactggtttcaggcgtttctgctaaagcaactatcgaagaaaaagctgtcaactgagatatacagcacagtcctgcaactgccttctgaaatatctttcttacttttttcatgtgtgtctccctgttaagcattattcatagaacaagttaatccttctatgattcataggtactttcaatctgtatacacgaagaaacggattacttatgttctgataaaatttatctcactgagttaatccgttcactaacaaacgtagcaaaagcgtataaaagtgcgttatagctatcttctcaacctggcaatgacacacttgtatacaatatagtatagtattactattaactatcctagtataaattaaaacaacttccatcacaatagatatttttatcacatatttttttatagaacgacaatatttgataaaaaaatattttctaataaaaaaaataagccataaaactccaccaatactcattactatctttaaaatgccttttattacatgctgttttatcaataaagtcggaaattccacaacctttttgacaagacaattagtttcttttgtattataataattaaaattatctatatgcaactaagattcggtaactatgctaaacaaatacattgaaaaaagaattacagataaaattaccattttaaatatattattggatattcggtctattgaactagatgaactgtctactttaacttcattacaatctaaaagtctcctaagcattttgcaggaattacaagaaacattcgaggaagagttgacatttaatttagatacgcaacaagttcaattaatcgaacaccattctcatcaaacgaattattacttccatcagctttataaccaatcaactattttaaaaatactccgcttctttctactacaaggtaatcaaagctttaacgaatttacacaaaaagagtatatttccatcgcaacaggctaccgcgtacgacaaaagtgtggcttgttactacgttcagtaggtttggaccttgtgaaaaatcaagtagttggtcctgaatatcgcattcgttttttaattgcactcctccagtttcattttggtattgagatttatgatttgaatgatggaagtatggattgggtcacacatatgattgtgcagtctaattctcaactcagtcatgaactgttagaaatcacacctgacgagtatgttcattttagcatactagtggcactcacttggaaacgtcgggaatttccacttgagttccctgagtccaaagagtttgaaaaattaaaaaacctctttatgtatccgattttgatggaacattgccaaacttacttagagccacatgccaacatgacttttactcaggaagaactggattatatctttttggtttattgttctgctaattcttcgttttccaaggacaaatggaatcaagaaaaaaagactcatactattcaactgattcttcagcatacaagaggaaagcatctactatccaagttcaagaatatcttaggaaatgacatttcgaattctctttcttttttaacagcactgactttcttaacaagaacgtttttgtttggtttacaaaatctagttccctattataattattacgaacattatgggattgaaagcgacaagccactgtatcatatttcgaaagcaattgttcaagagtggatgactgagcagaagattgaaggagttatcgaccagcatcggctgtaccttttctcactctacttgacagaaaccatcttttcctcactacctgctatcccgatttttatcattttaaataatcaagcagatgtaaacttaataaagtccattattttacggaattttactgacaaagttgcctctgttacaggatacaatattctaattagtcctcctccttcagaggagcatttgacagagccattgattattattacaacgaaagaatacctgccttacgttaaaaagcagtatcccaaagggaaacatcactttttgacgattgccttagatttgcatgttagccaacagcgtctcatctatcagacaattgtagatatccgaaaagaggcttttgacaaacgggtcgcaatgattgctaaaaaggctcactatttgttataagttcatcgtactgtctacacacaaaaaggggcttcctaagccatctctattcttatccccatatttcccagttttgggtaaatctgaacagaaaaacacttctgctctctagtttctgctagtgaacaaaagtgttttttctggctctataatttctgtagtgggtaaatcccactgtggagattatagggctttttgagtatcaaaaaagtcccataagacttataatgaaaagcgc

SEQ ID NO: 505 - DNA, 383 bp, S. agalactiae
ttgatagaccgccttcattatcatttctagaatttttctttaggtttgtaaagactacaaaataaaatgatgaaaacaactatcttgtggatacactaaaaagacacgctaattagcaaactctctcttcatcatctctcaccattattatactactatttatatgacaaataaaggtgattttgttaaaatataactttgaaaatccacatatatttttaatcttccgtctgaaaaaataaataaaaatagtaaaaataaacacgaatttaaaataagcaaattttttaagaaaatctgtgctaaactttaatagttttgtgcttaataataatcagcacttacaaagaacaaagggaaaagcgaggagagaacttttaatg

SEQ ID NO: 506 - DNA, 35 bp, S. agalactiae
agtcagtctctagacggcacaataggagttgtaaa

SEQ ID NO: 507 - DNA, 37 bp, S. agalactiae
cacctgtcatagatcttaagaatactaaagcgcataa

SEQ ID NO: 508 - DNA, 36 bp, S. agalactiae
agtcagtccttaagccgcatattattaatcatgttg

SEQ ID NO: 509 - DNA, 35 bp, S. agalactiae
agtcagtcctcgagttaaacttcctctgattgacg

SEQ ID NO: 510 - DNA, 34 bp, S. agalactiae
agtcagtccttaagaaggagtggtgctgcggtaa

SEQ ID NO: 511 - DNA, 35 bp, S. agalactiae
agtcagtcctcgagttaagcttcctctgattgacg

SEQ ID NO: 512 - DNA, 24 bp, S. agalactiae
ctagtgatatatctagagaaaaag

SEQ ID NO: 513 - DNA, 39 bp, S. agalactiae
ctagctagtcgcgactttttcatttttgatttccctttc

SEQ ID NO: 514 - protein, 1309 aa, S. agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLETDTTWTARTVSEVKADLVKQDNKSSYTVKYGDTLSVISEAMSIDMNVLAKINNIADINLIYPETTLTVTYDQKSHTATSMKIETPATNAAGQTTATVDLKTNQVSVADQKVSLNTISEGMTPEAATTIVSPMKTYSSAPALKSKEVLAQEQAVSQAAANEQVSPAPVKSITSEVPAAKEEVKPTQTSVSQSTTVSPASVAAETPAPVAKVAPVRTVAAPRVASVKVVTPKVETGASPEHVSAPAVPVTTTSPATDSKLQATEVKSVPVAQKAPTATPVAQPASTTNAVAAHPENAGLQPHVAAYKEKVASTYGVNEFSTYRAGDPGDHGKGLAVDFIVGTNQALGNKVAQYSTQNMAANNISYVIWQQKFYSNTNSIYGPANTWNAMPDRGGVTANHYDHVHVSFNKDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPDDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQILQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPKTGGKGILSFILIGGAMMSIAGGIYIWKRYKKSSDMSIKKD

SEQ ID NO: 515 - protein, 1095 aa, S. agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLETDTTWTARTVSEVKADLVKQDNKSSYTVKYGDTLSVISEAMSIDMNVLAKINNIADINLIYPETTLTVTYDQKSHTATSMKIETPATNAAGQTTATVDLKTNQVSVADQKVSLNTISEGMTPEAATTIVSPMKTYSSAPALKSKEVLAQEQAVSQAAANEQVSPAPVKSITSEVPAAKEEVKPTQTSVSQSTTVSPASVAAETPAPVAKVAPVRTVAAPRVASVKVVTPKVETGASPEHVSAPAVPVTTTSPATDSKLQATEVKSVPVAQKAPTATPVAQPASTTNAVAAHPENAGLQPHVAAYKEKVASTYGVNEFSTYRAGDPGDHGKGLAVDFIVGTNQALGNKVAQYSTQNMAANNISYVIWQQKFYSNTNSIYGPANTWNAMPDRGGVTANHYDHVHVSFNKGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQILQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPKTGGKGILSFILIGGAMMSIAGGIYIWKRYKKSSDMSIKKD

SEQ ID NO: 516 - DNA, 35 bp, S. agalactiae; identical to SEQ ID NO: 506

SEQ ID NO: 517 - DNA, 40 bp, S. agalactiae
ccacgtcgtatctgtttctaacggcttttgtttgtccact

SEQ ID NO: 518 - DNA, 40 bp, S. agalactiae
gacaaacaaaagccgttagaaacagatacgacgtggacag

SEQ ID NO: 519 - DNA, 40 bp, S. agalactiae
gagtacgaagacaacatctttgttaaatgatacgtgaacg

SEQ ID NO: 520 - DNA, 40 bp, S. agalactiae
taaaaagtaactctcccctttgttaaatgatacgtgaacg

SEQ ID NO: 521 - DNA, 39 bp, S. agalactiae
cacgtatcatttaacaaagatgttgtcttcgtactcgat

SEQ ID NO: 522 - DNA, 41 bp, S. agalactiae
cacgtatcatttaacaaaggggagagttactttttatttcc

SEQ ID NO: 523 - DNA, 37 bp, S. agalactiae; identical to SEQ ID NO: 507

SEQ ID NO: 524 - protein, 711 aa, S. agalactiae
MKMNKKVLLTSTMAASLLSVASVQAQETDTTWTARTVSEVKADLVKQDNKSSYTVKYGDTLSVISEAMSIDMNVLAKINNIADINLIYPETTLTVTYDQKSHTATSMKIETPATNAAGQTTATVDLKTNQVSVADQKVSLNTISEGMTPEAATTIVSPMKTYSSAPALKSKEVLAQEQAVSQAAANEQVSPAPVKSITSEVPAAKEEVKPTQTSVSQSTTVSPASVAAETPAPVAKVAPVRTVAAPRVASVKVVTPKVETGASPEHVSAPAVPVTTTSPATDSKLQATEVKSVPVAQKAPTATPVAQPASTTNAVAAHPENAGLQPHVAAYKEKVASTYGVNEFSTYRAGDPGDHGKGLAVDFIVGTNQALGNKVAQYSTQNMAANNISYVIWQQKFYSNTNSIYGPANTWNAMPDRGGVTANHYDHVHVSFNKHQLTIVHLEARDIDRPNPQLEIAPKEGTPIEGVLYQLYQLKSTEDGDLLAHWNSLTITELKKQAQQVFEATTNQQGKATFNQLPDGIYYGLAVKAGEKNRNVSAFLVDLSEDKVIYPKIIWSTGELDLLKVGVDGDTKKPLAGVVFELYEKNGRTPIRVKNGVHSQDIDAAKHLETDSSGHIRISGLIHGDYVLKEIETQSGYQIGQAETAVTIEKSKTVTVTIENKKVPTPKVPSRGGLIPKTGEQQAMALVIIGGILIALALRLLSKHRKHQNKD

SEQ ID NO: 525 - protein, 637 aa, S. agalactiae
MKMNKKVLLTSTMAASLLSVASVQAQETDTTWTARTVSEVKADLVKQDNKSSYTVKYGDTLSVISEAMSIDMNVLAKINNIADINLIYPETTLTVTYDQKSHTATSMKIETPATNAAGQTTATVDLKTNQVSVADQKVSLNTISEGMTPEAATTIVSPMKTYSSAPALKSKEVLAQEQAVSQAAANEQVSPAPVKSITSEVPAAKEEVKPTQTSVSQSTTVSPASVAAETPAPVAKVAPVRTVAAPRVASVKVVTPKVETGASPEHVSAPAVPVTTTSPATDSKLQATEVKSVPVAQKAPTATPVAQPASTTNAVAAHPENAGLQPHVAAYKEKVASTYGVNEFSTYRAGDPGDHGKGLAVDFIVGTNQALGNKVAQYSTQNMAANNISYVIWQQKFYSNTNSIYGPANTWNAMPDRGGVTANHYDHVHVSFNKQGKATFNQLPDGIYYGLAVKAGEKNRNVSAFLVDLSEDKVIYPKIIWSTGELDLLKVGVDGDTKKPLAGVVFELYEKNGRTPIRVKNGVHSQDIDAAKHLETDSSGHIRISGLIHGDYVLKEIETQSGYQIGQAETAVTIEKSKTVTVTIENKKVPTPKVPSRGGLIPKTGEQQAMALVIIGGILIALALRLLSKHRKHQNKD

SEQ ID NO: 526 - protein, 6 aa, S. pyogenes
VVPTGV

SEQ ID NO: 527 - protein, 6 aa, S. pyogenes
EFPTGV

SEQ ID NO: 528 - protein, 6 aa, S. pyogenes
LPSTGE

SEQ ID NO: 529 - protein, 6 aa, S. pyogenes
VPPTGL

SEQ ID NO: 530 - protein, 6 aa, S. pyogenes
QVPTGV

SEQ ID NO: 531 - protein, 6 aa, S. pyogenes
LPLAGE

SEQ ID NO: 532 - protein, 6 aa, S. pyogenes
LPATGE

SEQ ID NO: 533 - protein, 6 aa, S. pyogenes
LPATGD

SEQ ID NO: 534 - protein, 6 aa, S. pyogenes
VPPTGF

SEQ ID NO: 535 - protein, 10 aa, S. pyogenes
LSLAQVPTGV

SEQ ID NO: 536 - protein, 6 aa, S. pyogenes
LPLAGE

SEQ ID NO: 537 - protein, 6 aa, S. pyogenes
LPATGE

SEQ ID NO: 538 - protein, 6 aa, S. pyogenes
LPATGD

SEQ ID NO: 539 - protein, 6 aa, S. pyogenes
LPSSGG

SEQ ID NO: 540 - protein, 6 aa, S. pyogenes
LPSTGS

SEQ ID NO: 541 - protein, 5 aa, S. pyogenes
  VARIANT (1)...(5): Xaa = Any Amino Acid
LPXSG

SEQ ID NO: 542 - protein, 5 aa, S. pyogenes
  VARIANT (1)...(5): Xaa = Any Amino Acid
VVXTG

SEQ ID NO: 543 - protein, 5 aa, S. pyogenes
  VARIANT (1)...(5): Xaa = Any Amino Acid
EVXTG

SEQ ID NO: 544 - protein, 5 aa, S. pyogenes
  VARIANT (1)...(5): Xaa = Any Amino Acid
VPXTG

SEQ ID NO: 545 - protein, 5 aa, S. pyogenes
  VARIANT (1)...(5): Xaa = Any Amino Acid
QVXTG

SEQ ID NO: 546 - protein, 5 aa, S. pyogenes
  VARIANT (1)...(5): Xaa = Any Amino Acid
LPXAG

SEQ ID NO: 547 - DNA, 14141 bp, S. agalactiae
gttgcttcataagttgtctgaaggcctaattctaaagtcacatgcattctttcagaaagttcagcgagatagtatatagtttcatcaggtaagcaatccggccttgttccgatgttgatctccgataactcctggctcattaatagcctgttcgtaacgctctttaattatctctaacttagcatgggtattggtaaaattttgaaaatagactaagtatttattaacctcgggccactttctatgcatgaaatcaatttctttatagaattgttcacgaataggagcttctggagcaactatagcatcccctgaaccagaaactgtgcaaaaagtgcatcctcctctagcaactgttccgtctctgttaggacagtcaaaaccagcatctataggtaatttaaatattttttctccaaagagttctcgataataatcattaatcgcacgataacgttttttcataggataattgtatcacaattttaactaaaataacctcactactacaataaaacttaaaaagattggaacgtcagttagtcccaatcttttatttacttcactttctttaaccaatccttggctaaaaagatatacgcagttagattcaaaataccataagcaagtataaaaccagctaaaacatctgtcggaaaatgaacccctaggtaaatacgagataacccaattaaaaaaatgagcaaacccaaataaagtaccttggcacaacagtttccatatactcttaggcatatagtactgcaataaaataataatactcccaaatatcataaatgttcccatcgagtgcccactgggaaacgaatagccacctgcaaatactaaatgggttaaagttggtcttactctttgaaaaataagttttaaagaaagtatacatataccagagataatagcatttactgcgataaatctagcttgaggataccacttcttaaggtaacagaaagtgacgctcataatcgcaatagctatctggcttacagtattaccaatcacagtgattaacttgaaaaatcttgtagaaagatttggcaactgtcctctaacactttcttgaatgttttggtcaaatgcaattacagtgtcgggccaatatttgatgaccaatcctaaactgaaaaataagataatagcaataaatgcttgaataagtttactattttgacgagataacattagtctttttatatctttctaatattggcaaacaagccacgtaagttagatagaaaacaatcgaaattaaaattccctcaacgatattaaatggaataaccattgttaaaaggtaattgcctacaccaataaatgttctgatatcaaagttagcaaatatagcatacaaaggaatcgcaaagacatagttgagagctaccatagatacggtcaagctaactgtaccaaatagactagctttaataaaatcttttgcactctctctatttttccagaaaatagcgaaacttgctaaaaataaagctagagcaaccatattcatcggtaaaccgataaaggtttctggaccacgattagcaagtataacttttaaaagtgatcttaataagagtacaccataacttgatttcaaatcaaataaaataaaagcaactaacatcggaaggattgaaaaatcaacctttaaaaattctgctcctggtattaatggaaatgaaaccatcatcaatacaaaagataaggcagaaagaatggcgattgtcaccattttacgtgtatttgtcataaaaaaattcctccaatttaaataaattgaaagaagctccaaaggtaagcgtatgtacgcgaaaaaaacctttgtcttctcccatccagactttactgtcggttgtggaatctcaccacatcagctttcgctcgcggactgatgcttcacaactgacaaataagttggaagcgattaccgccggtcgggaattacaccctgccctgaagacacctatagcataacaaaaaaaacttgcaattgcaagttttttaattactaattagtagtagtgattaaaaatcatattaataccaaattactatgctgtatcgtttctttcagatttgctatttttagtttttcttaaaaagataaacaaaattcccaaaataatacaaccaagaattgtcagtcctccaccaataatcattcctgttttaggaagaaatgattgtggaaaaagcggttgtgatggtttaggatttgttggtggaggagtttctttttcgttttctacctctacttcctgtgttttattagcaactacagcaactacagcatccttcatagatatacggtaaccagttagtgcttttgcttctcgaaaaatatacttaccaggtaataaaccttcaacctcaatttctcccttatcatcagttactaatgaagtaatcccatcttgatcggtcgtaaatcgtccatttttaaagcgaactggctgattctggttatcgtataatacaaatattactcctgatagccttttctttatctttccttcttttgtatatttaataagttttaatcggcctgtttcaacttttcgcttaggatttatctgtaattgatttgataacttatcatctggtatttcaatataaaaaggtactattgttgaaacgctttgatcagctttataagcacgaccaaagtacgaaccatttgggagtgctatctttgtctgaccattagtatcagtaggagaagtcaagatactcttatacttctggttcaattcgctatctgtcatttggctcaataaatcaacttttaagttgtcagtcacagtccataaacgataagaaatcccctcctctgtagtatttggctgaagtcctatctgtgtgattgttagttgattaggggtatcagcatttacactggctaccgaaaaaaacgctaattgtaccaatcctaaaaagcaacatagtagaagtcctaaactttttctaatctttttcatttttgatttccctttctttttctctctttaaattttcgttttaaatataatagtaaagcgactaatataagaataactaggattgataagaggaaataaagtttatagtgtgtttgcaattctttcattaaatagttcttttctttaacaggaggtacatacttgattcgatgccctctaactagtaaacgatgtgaattaatcgaataaggtgtacatgttagcaaagtcgcataatccttacctttaacaaccaataatttagaaaaattatctggctttacaacacttatttgatcaaccttataggctaaaacttctttgatattatgaatataaaaaatttttccttttttaagtttatctaaatctgtaaataacttagctttaggtaagccgcgatgagctgtgataacagtatgtgaactttttccaccaattggcaaggaggttccttcaaggtgtcctgctcctttttcaagaacactactggtagtccccgcatagataggtaatttttgcttgatagacggtatatcaatatatccaatcatttcagtaatctcaagcatgtgggcgtattcagcaataccttttttttctttttcagtatagggatctgataggcggcttgggtccagtgttctattataagcttttgctaactcaaatcgtctattaatctctttagtatttaatttttgggtttgattatcaaagttagttacttgattattagctttaatattatagtaccaatttgaaataaaaggatatgaggttatcaaaagaccaactaagaacaatagtatcaggcctacattcatccatcgatttaaaacgaccgatttcttaaggtttttctgaaattttcctcccattatgattcaattccttttctaacacttgctaaacgatttttttgacgttgacgttttattaaccaaagtaaccaagcaataataactaaagatatatagaatagatatctataaatcgtgtttaaatgaccttcttttattaatttttcatcaataggacctttataagggatacgatgtccccttactaaaagtctgtgtgtattgatcataatcggggtgcaagttaataaggttgcataatcatgtccaggaacaaccaacaaatctgaaaagttatcgggtgtaacgacttttatctgatctacttgatatgctatcgtttcttttatgttttgaatataaaacttatctcctttttttaactttttaaggttagaaaagagttctttatctggaattcctgagtgcgctgttataacggtatgtgtgctatttcctccaattggaagagaggtaccttctaaatgccctgctcctttagatagaacttcttgacttgaacctgcaaatatagggagtttttgacctatcttaggaactgaaattgttccgattttttcacttacctctaacatacgggcgtactctgctacccccttttgaattcgttttttctcataaggatcttcaagatggacattatttaaagaatcattataagcttgtgctagagtcatacgacgattgatttctttctgactaagttttttagcagctctctcaaaatcctgtgtttgattattagattctatcgtatagtaaaaacgtgataccactggatacaataaaatagatagacctattagaaaaagaatgataaaaggaagatttgacttcttctttttttttgtttttttgttgatttttttagtcttcacgtcatctcctaaataatggctcttgcttatgatctaagagtacttctactgaaatacccttagatcataagcacagctttaactgtgcttatacatcatcaaagactagccttaagcttcctttgattggcgttttttcatgataactactgctccaagcataatgcttaaaccaataattgtgaaaagaattgtaccaataccacctgtttgtgggattgttacttttttgttttgtacttgtttggcatctttttttacaggttttttgttatctgcgttgtcagttttagccccttttctgtatgatgtttgatttacttcaaagtttatattacctgccaatttcgcatatcctgctggtgcttgtgtttcttccaggttgtaagtgcctttttccagacctgtaatttcaaattgaccttggtcgtttgaggtgtatttaatggctttatcagcctttttatctgttatccattcatatgcttttgttagctttaatgaaggcttcattgtaatctttttgtttttttttgatagtttcttttgctgtttttcctttttggcctttttgtttttttttagtcaagttgttataagctttgatagcttcatctaatgctattttagcagtttttgcagctgcctttttttgagcttttgcttgatctgctttacgtgccaggtattttccttctgagtttttcacaaggaattttgctcctgccaagcgttcagttttagcttgatttgttttgacaaatttctttccatgagtttccacttttggttctgttgggttgattggtgttgggttatttgagtttttgttgttgttgatggttactttaccattttttagttttatttcttttggagtgtagccggtaacacgttctgcgatgctgtatgttttggtattttctagacctgtgaatttacccgagtattttccaggtgttttggttttgttgctttttgtgaggtcgcttttacctttgtatgtttttgtttgtttttcttgcgcggtagttttatctttatctttcaatgtgtaagcaacgtttacatcattagttgtactttcttctgcccagtttttagtgacttttatttcttggtttgctggtgtaccttgttgttgtttcctttctttcgttggtttgttaccatagtccaatttgatatcattggtttctggattttcaatagttgtttggccgttcaccgtagctgtgtaagtgattttgatttcaatatcttttttttttgctgctttttctacttttgccagtccttttgctttgaattttagtgtgaaaccttggtcatctgttctgagtttgtagtttgtatccttaggaaaattttttgtatttcctgttgctttaaggttgttagttgaacccattgtcaaaccttttgtcattctatctgtccaaaccagttttttgtattttgagcctttgtgaatttttgttttaactttgtattgtttttttttaccgattttcgctgtggcagttgctttgtcacgtgcataattaccataatttgcgccagctgtcaaaagtctattttcgtttgtcagtgttgtcaagttgtttgtcttttgcaaagtttttatctatttgtggttttttttcagtgttctttggataaatgtgggcatctttaacaacaccttgtttgtttaccaatggcagagtgattttaactggaactgcttttgaatcagccaggatggaaccgttgttgttgtagtttgatttttctttcacttcaacgattttgtactttccttttaattttttggtgttgaaagcaagtccagtgtctttttttggtgttgatccaggcacggcctcatctttattttcttttgtttccggagtatcgtctttcttaattaaggctggtgttaatttgttaccttctttttccttaatgtattgcattttaccagttttattttttttcaaagctaaagcaaagaacgcacctttgatttctttagcttcgtttgagccaaagtaagctttaaggtcattaatttgtttacctttgtagtctttttcgttcttaccttttgttccttgggagttacttttgttaagttttgcttgtgttttgacaatcttgtgcaaggtcactgtattagttgttgcttcgtccgcaaacgctggtgcaactgagagtagtgacgttaaggtcagtagcagtgtcgagaacattgtaagatatttgttgatttttttcatttctatctccttcttattttagttaatcaacatggttaataatatgcggattttaatattaccgcagcaccactcctttcaagtcatggaattttatttaattaattaagaatactaaagcgcatgatttttaatctttttttctggatatatcactagatttcttatatcttttccaaatataaattccacctgcaatagacatcatagctccacctattaaaatgaaagatagaattcctttcccacctgtcatcggaataattccttttggtggaatatgcgtgttggtaattaaatgcttgtcaccttcctcatgatattcagaaatctgtttattaacagctattatattttttatcgatcctttaaccacttcaaaagttaaaattggtttattagtaattttttgataatccttcggcgaaactgcttctattaactgatatttgccatctttcaaatctttgtaagaaattttgccgttttctcccgtcactacttttgaattattattttttattggtaaataaagtttataatcttcattaaattcttgaagttcaaacgtagctcctttgagaagcaacttattattatctttatcaacttttgtaaattcaatttcacctaacttcttctcgtttttaatcgttattgtaggatattctctcacatcacgaattttagggattggaaaatctctaagtgtattaggatcctctgatttaggattcaatgttgttctaccattagtgtcatagaatttgttacttataaaactgtcatctagtttcacatcatatgtgagtgttactttttgtccttctcctaagttcaaacctctaacgtagagtttatttttgatgtattctaatttaacccctttaagtattccaccatcattattaggcccaccagttgcaatgctatctttcattatacttccatcatttccctgtaaagtataatcacttggttgtaatgtttgtccgttgccaagctgtaaattgattttgtcacccataggatcttctatagttccattaacaattgagttttcttttgttaaaatcttttcaaattgttgctgaattttagataaaatttcattgttagatgtatcggctgaagttactatcggggtgtagtactcaggtttggaagagaatgacttcattagttctgttatttctccatctgaaagtttaaaagcttcctctttcaatttttgaaaagtaccatcttgatttttcttatactcctcattataaacttgtctaaaagcagatatatctataccaaaattaaagatgtcataatttttctgttttaaactatttatataaagtttggttggtgttccatgttcttttactggtccatttcgataaattgtacctttagggtaattaagatttaaatctaaataatgaagtttttgtaagtttccagagattatctgtgtttgataactatctaagggaaacaaaaagtaactctccccatttccttttatatcctcgggcttatcagtaagtagaaaattacttttatttagatatccattttttttcatttgttcaaattggctttcatatgatgcacccagtttaaaattattaatagcatatgatcttgttggaacaccatcagttatatgaacaataattttttgactatttcgatctacttgactcaaaatatcatctgcctccatgaaggctttcatagtaaatgtttctcctactttactaagatagtactgcttttgttgctctggagttagtccgtttgtagttgatccccatttagctttaggagcttctgtcggaatcctttttataatctcttcagcattatttgttaattgtttatgactataattctctgtctgaattgtgaacttagtttgaaggccataatatttatcatcttctttaaattcttttacgacatctacactcctaccatcaaaaatatctgaaccataggtaactaatgcaaccctattatcactgtttgctcctaaaatatcttttactgcggtcccaagagcttcggcagctttcttggctttattatgcctttgaaaatttgggccatcgttattcattgagttagaattatcgagtacgaagacaacatctaacggcttttgtttgtccactggttttactatggtttttccactgacagttaactcaattttatatttattatgagctaaatcacctacttctgaaatacgtttagataatgttccctctggaatttctcttatatgctcaccttcacttgaatatgggttaactgcttttgcctctgactttccatttggaactgaacctttaacatgctcaagtttataagattcctttgtatcttcataaattcctgtggggggatactgcttatctagttcttcgtgattttgtccaattgtggaatttttatcaccactattttgtatcgtagtttttccattactctcaaccttaacttgccaagtctggttagtctttttataaccttcgggcgctgtttcttctgataaagtataatctccaggtatgagattatcaaaagtagcttcacctgttagctcagcagttactttttctattttactttctggatgagcagtagtttttaaaacaaaggtagcttttgaaagtggtttgttctggtcatctgtctttttaacaactaactttcctttagcaccattttccggtacggtactttcccctaaaacattggtattaagcggtatttgcgacaaacaaaaaagacttaacgtcaatattttagaaaatttttggtattttctcattttacaactcctattgtgccgaaatgtcgtttctaaatctaagatcagatacagaatatcctagaatatacaaactatcacttattatgatatcaataatttcttattataaggtatggaattttaatgttttttcccaatttttgaatgatttttctttttatttgataatcttattttttattatcttagaaatatttcaattagcttaagtagttgatttttctttttttatgttttaaaatattgcttaaaaataatgtttgagagagagtttactgaattgattgaaaattatttagaaaaagacatccttaatcaaataaaacttctaactttatgctatgattactacccttccattactctagacaaatcatgtcatcaacttggtttatctgaactacttattaggaaatattgtcatgatttaacaactttatttaacagtcaactctctctgaatatcgaaaagagtacaatagtctaccaatctaatggtgtaactagagaacaagctttcaaatatatttatcatcaatcacacgttttacaacttttaaaatttttgatcacgaatgattcaggcaggttacctttaacttactttagtgaaaaatttggactatcttgtgcaactgcttatcgcatacgaaaacatattagtccgttactagaaaaacttggatttcagattttcaaaaatactattaccggtgacgagtatcgaattcgctatttaatcgcatttttaaatgctcgatttggtatagaagtttatcccttgtctaagatggataaattgcttatcaaacgattgttattagaatactcaactacttttactgcttctcattacttcccaaatacatttattttctttgatacattgttgtctctatcatggaaacgtattaattataatgtagttgtcccttactcaccccttttcattgaactacaaaatatatttatctatgatacattacaatattgtgtcaaaaatgttattatagattcctttaaaattaatttaaaaaaagacgatatagactatatttttcttgcttaccttacttcccataactctttttctaatccaaattggactgagaagcgtatcgataatgtaatagctattttcgaaaattatcccaaattccaaaaattattacagccactcaaagatgctcttcccttatctggctcctatcatgatgagttggtaaaagttgctatcatttttttccgaacatttattttaggattaaatcaattaatccctgaaacaatttcatttccttcatggaactatcatagacatgataaattaactactattctccgaccgataattacaaattggttaagtgaaattggagaatacacgtttaaggaacaacattttcttctcctttgtgctcatctagaaagaattatcaaaaatcatattcctccgatacagatagccgtactaactacagactttattaataaccaaattttaacagaatgtttattacagaggttttcttctaaacagattcatttccacccttactatttattaactgatgatctttccaatattactaatcttaatccagatattattattaccaatccaaagctttcttcctttatcaaacatgagatttcttcagagagtttaattacatatattgatttgattcatacttcagaccagatcaatcaaatccaagaaattatttcatcaatacaggaagaaaaatattgtaaactttttgcaaaaactaatgaaataactactcgtagctcctataactcttaaaaattaacattaaaaagctagagcattgtgtaatgctctagctttttaatgttaatttttttgaataatataatccaacttttcaactgttttttcccatgtgaaatgttctttaattcttttagcaatattctgttgtagtttctctcttaatgccttatcttttactaataaatcaagagattcatggagtgactgagtattttcttccatgatgattcctaactcagggctatcaataacttcaactgttccaccgcgatctgttgcaataatagcacttgaaagtagaccagcttctaaaatagaggttggtaatccctctggatacattgaagggtaaacaaagatatcagtctgtgccattaaagacatagtctgttcaaagtttaatttccccaaaaagttaatctgtttggactgatatttctctttcaaatgtgctaattcaggtccgtctcctgcaatctgtaaataaacattttcagagtactgtgacatcgaaaatgcttctaagagcaattcaatgcctttttctttaataattctaccagcataagtgatgaaaatatcatcagcagatttttcaaggtaagccgtaccagcaaaatcagagcctagactttcagataccgaattataaataactcctttagcttctatattaaaatgttttaaccattcaacgcttctcttggataccgcataaaaatctggacgataatgcttaacacgcgctgtgagaagatgttcatagatagctccaaagaaatctaaaaaacgattattgacagaaaaatgacttgacccatggtctaaaacaatactaggtaaatggtgattctttgcaaaagatagcccttctagcgttgttaactgaaaacgtgtattacaaatcacaaaatcaatattttcatctgaaacatatttcatcagcgtgttgtattctcgatttttgttaataataggatagcgctgcttgacaatatttttggtcggtaaacggtaaatttttctacccttgtcttcatctataatcggtaaatcaccatgattagttgttacaataacaacacggtagccacgcttaaccaaatctgctgtcattttatctgtataacgttcaatacctccgaggaagggtagataatatcctgagaaaacagcaactgtttttaccttattttccatatttatccactttcatcaataagccatcttttaagcctttaatcatagcaactatttttttgctcttttgctcttctgctaccaacactcgaacaaattcatttcgcataaatactaaatatttgtatcgcttcttcttaccatatttttttataatatagatcgcattgcgtatcatgtaatattttcgaaatggtgaatgattcaatacatgaaaaacatggccaaattttttaactcgtgaagagtgtccaatttcgtgtaacagaccaataaaattaacctgataagtcttatatcccatctctgacagacgataattcatttcagagtcaacaaaatcaataaacatctcttctgcaaagccagatgtttcttcgaaaacgctcgttttcattaaagcagccgaagtaatacactcttcaatttctttatagtcaaattcttgcatcactaaattttcacggttcatatcttgatacaaacaagataacataccgaccttaggtaaatgaaggtaattttcataattatctatcaaatcacctaggacaaccgaatcttgatctaaagtcaagaaccaatcaaattcttgtgctactgcaaattgaccgatacagttcaaagcatatgcaatccctttattttctgttaaataatcaacagttaggtgcccctcttcattataatcggctactaattgagaaatttcttccttatttttcgagccattatctacgatatagatgtggcttacttgaggataaattgctcgaatgttctgatctaagcgttcaatattggggttaaaggtgacaatacccgctaaatatttcatgttctatgctcttttctaaaatctctaaataactgaatgactggtgctttggttataaaaacgataccgacatagatagttactgctactaaactttgaatgacataatttaccaatgatactgacatttgagtattgatataatagagtacagctccactaagagtagcagcaattaaatagcgcagcattcctcttgttaattctttaaaagtaaatacatctcttaaagagatagcttgatatagggagacaataaattcagtaataactgtagagataatagctcccatagcacctaaaattggtattaaaagtatattaagcacaacatttgccacaagtccaataactgcagacattgtgtaagcttttgtacgtcttgaagccagtagatactgtgtccctaaagcgttaccataagaaatgcaaatgatcatcaaa

SEQ ID NO: 548 - DNA, 8697 bp, S. agalactiae
tccacatcggtccaattaacatatgacgtggcgcatcaccagtaattcggtgaataacaatatgttttggaataatctccagttggtcacaaataatcgaaatatagtcttcttgacttaacaaacgtaaacgaccttcatggtaatctctctgcattcttgtattagtcataagatgcagaaggtgtaattttataccctgaatatcattatccgtaacacatcgacgaacattttccaccatcatatcatgtgtctcccctgggagaccatttattaggtgagaaacgatttctactttaggagctaattctcgtattctcttaacagtttttttgtaaaggtcatatgaatgtgctctatttattaatgcagaagttgcttcataagttgtctgaaggcctaattctaaagtcacatgcattctttcagaaagttcagcgagatagtatatagtttcatcaggtaagcaatccggccttgttccgatgttgatcccgataactcctggctcattaatagcctgttcgtaacgctctttaattatctctaacttagcatgggtattggtaaaattttgaaaatagactaagtatttattaacctcaggccactttctatgcatgaaatcaatttctttatagaattgttcacgaataggagcttctggagcaactatagcatcccctgaaccagaaactgtgcaaaaagtgcaccctcctctagcaactgttccatctctgttaggacagtcaaaaccagcatctataggtaatttaaatattttttctccaaagagttctcgataataatcattaatcgcacgataacgttttttcataggataattgtatcacaattttaactaaaataacctcactactacaataaaactaaaaaagattggaacgtcagttagttccaatcttttatttacttcactttctttaaccaatccttggctaaaaagatatacgcagttagattcaaaataccataagcaagtataaaaccagctaaaacatctgtcggaaaatgaacccctaggtaaatacgagataacccaattaaaaaaatgagcaaacccaatgtaccttggcacaacagtttccatatactcttaggcatatagtactgcaataaaataatactactcccaaatatcataaatgttcccatcgagtgcccactgggaaacgaatagccacctgcaaatactaaatgggttaaagttggtctcactctttgaaaaataagttttaaagaaagtatacatataccagagataatagcatttactgcgataaatctagcttgaggataccacttcttaaggtaacagaaagtgacgctcataatcgcaatagctatctggcttacagtattaccaaccacagtgattaacttgaaaaatcttgtagaaagatttggcaactgtcctctaacactttcttgaatagtttggtcaaatgcgattacagtgtcgggccaatatttgatgaccaatcctaaactgaaaaataagataatagcaataaatgcttgaataagtttactattttgacgagataacattagtctttttatatctttctaatattggcaaacaagccacgtaagttagatagaaaacaatcgaaattaaaattccctcaacgatattaaatggaataaccattgttaaaaggtaattgcctacaccaataaatgttctgatatcaaagttagcaaatatagcatacaaaggaatcgcaaagacatagttgagagctaccatagatacagtcaagctaactgtaccaaataaactagctttaataaaatcttttgcactctctctatttttccagaaaatagcgaaacttgctaaaaatagagctagagcaaccatattcatcggtaaaccgataaaggtttctggaccacgattagcaagtataacttttaaaagtgatcttaataagagtacaccataacttgatttcaaatcaaataaaataaaagcaactaacatcggaaggattgaaaaatcaacctttaaaaattctgctcctggtattaatggaaatgaaaccatcatcaatacaaaagataaggcagaaagaatggcgattgtcaccattttacgtgtatttgtcataaaaaaattcctccaatttaaataaattgaaagaagctccaaaggtaagcgtaggtacgcgaaaaaaacctttgtcttctcccatccagactttactgtcggttgtggaatctcaccacatcagctttcgctcgcggactgatgcttcacaactgacaaataagttggaagcgattaccgccggtcgggaattacaccctgccctgaagacacctatagcataacaaaaaaaacttgcaattgcaagttttttaatcactaattagtagtagattgtataatattaatttttaacatcaattaattgacagcgcactaatactctagctactcctgcctttgtacaagtaaacaagcttaagtcccaatcattgtctgatgtggcagttttataaactttttcaatcgctgttggttcaataatttctctattactgattttgtagtgatagatttgccctgttgtagttgtaaaataaacatccgttcccatatctacattttttaaagcatcaaaatgataaggaaaattatgcgcacaaatcaccatgttattagttaaataagaaccataataccttgtaggcgttttagacagttgttcaaaactataattagcagctaccggtaaatgcagttttaagttcggaatatccagagttcccaagtaatctgttttatccaacttttttacaggtaattctccattttctgaaccctttacttgatgcgtaatagatttatcaagcgccttgacaatatgctgagaagttaaatcagcttgatgcgcctgattaatattataccaaccccaatagattccagaacttaccagaatgattccgagtatcgctaaaaaatttgctgaatatcttctaatcacgtcttcttctccattttaaggctattattaaacacagaagtcctgacataattagtataggtattggccaccatacttgtccagtaaacgggagctttccctttgtctgatgtgttactgtaggagtaattgtctcttcttttttaggtttagcatttaaagggctcattttctcaaatgctgtaatatcgtacttcccatccttaggtattgatagtataaagggagacattagttcataaccttgagctgttttagtctgaataaatagataaatcccttgaggaagattgttcgcaacaataccttcagccggtaaattatcaaacgtttgtaaaggttgagttttatgaacagcttttgttagtagattgacgtatttggcttggttactatcaaggtttacttgtgttagatcatcgtcttttattccaataccttgaaatggggtagttagagtaaaaacttggttaccatcaacatctttagcttgtgctacttggtaaacaagtaaattaccgccagcgataccttgattattatacttattttgtatagtaatagaacccgttttcatctgatcattggtatcagcagacacaagttgagtacttagactaaataataagagaagagttatctttaggatctttttataaatcattgttctcttcctttctcattgcttgttttaaaattttcttacgttgacgtgctctcctagttacttctaaagagattaaaagtaaaatcaaagtaaggaaaatagcgataaatggtgcgatataaataggctctatttgtattgcctctgctactaccaaagcgttaccattatcgtttggtacacgatgtcctctcactagtaaccgatgggtattaacgccatatggtgtacacgtcaccaaagtttggtagtctttacctttaacaatttgtaaatccctcaaatcatccggtttaactgttctgatttgatccacttgataagtatatgtttcatttaagatactgactgtccagtggtctccagcttttaacttatccaaatcagaaaaaagccttgaagagggtaaacctctatgtcctgataaaatagaatgagttgagtctcctccaattggaagactacttccttctaaatgaccaatagaagtttgaagcactttttcacttgtaccatgataaagtggtaattttatgtttatctttggaattgaaatataacccatattacccgttttatcgatagccagttgtgaattataatccaaacgctcttggttagtcatgtgccacttcattcctgaagttttaaattgcttattatattctttggctcggttaataatttttttatagtcgttttcatccatatgcgttacgcggtcttggtaatccataatcgctcgagattggtgaaatgaattccaataattagcaagtgaaggataagccattaagcctacccccactgcaattatagtgacaagcaaaatggatactaaatgttgtcttatttttttcatatattttaaatctgtaccactttgctagcccatcttattaagaacgtaaacgacgacgagcaacaagcacgatacctgctcctattactaaaattgcacctataatgtagaaaattgttgtaccaataccacctgttgaaggcaactcagtacctttgttattttcaacagttgggttaactaaaaggttatctgaattagtcgtatcagtggctccatctcctaaaataaccttctgagagttatctaacaaattgtaacctaagggagcctttttctcaactagatagtatgtaccttctttcaagcctgtaatggtaattataccatctgctcctgttgtatattctgttgcattagcttctgtgccccattcaacgttatttgtatcgttaaagtttagaaattgacccgtagcattctttaaaacaaatatagcaccttgtaatgaagcttttgtggaaccatcaattttttttatagtaatttgaccatccctcactgttactttttgacctgggtcatcattgctagtattggggttgatggtcgcaatgtttgtattttctggtaaatcagctgaacctggtttagctccactctttaatactcctgtataagtgactgtgattgtatttattcccttataaaaaaagtcatcattagctccattttgagtatttccggttggagtattggtagctgcccacggaatagtaatcgtgaaattattattttcctctaacaggttatacttcccagttgctttttccgaaccttgagttagagttgtaatattccctgatccatcagtaatagttacttcataagatccttcgttcaaatcaactacagaagcagatggcatagtatcctttataacatattgatacactttttctgtaccatgataattgactgcattcttataagtaatagtatatttgactgtatcaccaaccgagtacgttttttgatctacagtttttccaccaccatctccccatgtcgcatcagtattcttttcatgaatagtagcatttggagttacagatgtaaccataattacagctccattattaacagtgctagaaacataataatatccatattgggaaacattaataacctcagtaccatcattatttgactcagtaacagtggaaactggtgtagtattagctgatatagatttagcccatgtcgcaatctcatttgctgacgcagtatcttttttagttacatatgttctccctccattagtagttgtcgtaaaaagagaattaaaatcagttgaagctttatactcagcttctttaccttgaggaattaaataagaagctccatctttattcgaatcagatacatttgcattatctatttctgcatcaaaaactttgtatgctttataggttgcgcctttttgagtatcttgaactgtaattgtccctgtctcagcggcaaaagctatcggcgtaactggtgatacagccataccaaatgctaaactcgccactaacagcgattgaatcattttctttttcattgaaatctttctcctaaaatcatattgatgaatgattaattcatattttttttcgatagtataatattaatcctgatggtagagctaaagctaaaccaactaggatataaatgtgtgttccaatacctccagtactaggcaattctgttcctttactgttagtaattttaaaagtatatactgtacttccatctactaaattctcttttattggtgtcgcattattaccattttgttcaaaggtaactcccgtagaaatcactaatactgatatatcatttttaggtagtaggtaccctggaggggcctttgtctctgttaggtagtattttcctactggcaaactgaggtagttattagcatccactaataacaagcctttatcgtttgtcaccagccctgaatacataggatgtgaagctttattcccattagcatctgattcataaatatcaaaaactgcacctgctaaaaaattattatcattttcgacattaactttctgtagtcgtactttttgcttgatacgtgtattggtaaagctaatatctacgtctcctgaaactgtcagggattgtaagccggtagcatcataagttttatcagcttcaccagttgctagatttttttctgtaattgactcagatactttaaattcatcgtaggcttgttcatctattgatatagaagttccataaggtactttaaattccttagtctgaccatctctcagcggaaaattctcttgttgcaacgtttcacttggattaaacaagaagtctttcgtcttatcttcatctagtccaacgacagttttacttactctgacggtgtattctttaggttgccaaacagcatataaggtatttgttgcatcagggttgttatcaatacctattgattgacctgctgtaaattccacacgtcctgtatcagctaaatccttatcatgatgccaaccaataaggttgtaacctgtccttgtaaagtattggttttcaggaattgtagttgtgctattcaactccatacgcggtgtctctacttgtgttaccacattaccattttctactctagtaccaccgttaccattgtatttgattgaggtatcttctaatttgatatctcctactggaataatgacaggttttatggtgatatttttattagcatctgctaaatgggcgtcaatatcaatggaatcatatgggttataaattttaccattgtaccaccagccacggaaacgatagccatctggcattgtcggacgtctcagtaaggctgaatgggagccatcgtcataggaatcagggtcagtaggctcattacttgtttgtaattgctgaccagaagcatccaatgctggctttccatctgtaccaacagcatcattgctgtatataatatgataatctccagcctttcgccaaatagctcttaaattgatatcttgagttacagcacctgaaaagttataaggtctaatactaccatctggattaacataataccaaccgactaatttgtaagcgtcttttacgtacttgtacttagttgttgtatcaacatttgagagactagtatctgtcgtataataggcatctttagttgagtcgggatctttatctcgtgaatcatacttataataatatgtacctgaaggatcttggatataatcccttgtaatatctgtataatccggaatacgatcaccataatgcaagtctaaataggtatcatctgtttttgataattggcctccgtttggatcaatattgacacgatatgttaccttttgccaacctgcatagactttaacatcatgaggaggcatagtcgtgttaaagtcaaatacttgtgtttgtgcttggtctttataccatttaccatcccaaacataccctggtcgactaggtttaggttgaaccgttgtcgtatcgggggcataagaggacaaattttgctcatatagaacatcctttactggaaaattaggaagctctgtattatcaagcggatctaaatatttaatcttgtatgaattacgttcataccataccactaagttcaaataatctttgtggtagtctccatatttatcgtagtattcatctgcgattggcacttttgtttttgcactcgtttgtcttgggttctgatcaaaatggtaattatctggatataagctttgatagtatttaacattaaatcctaggtatttttctgtaaaggtaaattcgtctgctccagcacctccccctgtgtctgctaaagagtatttgccatctagtccttgtttgtagaacggataattttgaattctctgaccttttggatagagttttatttcatctggatttgctgtatgtactccattgggtagtatgaactcacccaaataactcattccttatgttccagtttggttatttccaacattggttaggtaacgccatgcacctgtcttccattgatagccattcgcggctaaggttgtaccgtatagtcctgtgtaggtttcggcatctgatgctctagttctaggaatcgtagtattttggtaatgaatctccgagtagccctttaaacattaaca

The invention claimed is:

1. An immunogenic composition comprising:

a first and a second purified or isolated *S. agalactiae* (Group B Streptococcus; GBS) adhesin island (AI) polypeptide, wherein the first GBS AI polypeptide is a GBS80 protein comprising the amino acid sequence SEQ ID NO: 2 or an immunogenic fragment thereof and wherein the second GBS AI polypeptide is a GBS67 protein comprising the amino acid sequence SEQ ID NO: 16 or an immunogenic fragment thereof; and a pharmaceutically acceptable buffer.

2. The immunogenic composition of claim 1 wherein the first GBS AI polypeptide is the GBS80 protein.

3. The immunogenic composition of claim 1 wherein the second GBS AI polypeptide is the GBS67 protein.

4. The immunogenic composition of claim 1 wherein the first GBS AI polypeptide is the GBS80 protein and the second GBS AI polypeptide is the GBS67 protein.

5. The immunogenic composition of claim 1 wherein the first GBS AI polypeptide is an immunogenic fragment of the GBS80 protein.

6. The immunogenic composition of claim 5 wherein the immunogenic fragment comprises SEQ ID NO:3.

7. The immunogenic composition of claim 5 wherein the immunogenic fragment comprises SEQ ID NO:4.

8. The immunogenic composition of claim 5 wherein the immunogenic fragment comprises SEQ ID NO:6.

9. The immunogenic composition of claim 5 wherein the immunogenic fragment comprises SEQ ID NO:7.

10. The immunogenic composition of claim 5 wherein the immunogenic fragment comprises SEQ ID NO:8.

11. The immunogenic composition of claim 5 wherein the immunogenic fragment comprises amino acids 388-398 SEQ ID NO:2.

12. The immunogenic composition of claim 5 wherein the immunogenic fragment comprises amino acids 467-478 of SEQ ID NO:2.

13. The immunogenic composition of claim 5 wherein the immunogenic fragment comprises amino acids 526-543 of SEQ ID NO:2.

14. The immunogenic composition of claim 1 wherein the second GBS AI polypeptide is an immunogenic fragment of the GBS67 protein.

15. The immunogenic composition of claim 14 wherein the immunogenic fragment comprises the amino acid sequence SEQ ID NO:17.

16. The immunogenic composition of claim 14 wherein the immunogenic fragment comprises the amino acid sequence SEQ ID NO:19.

17. The immunogenic composition of claim 14 wherein the immunogenic fragment comprises amino acids 331-342 of SEQ ID NO:16.

18. The immunogenic composition of claim 14 wherein the immunogenic fragment comprises amino acids 478-488 of SEQ ID NO:16.

19. The immunogenic composition of claim 14 wherein the immunogenic fragment comprises amino acids 694-717 of SEQ ID NO:16.

20. The immunogenic composition of claim 14 wherein the immunogenic fragment comprises amino acids 92-103 of SEQ ID NO:16.

21. The immunogenic composition of claim 14 wherein the immunogenic fragment comprises amino acids 717-808 of SEQ ID NO:16.

22. The immunogenic composition of claim 1, further comprising an adjuvant.

23. The immunogenic composition of claim 20, wherein the adjuvant comprises an aluminium salt.

24. The immunogenic composition of claim 20, wherein the adjuvant comprises 0.5% squalene, 0.5% polyoxyethylenesorbitan monooleate, and 0.5% sorbitan trioleate.

25. The immunogenic composition of claim 1, further comprising a carrier protein, wherein the carrier protein is a toxoid.

26. The immunogenic composition of claim 23, wherein the toxoid is CRM197.

27. A kit, comprising the immunogenic composition of claim 1 and a package insert containing written instructions for a method of inducing immunity against *S. agalactiae*.

* * * * *